United States Patent 7,868,149 (PLANT GENOME SEQUENCE AND USES THEREOF) - sequence listing, part 116

SEQ ID NO: 63955 - DNA, 8600 bp, Oryza sativa
caacggcaaaggaaactcgcggcttgaaggaaagaggtcgatccgaatcgaactcgattccacgaacttccaaaccgatttagccgaagattccaaaggagaaaaaggtagaggagatcccggagattgtttcccctcttttgattcgaccagagaaggaaaggaacggccggatttggaaggaaacggcggcggcgcgaaactagggtttcggcggcggcggccgaaggaggacgaaggtcctgacaggcgggaccctcctgtcagcgacagcgagagggcgcgcgcgcggcggactgggccgaactgggccgaggagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctgggcccattttatattggaatttattaattaaaactagatcttctcttcaagacttttaaaattatttctaaaaattccatttaaacaacaatttataaattttaaattttcagggtgtgacaatggataagtatgaagcaattgaagaaaagtctgacagaccaaattgagttcggaggatgtgtttacctgtgattatttccggtcggggacgagcaggcccttgtactttagcaggagagctagaccctagatcgacattggcatcttttttaggaggattgtcaacttgagcttctacttcgaggatgtccttgtttcgctctgtacccgactggtttccagtcgggggctcctgattagcgtcgaccctagcttcggccgactggtttccagtcgggggctcattgctgggacctacattgtcggttgccggctgttcgtcactcaggcgatcccctgcagtcggctcggtctcttttgaaaaacctgtctccatgccagtcggttcggagtcttttctagaaggatctatgtcagatggcttcctacaagtttgagttatgctatcagtataattttaatgaatgagcgtcaatccaaggaagaccgccaaataatttgtacctagaagacttcctgatttttggcatgggacgactggatgttttcttctttgggttagcctgccttggatgttttccagtcacccctttgctgccagccttttcagcatcatcgtcgtcactcaggaccaatttcctcttacggaaatctgattggttggccgactgagtggtggtgggatgagagtcagaacggatttttggccctccactagtttggctagtcttcccacaaggagtgcggtgttgggtaatcggaggatcagacttcatcaaggtaaactcctgtatattacaagtttttagtcaacctcgcggaagataaaagcatgctttttagaaaggctgagatattaaatacataccggtggaggggggttgaaagcattgtatggtacaactggcagcagatgtgaatagctgacaacgatagcatttgagaagatcttgtacattctttccttcatgaccttaaagtcaagagagtctggatcttcacgatttggatcatgtttgccatcaaattcaaaagccgtgcgggatctctctttgattggagctagccgacttttgatgaagtgccgagtgatctgctttccctgcaaaccttgttccttcagttttagcatgcgctccatcagttccactgcctgagcagcttcatctcccataggcaatgaattccatgtgtcctggcagaccggagggagacaggagtactcggggagtgctggttcaggattctgaacgtaaaaccagtttgcgtgccagcctttgtttgaggtcttgaagggcatggagaaatacttttggcttagtgttcctctgagttggaaaccagcgcccccaacaacgcatggtttgctcttgttcggctggggcttgaggaagaagatgcggcggaacaaagcaaaatgaggtctaatgcccagaaaagcttcgcaggcatgaataaaattggcgatatgcactatggagtttggattcagatgatgcaggctaattccatagaagttcagagttcctcggaaaaatcctgaagttggaagagaaaacccgccataaaagaagtgagaaaataccacgacttcgtgtgtatagggggtcgggaacgcctcgctgaacgctggtcaccacccgatgatctccttcactggaagaacgccgtgtgctaccatttctttcagattctcctccatcacatcggagggcgcccactgactctcaaaactttctctctcttccgccatggatgcgtgtggaatggtttgatttggtccaagatatagctggaggggaatgaggaatcggagcggaggacgcgcggagaagtttcgtgggatttttgagaatggattggggcggattgatgaaccctagcttcgtcggtgcggtttttaactgtagcaaggagtggggaaatggcgagagtctcggcggggaagacgaagcgtcgcttggacttcggtgttttgttagggtatcgggagtactaatgggcctgggcctgtacagtacttcagcccaatattattatcagcgtggcccgttgtgatccctagggacttaggcgctttttgctttggcaatttgtgctcataatgatgtgactcgatgctgctaaaatcctttttgatgcagttagataattctttggaattactacgatgcaaataaaaaggtgcccaacagaaaagtgttatactaattttgtaggccttttaggctacaaatgctgttcgggttttcttgagatgattggttttaatgcagtcatccattcggcatgttatatgcttattttgattatggcatgagtcatagcctaggctatttaaactcatcttttatcaaattttatgccacgtttgataggtcttttgagagtttttactcggccttttatcatctatgttgatttataaacctttagagtgcttctcgctcgggtttttctttatgtttctttggcgcattaaaagcagtcggcaggaggttttatcagatgctgcacatgcttagccttagaccgtttggtttaaaaccactcggatggatgtcttgatgcactctgactatatgtttagttttatttaactaaccacatagtcgggggctacacctaattaggtgcatctagtcgatgcacctgattttttctattcttcagcccttcacagtctttgattttattactcgggagaccaaaacagaggaagttaaagcactcggattgtctttttggattatgagagaagactatttcgtcgactgtaaaggtctcaggggctactgtggagattatggataccccatacctacacggcatgtataaccgactgggtatggggtgccatgtatagatagaatatctttaaagggactcgggttaaatattaaacttgtatgtcaaggaaatatccaaggttctagtcggttacgattgtattttatctgtaactacctattccgttagggatatggtctgtactttgtaatacggactcctcccctatataaggaggggtccgggtgcctctaggggcacgattttttctcccagatcatacaatcaataatatactcggcggatcaatccccggacaggagtagggtattacttcttgaataagaaggcctgaacctatataaaattccttgtctctgaacccatctactttttcagcttgatagccacccccttttagtattgccgaaatcttgtttcgacactgcgtggtcagagaggagaagggtgtaggagaacaacaggaggaagaagggaaggtaaaggccaagcaattttggggtttatggtgacttcgcaactagtgggtttgttcttaaattctagtatcctcgctgcaacggtacttttgtttactttctggaagcataatattcaaatagaaattgattcgatagccgcttacgcaattttttttaggtcgttgggtacgggctgggaaacgtattttcaaatctggtagtaaacaatcaggtttcgggttatgcatcctaaataaagtttgtagtaatcgtcgatatatttctaacaccactggtttcgctcgattccaataaacggtttaggagaaacaacagaaacagtattattgaccgggtctgttttaacatggacaataattagttttacttcatctgagaccaatagaggcttaatctgattttgtgcccaacatgaaaaatttagacaattttatctagatgtccgaagttgtattatttgctagattatattccgttagatggcataaaacagtaatagaactgctgagtattctttactcactcttgtgcataatttggtttttaggtaccaaatgatatcgatcagcatgggacgagagtaggacaaggactacacattttattacactattgaaatttggttttagatcatgattttgcttagcataagttttgcgtagaacttgtaatggtcaattaaagttttggttcacatttccttgtggaatttatggagttaggatggttagcaatgtgctgattaattcgttattgatttatcttatgacttcctgtcgtggatgtccctatttttaggtgaggctctgccgaaatttctaataattttagaagttagtggttttgagtgtattttggtgtggcactttaggtacgtggttacctgggatgttacagttgagaccaacatcgattcggagtcggcaccggcatcgctcgggccgccccacgccgtcaccgctcgggccgcccggcactgtcgtcggatggaccgccccgccagccgccgctgctcacccccagccttcggcctcatattgttctgccggttgggaaaaaaaagaaaggagagagatagagcggaggggaagatgaaagtgaaagaagaaagagagaaagaggggtagatgaaaagtaaaagaaatggtattggtgggacccactataatcaacttgcactgtagagcatttagcttacaatgttcttagtctacgtggcatgtgaaaaacagcaaaaatggaggacaccctgctaatacccgaatgctagagctgctggagcagtgtggactggtttggatcgctgcttcactagggagttgggttggagtggtttggatcgctgcttcactagggagttgggttggagggggaccgctagttggcgcgtatgcgccaccggcgcgcattttttctggggataaggtggttagactaatcttttagttttagataacgatagtttgagataataatggtagtagataagattttctttttcccgcgagatttttttaacgaacaaattgaaaaagaaaatctatatctgaagtcaaattttcaaaattttaaacctatatttgaaaactttcaactcgaaatttgaattttaaattcaaatttcaaaaactttcaacttttcatcccaaatttgaaaactttcaacttgagatttgaaaattttcaactcagatttaaaaattttcaactcgagatttgaaaattttctactcagatttaaaaactttttaactcaagatttaaaacttttaactcgagatttgaaaattttcaagtccagatttaaaaattttcaagtaatgatttaaaaagttttaacacaaaatatttgaaaacacgcgtactgaaaatttaaaaaaataatcagaaaaaagagaaaaagaaaagaaaaaatcgtgaaaaaaaacaaaaaaacgcagcgccggggagggaccgccaccagctggcgcgcgccaattagctttcgcggggtttggagcagttttggactggatgtcaacccactagctgactagaaggacccagctgttcgccacgtgtgcgtgttgacttccacgtcagccttgcccttcatcaggctcaggagctctagcatcgtcaaaagtcctagcggcgggaaaagcgcggcagtttcccgccaaacgccaccaaaatccccaatctcgcgctatcccgcgtcccacaaacgcgccgacggagagacgggagggcaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgaggtgcgggcgcctcctctcccctccccactgtggcggcgtttgtagagtccttttttcctttccttcctcgcattctgtgaacgatttgacatctagactgctgctgtgttggtcagtattgaaggggatcgccgacgggctctcgcgagggaagagaccggaggaaatggagaaattggtgagccgtcctctctctatatatctcgttgcaattctaccacggagatgcgaattccttcatgtatttggggcaaattaaattccatttcttgctggacttttcgatttcaatcttgaacataatttcgcggttagagtttcaagctctagttaccaagtttaccatattttctttaacagtaatcctatctgttttccctccttgtgcttaggtcaaggaattgtggaaagcccatatgaggcaccaggatcctacagagactttgaacaaggacataatatctcactttgttctccgtcttgtctactgcagaacgtaagcttaacattcgttacacttgagtacttgacattccatagacagtaagccggtggtttgcttctggtgctttcaagtttgaacctttgactaacttctcaaaggctttgtgctatacccgcattctagggaggagctgcggaagtggtttctctccatggagactacgctttttcgctatcgctttcggctcgagagtcctgaatcacaggtgactttctgtccttttcttgcatacaaggaaagctatcatgctttaaccgttccttgccacactgtatttttcagaggatgcttatgagtgagtttcgacttccatacaaagcattgccacactcggaatttgaggtatgtgttatggtcactctgttgacttggaccttgatgatttcagtaatatttacagtagtgagatgttcttgttttcacgtttttaggctgtcaaagacaagttgagccaagttgcacgcaccattggtcaatctgcagctggtatggaacatcttactatgtgatacctgttctttatgttgtttcagcacaatggtgcttcgctgcttgcaggtgtgatctttcacttgctaagtttgttctatgttttcgttttgcagttgaatctgtgttcttcaaggtatttgcatcagtttattttacctcttcaattccatatccagtagaaaaaaattgttcgtgtgattacccagtctaaataaaccttgttcgtatccatgtaaggtgccttttgaagaagttccagatcttgttgccagccgccgagtatttctttcaaaaggatatgcttatgttgcgatgagtcaggtttgctgcgaaaacgagactggaaacttctatgtactttttggatgttgtttcctgcccattctaaacatacttgtataatttaataggttgtttcgcttgtggttacccaattccgctgcaatatctcgaaggcacttgttttaacaaataggtacatggtacaaatgttctactttactctgcctagctacatatcatgtccgggaagtgtgctttcttagttctttgctggaaaaattgttgcactcttaggtgatataattaggaacattaacagcattgtctactatttgccaataatttacatagaacaaaagccccttgacagttggatttatttctcaacttagaacactctttagtacaggctgtactaagctataatataaataattcgatgtacagaaaatggacggccaccattaaggaacaagaaaaggataggttgactcctgtgagtatcaattaaccacttcccgtattcctccagacaatcttttcataacttttataatccacactttttatcttaacagattgtcgaagcattgagtaatgcatattttggacctgattactctcaggtatgttgctttatctataggtgtttttccagatattgttaatgggattttcttcaatgctaatgtttactatatttgttattaattgtctggcttatcaaatatccaatattctatacagccaaaggatgctgttgagatttctctgaaggatattgaccaactggctaaaacttctttccctctttgtatgcgccacatgctagagaaggcaaggcaccttaaaagttcacatactttgcttaccttatgatcaggttatttagtgattgcttttatttttcagttgagagaaaaccatcatctgaagcatgggggcagaatgca

SEQ ID NO: 63956 - DNA, 2153 bp, Oryza sativa
ttatcgacattttgggtataatctcattctaccatgccattaacagagtagttaagcatttatttgttttatggttaactttctgttatcagtagactatttatcgaatatgtcaatgggacatgggatttcatatcctaaaactctctgttagcagtagactatttatcgaatatgtaaaagaacctacagctatcactgtctttgtgagttacatgtgtccttttcttgtgtgatatttctagtgaagacaacttgagagcagctctcaataaaatgggaatcagtggtcatccattagaagagataatggataaagtgaagaacaggcactaccaggtactgcacctcacagttctacctttaataagcaatcttctaaacttcgtctgcttgaaccatctgagttatgaaatacacagctagcttgcacgatgacttttgaggcagaacatggtgtctcatgtgatactggaatcaatcatcctaatcagtatttcagtgaaagccagaaagtcttgaaagcaaaggtgggtcaccatagttgatttgcattcatttgtgcattttgtcagcatatgagatgttcaaattgacagtaatttcgttttattccacagaatcaagcagtgcagagccaaggaacaacctaaactgtaatgctgctggcaaaagtcagtccatccaaatgcggaatttcaggtttcgacactactagtctgtcagctgttgcgatgcattgttttctaatatctactggttattggcaacaaatttctaatgttcaattgtgcgaacataaacatcattctcaccctttgcttttttatagctatttttcagtattcagcaatcaaatccatgatatgtgtacaattggcagcaattctaagttatttttcttttaatttctgtttttagttttgatgaaataattttgctgtttttccatatgagatgtttttactcctagatttaaccatgaattaaagttttactcatggtcacattggacgattttcaaatgcccattttttgattcaacggtagtttctaggtttgcactacaaattttcccatttatctttggcttctaaattgcccatgaagttgtggctttgcattctgttcaagtgtgcctcgtcgtttggcctgtctattgttattggaaaggggatataactctatgctaagttctgatctagattttaagagagtatttttctgagttggtttctatgaacttcctgcaaaattcttactctaaacagggttcaaatatcagaacctgctattcctaaactaaggatcattgctgtaatttatacactacactagcaagactctttgaaacttgtagaataataataataccgattcatttgctaatactactgggatgtctgtaaataagatttgcgttaattgtgtaatcatgcccaaaaacagcatgcagaatttttgcatacaaggtaatttctttcctaggaatgctacaactaattccaactgtctaattattctatctacttgacagttcgtatcaagatttcatccttgctgctaatgatatggagaacaacaattactaatctttattctgatgcctagatggaattctattgctttgcacggtttcagaattccaacggctgaatatgtcatcccccaaaagtgatggatgtccctgtaaacatgacttgagcacagaaagtagatagaaccgtacaagtacgtacttgtcaaaaccaaaggaaaccatgattatggatatcaaattattgtttgtgttggtaagtggtaactatgtaaccatggtaactatgaccagggggagttgtgaacacctcatcagttaagttgcgctgtaatgtttctgtaatcgaaaacttgttcgacaaaacaattgcgcttccagatatgcaatttcattaatctgcttgaactattcgatctggctgccttgaccagtctgggctcatgatcctgactagccaaaaaagtctggaggtaaccattcaataaactgtggggcactgatgctgcaggagttctgatgctgtggtagtgcaagcaagcaaccccggcggccgcggcgcacgcgtagaggaagggagcagccccggcggcgacgggcgcggaaggaggagcca

SEQ ID NO: 63957 - DNA, 795 bp, Oryza sativa
tatgtccgctcacccctccaaggtacatctccccgctacgtaaaaaaaccggtgtacactctaaaagatccatcaaccatgaaatgacctgctatcaatttttgaaaggaacttaatgtcgcctagaggggggtaaaataggtgttcctaaaaattatcacaacttcatatcatattagagatatgagaactttcggtttaaataggaacttccggtatgagattggaagttccggtctcaaccgaaaagttcggcggataacggaataaaacactaactatgaatttgtagcttgaataaacaaaatgtatatgaatcaaaaggtgacaaataaggtatctaagtaagatataaggtcaccagctatattaattaagcatacaagtagatcaggtaaaaacaagctcaagcacaatatgagatatggcaagaacggacaaaccaagagagtagacaagttgatttgtttcccgaagttcggatccacggatcctatgtctccgttgaggggccacaagaccgggtctatttcaaccatttcctcacgagattgcacaaatgcactcctcggtttcactcttgatttcttcccttacggaggcgaaatcgaagtcttcacaaactttctatggcacaccacaaccttgggtgatcaccgacgatgcctagccatctggaaaaccttagtccccaagagtaacaaacacaatcgaagatttacttgctatgaactcgagtgctcaaagtatggagtgaaactcactagctctcaacttctcaatctctcaatccaa

SEQ ID NO: 63958 - DNA, 5802 bp, Oryza sativa
aagccagtcccgtgaaaattggaatttcatatatcttaccttcttcgtttcttcaggaattttctaaaataattccgtggaaccctcctcgcaagaaaatacctaggtgcagttcctctccctctctttatccaacccttactaatcttgaggacgagattattcttaagggggtaggtttgtaacatcctggaaatctcgattctgaaatacggaattaaaaattcggaataataaaaaatcttttaaaacatttttgcatgctgggatttattatgtatttgtgtgtatttaggttgtgtgccaaagatctcgattaaatcttatctcctaaagggacgccctctctgtccaacgtcctttccttcccttatcttcacggtctgatttattaagtgctttagtactaaacaaatcacagatctgaatttataacccgaaaatctttccttatgtcacaatgcgacatatctttctcaattcttaccctacggttattttaaaccattctactaattctactcgataaatccttcaaatgtctacaatcgattggcgtaacgtatcatatgcacacatgccctcgcatgtacacaccgtgtacaccaactaaaaattatcacaaaaaattctagaaaaattcatacatgtactttcaatagtattacatctacgtgcaaagtcgcatcttcaaattcattctatatagagaataacaaaaaagataaaattttgacaaaattgcaaccttaaaactgtcagattttttgtttttttttgttacggctaaaatataatgaatttgacgttaacattttaaccctaggtgtaatacaattgaaagtatgtgtatgattttttctagattttttggtgacatttttagttggtgtgcacgtgtgtacacgtgagggcatgtgtgcataggatatgttgcctatttatttatcgtgcatcgattcaaatatattcaattctatttctaccgtgacaattggatttgtatgccatgcgtcttccctaaaatttctttgtgccacctgtgttcattcatgcaaagcgctcgcaaagggatcctaattctaacccatacggccttcttgccaaattaaattcctaactaccgtcatacagaccgatgtatagtcgctgtgcacgttcaagtccaagtgacaaatccattttccaacctccgaaattccccagggaagtacaataggactagcagtaccaactccaaataaaataatgcccaagatgtacaatgacctgcaccgtccacctatacgatcccattacccatatactgtccattttaccgtactatcacgaaatccaaaccgaactcaattgttcagataacgcttcactcatacagtcccattcccaagtatacaattcaccctaccatccaattacacagagccaaattaaatgtccaaattatacgatccatagtacagtccaatgcacagatcagttgcaagctcaaatgccactgtcatcccaatacaaaccctaccaaaaatacaaaagctcctattacaattgggccattctcctctctctcccagcccaacgaacaacccagcataagtctattttatctcccccagccgacctagcagcccacccctgttcccttgctcagccaaccaccagaagtctgctctgcctccctcaggcaacatgcatgcacagaacgtgtccgacaaattgcctacaagacaccacagggttttgcacccacctttgccggctcacaacagtagctcataaatgccatggcccctcccaaccaacaacgcctgcacccatgctccaaatccacaagactcaccaccaaaaaccaacaaacacagtgaggaaggctcacaccgaaaaacaacaccaagttcacagaggggaactcactttgtctcccatgcagatagccacaacaccaggaagcctatataaacaccaccacagccatgcacccctccatttcctcctccccctccctgatcgtcgagctctgtcgccaccaccactccattccctcacgcatttgctgcctcctctccatttgccccgccgtggctagcctaggctgagcttcgattgggcaaagggacgggttggccgccgcgcgcattgatcacctgagaacgactaacccctaacatttaacccgctaaccctttcattttcagtttcgctaacctctgactctttctttttgtttcgctaacccctaactcactaacccgccaactcctttactttcgttccgctaacttctaactcgctaacaaactaacctccaacccttatcttgcactaacccgctgacatttatcccctaacactgtgtgttcgcttgttgccgacgatcgaacacgtggtgtgtgcgaggacgaacagcaagcctaggatgatccgtgagccgaccgtcgacgcccgtcgacattgcacggtgtgccgctactcggctaccgcaatgtgagcaactcctccttcccctccttgctctccctcccatcgtcacccttagttttgttgatcgcctcctccttgcgtggccgacacctagccggaccgcgcaccatccctctcccacgcgcctggccgcgccgccgcgtagcctagcctggctaccggctaccgccgcaccgtcgcctgcgccgacacgcccggccgctgccccgccgacgtcttggcctcacccaggacgccgccgagtggccgcgccatatgcgcggcatcgccgtatcacggccacctcgaaccgccatggccaccaccctcgcaccaacaaactgaacaccgtcatcgcgccctccatccccaacccaacctattaactgaacgccgccacccccggtcccaacctccatccccgccagcaagcccctcccctctgcctgccgccggcgtccccattccccatggccgtcgtgccgcccctagcgccgacgagccgacgccccaggccgcctccccctccattaccgccgccaaacacatccaccccgttgccgcaccacccatccccctctcttttttgcgcatgaggagaagccgagggaggaaagtaggaaacagagcgagagaaagagataagacgagagattgagaaggatcgggagaaggagaaagaaaaagaaataaaaggtaggacccaccctttggacttccgttcgtgagccatctctcctccatgaagtctacaacacctccctgactcctccaggacaagcccaaacaccaaggcctctgttgaagtctatgttatcccctagccgagccgagagatggaaaaagtacaccgaaggtccctcagcttgttatggagttacaaaatcgtcctccaaccacaaaaccagatatctggtatcccttaactaatcaaaactggtcacagtaggtcatttagtggttttgtgcccggttttgtcctacgtggcggctgattcaacgtgggacccacatgtcaggctgccacgtcatatttctctcacttccctcctctctctctctcactcttctcttttgttctatgggcaagccggccagcggcggaggagaccaccaaggtaagataggagaggaggaggcggcgggcgacaagacggcgacgacgcggcggcgacgacgacacgggaggacacgcgacaatgacacgacggcggcgacacggcgacggcgatggcgacgatacggcggcggcgacgacgacgaggcctgcgtcatgacgaggtcgatgtcgcggggttctatccctgtctcgtacaattgtttgcagcagttgtacagtttcttacattcttggctctcttgatggtaatcctgctgactcccgtgacgggtttcattccgagcttcatcatggccttgcggctcttcttctcgctcctgctctgcttggagcctttatttacaactgcaccgtgctcaccttcaattcaaggtcatcaaaactgcaaatcaggctataaatctagctattagtaattgctacaagaactgaaggtaacaccgttaacgaaatccaaacaccacgatgcactaacacgtttctaatcagtaaaactactgcacgctgcctttcacatggacagattgcagtattaacgaagacgaaacgcaaaggaggaagagtgttaccgtcatcctcatcaccatcgtcatcgtcgtcttcatcgccgtcgtcatcatccttggcgtcctcgacgatgggagcatcgtcctccggctgcgccttggccgcggcctcctcgggtttgacgggcaccgcggcgctgctcaccagctccgcctcggcggtcgccaccggcgtttgctcgctgaccatgtcgaggaggaggaggaggatccgagcgaggctcgcggttgcaacaatgacttgcggtggtggcgcgcgcaccaggagaggctcgctgttgcaacaactacttccgccacgtccgctgcctcgcttctccgtctcgcggccgcagcgccgccccccgtcgcttcccccaccggcgtcgcgggcctcgcacggccgccgcggagctccgccgggctgccgccgtgcttccccattgctgccgccgcggccgccgccgaggaggaagagaagagtgagagagagaggagggaagggaaagagagatgacgttgcagcctgacatgtgggtcccacgttgaatcagccgccacgtaggataaaataggggtcaaaaccaccgaaggacctactgtgaccggttttgattagttaaaggatgccagatatctggttttatggttgggggacgattttgtaactcgataacaggttgaaggaccttcggtgtactttttccccgagagattgattaacctacataagtctacataatacccttctacagagcccatcattagccacctcatccactaaagtccacaacacatcccctatgcaacccagagccctctctgaaagcagctccccttcggtttataaactcttccaacttcgaaaatccatatctttccaaccgtaactccgattgactccgttcaacttccataatctgaaaacctctacggctcgggcgcccgatcatttggagaaaaatcgggcgctgacgtcagcgatttacgtgcagaaactactttaaactgatttttctcttaaattatttatccaaatcatgatccgattgcaccattaaattcgttgtaattaaatcttcaaaacaagaccacacatgaatatattccgatgaaatttttttatcttattattgaattatttttaaatgttgcacgatgttccaccaggtatatcagaattgtttcactaagtatatcgaaaatgtttcactcgtttaaatcgggtgttgtttcaccttatataataacaatgtttcagcaaatagcgaaagattgtttcagttcactgcaacatttgatctatacatagtgaaacattataagtacactaggtgaaatattttttggtggaacaaaaaataaaacaaattctcttaatagggggtttccaaaatatgtgggtttttttgttgcaatggaatatttcagttcactacaacatttgatctatacatagtgaaacatcgtgagtacactaggtgaaacattttttgtggaacaaaaaaataaaccaaatttccttaatagagggtttccaaaatatgtgattgatttgttgcaggtgggggtaggtattgtggtcgggtcagcgtcatcaacgcgcgcgcggggacgggggcggggggagcgaccgatttttcctccccccgcctggtcgcccgaaggcaagcatta

SEQ ID NO: 63959 - DNA, 14029 bp, Oryza sativa
  unsure (1)..(14029): unsure at all n locations
tttatttcttttaggattgtgcgtggatattctttggttatttatcaacgtatcggatatttatcgatcacgggtattcaggttatctgactgttgcggatatctcgaagacattaggaacctatagcaaggcaagtcactacactctcttccttgaacatattgatcctagatttataaatattttgtttacatataaattgcatgctatttataaagtgcgtacctatacttgattatgcctacccttgatattgattacctttatacatgttgtatgcctttgaatgcctgagtcatttatttatatgcggtcatttattgacattgcttagcactgccattatagacatacgcacactccatatttatgttagataaatatggatgtgggatcactcgatgtgagtgatcgatgatttgcaggtggaggcatgagcgccacctgccacacacagatattttgcgaaaaccaaaacttaatgaaacaaaactatttcgactggggcggcatgagtaaaatatgggtggtttaggaaatggttggtcgccgaccctagttagttaaggaccgagtcaggaagctatgcgggaaacaaaccaagtaagactgcacttcttacgtatgagcggacccgatggattaggaagctcttgcggggcggcacctcagtcatggtaagttctgtatggatacgatgttgaggattgcagtgtcggaaagtgagtaaaagccatggtaaaccttaaaatgcaccctataattatatatatagtaaatatcccccaatccctggagcgccaggactcccctcaccatccgatagtaggtaggttggagtgccggggtgcaatgggggctcatagtccttggagcgggtgccgaaatgcgagagcgactaaaaaggcgggccgtggcaagtctcatgtgttgggcaagccgcggagtgcgggattaaaagcatgcatccactgcagtgtgagtaaaccaatctattcgaatagccgtgctcgcagttaatgagcgctgggacctgtactgtgagatgctggaaaacccggggacttgaatcccggttcctcctcatgcgtgaaccgtgctagttccacgatcaatagctagcacacgccttcacaatcttgtcatcacatccatacaaggaaatacatacatatggatacaaggcttacataacttagcgcaaacggatgacatacatcactttgggccaaatggccaataaaagagagttaaaatgcagcggaaagaatatcaattatatatgttcatcggtatgcccatctaccaaaccacacaggcaaccgactaggaatcaccctaaaaagaaccatccttgaaactccggtacccgtcgcaaacactcacatcctgcaatcaagactaaaaacaacaagaggtgggtcaatacatacgtattggcaaaccctacccaaaaccttgggaaacttaaaagtacttgcaagctgagatcaatgagggctatatttgtagttcattttcagcataaagcaaattttgattcgcaatagtaaatgatagtaggttgctatgaaatttgtaaaacaataagcatgtaagtagagcatcatagtagtaatataatagcatcataatcatcatagtaatatcattcttgtgccctccaaggcagcaagcaacatgtctcattctcagcccacaatgggcaaaatcaccatttcccaccttacccggtttcaccaaacaattgaaagccataaaactatactcatgacacttcaccaagttgctcatgaccgtgagcacggctaatcgattagttttagactctgcagagtttatacaactttacccacatgatatgaacactctagtttgtttcgtgctcgcgaagcactaccacactctacacattgaatgcggtctagaggtcatgacaaagccgttacattgcttaatgcctaaccttgcatgagcacggcaagtgtttatccacactaggagcaacccaagtgccgctaggtcggggggccctcgccatccctagcgccgtggcagctaacacatccgttcccccatgaggcacttaaccgttatattggacacacttagacgcctaggcacagccacactaggtagctcctataaaccatcattccgactagttcatactactacggcctcccaatgcaaggtcagacattaaacaacttaataagctaaggccatcccattcctagcacatgtggttgcacggtatacttagatggtgacacaaagtttggtccttaattgactagggcgagcactccccctatcgatatgcaactaccaccatatgcacatcacttgctgccccagtctaaaatcatcatttttcagttttcctttttcacaaataacagaggcaacccctctgaacaatatttccaaatatcccgagtttgaagagggaataccatgtatttgtaaccatcgtaaattttctaagcatggctaagcaagtagctttagttttagctcgaatatacccacattggtgcttagacaacacaacaacccatcctaggtgtatcaacagcaagggtaatcaataagtcaaggtaggcaatgcaacaagtaggagtcgttctaccataacccaagtttaaaacatcttatgcaatttataaataacaaagcatttgcaacatataggattcaacatgatcgaaggaggaattgaagagggcttgccttgatttgttgtcacataatacttctctggtcctgctcacatcacgaatgaatccacaaatatgccatctattcaattttaaacgtaatccaaatgaacaccaaataaacaccaaaaataaattatgcgcaaacatgcatgatactggtgcagtagatagaacattattttagatgaatttaggtgaaagaattttaaattttcgataaagcatgtgagagatattaacagtcaaagttttatatgcggtcagcgacgtaactaatacttctctatttaaactggcattgcacattctagttttgcaaaatttgaccttacagcattaaggaaaatattattatagacctaacaaaatttggttcagtcgaaaatgatttaagatgaattagttatgcatttttgaagtttgcctatttttcagttttccaaattccccgtttgaactgtgcttttgcaactcgaaccctgagcttttatttttattacaaagaggtcctgtcttcttctccaaacgagcagagacagagcagagccatggctgagctcgatctcgagctcgcctgcgtcaaacggcggaccgaatgaggtcggggttaaaggagaaaatgcagataaggtctttgtgattccgtttctctattcatcccagccggcggtggacggagatggccgggaactcgtcggcagctgggctactcaaggactgcacatgcatgtggcaatgcgtttgcgatccgagcaaagagattaagagagacatgcaatagcaccctgtggctcacaggaagcttaccagggggtcggccaagggttgacgagctccggtgaggtcgggcagcggggtggcggtggagtagaccggcggcgacagtgacacagcgatggcgggatctacatcatgcatgccgaaatcattacatgcaacatgtacaacaccatcccaggttgctactactgcaagcaatcgaccaatggctcaccggttggacgggaatcgacgacggaggcgctaggtcggagtcagacaagacggtggtcgatctctctcctcgatggaccattcttggtgattcttggggcatttcatagaggatgatgagacgaagctagtggcgcagcagctcattcggatttgcctaggggcggcgggaagacggaagacccttctacttgggcatggatcaagctcctaaatgattatagcatgcagaaaaatagagggaggtggcagagctgctcaccgcataagcctgtccatggcggctggcaagaacaggaggtggcgatggcggcaaccatgctccagcgacggaatcctgaactgagcggggagatcgacggcaggcagcggcggctcttcatgccgaggaggaggacgacagccatggtggatggtgcaacttcaactggcttgcatgtcatcacaaacatcgaaaacagagctatttcgatgtggtacacgcgttcccgtgtgtcctgtgagctttggttcgtcggagtggccggggacttcatcgaacagctgagggctcccaccggcggcagggaagacggcggcatttcgggcggatggaggcagtctttgatgggcgaagtgagggtggtgaaggaggagagtggtgaatcttgtgggcaaggtcttgggcgctttggctgggtttacgacataagttggatggggatgtcacgagctcgtattcacgttcacggcctcactgcacagcgccctgtcctggcgacatccagcagaacggatgggacaacacggatgggggagtcttcaaggctcgaatggctgccactctgccagaggtggagtaaaggagaaggatttggtcggggcgtggaggatttggccgggacggcgaggtgacgaggtcgacacggctcagccatacccgcgctggggcgcgtccatgtggcgcgggaggttgggtcggcggacaaggggttgtacagcgtggcttgggtgcagggtttagtcgagaatgaggggtggagccaggtctgggacgaattgaagactggggcgctcgttgtcttcttcggaagacatagcacgccacgtgttcgacggattgcccaagagggcagagtgtggagaagaggaagggaatgggttgggcgtctcctggggctttactatggatgacaagtggggtcagtgcttccagggcccacgaacagaggaagggtgagtagataggccagtaaacacaagatttagtcaaattccaggatttttccctctccctctctttgaaaatcgatttgaccaagatacctaagggtagacattatggttgatttttgtggaggtaggctgtggtgcataggttccatttttcaagatgccactccaaatttcgaagtggattgctcccagaaattcaaataaaagggctcttgctgaaggtttgttgaatttttagaggggataaactgactgaataaattctggaaaatttatattacttcatgataaataaactagtatcttaataaattatataatgtatatgtttctgttcaatttgtttactatcctagggatgtatcggcttagccgatgatgattttgaattaatttaaatttgatgggtttgtttgggctatcaatctaactgagagctatctatgatgcttagtatttatgttgagtttactggaatttttagacacatagattagtcaggatgatttcataattggttgtaaggcatatgagtgcaattatggatgcatataaaatccaaaaacaagccaaaataaacatgcaacacacagggggcacactctattccttagcagtcagcacaagagattacacctcgaaatgcttggacttcgcggtactaagatctaggcaggctatgctagctcgcgcttaattagttcgctcaattcgccttaacacgtggcctatgcttcaacatactcgccttttatgcttgcgcatggcttgctcttcagcttatatggttcaaaaatttgcaagccatttgataggatttatttactgtacccaggttcaatagcttaaattttatttgtcgtcccatatttcttgtgtgtgtaggatttgattagtcacgccaactctttaggttttgttgataatatttaaaagtgtcatggcattctctctagattaaacactccttatatttgaccttaattatcattcagacatttagtaaaaaaaacattttctagtgtcttttattctcaagcatgtgtgctcgaatgctctattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgagtgggaaggttagtatagagttggtataagatgaatgtgagggtaaaccgaaccaagcgaggcttggagaggtggatgaaccctggataattacaacttcaacattaacgttgtttttagttaaaactgctaagtcataggtttgtgaaatgaattgtgaaaactagctttatgcaaataaaccaagccatccttgaacccctgtgtacattagattcattttgtagtagtggcttgctgagtacgtatgtactcactcttgcttaattaaatcttttagaaaggagttggagtcgattatattcatgccatgctgctatcaagtacgtgtcgaagacgatggattagggatcatagattcaccagtcgttgcctgtggagttggatggaccgcaactgcttcgcttccactattcggtatacttctttggaattttgtaatgtatgtgaccatgcttggtctattcaggacccatttgggatacccttgttttactattgtagaaacatctgtaaatgatgtcagttgtgatattatattgtgctatgtgtgtaccacctattgatccagagagtgatactatatgacacatgggattaccggtgtataaaaccgggggtccccacagacatactttgtaacgtcccgcctcttttgtaatgtccagcctctcccaggtcgagcccgcttacatctggcaactttcataggtcatagactaccctcacaagtcttttctgcacactttgtctactgatccagagtggtactgtatgacacatgagattaccggtgtataaaacggggggggggggggggagggtcccacagacatactttgtaacatcccacctctcccaggcttaccctcatagcctaccctcaattgcttcaggcctcccaggcctatccagagtggtacatctggcagctttcataggtcatagcctaccctcaattgcttcaggccaagcactcttaacctcagagttctttagagatcggcttccggaaaagaagttgcaacatgttgatatgagtattctattaatcctattaagccctggtccggaaaagaagttgcaacatgttgatatgagtattctattaatcctattaagccctgggccgggatgtcacagggttgttacacatcaagtggaccaaatagaactttataatatgtggtaatatgcgcttttaaattcgcatcaccatttatcatctcgtcaccattttgtaattgataaattcttgtttacctatgcttaccatttgctgccaaataaaaatatttagtattggagtctcctttcaaaatatttttagtctttagtcacaatataattctgtaaatacattgtaattacactcgacgactatttgtattgcaatgaaacgaaccagtcatgggcataagtagcttgattgtctcaacgtgagtcaatgcgttaatgataaaactgggtccaatctaacagctcaatcggttaaaaatcaatttgctcattgctcaataattatgttcttgcgggttttggctgattggatagatgtgtatgggaattatatggatttgcttctttcctaatcatttttcaatttgcgagttttgacttttggttgattggattggaattctatggattttaggtcataaaattccatataatttgtgagttttccctgacgtgaatgctgtgcaatgtagattntgtggatttgcttcacttctgtggacatttttatgttgaaccaaactaacaatgatgctaatccaggctacatgcttgttgtatcggtttattggctgcaggtttgttaatggaattttggagaatgagttgtaggatcgaaggttcaggtatttttctacctcagcttgtgctagttattttgcactattatatctttgtgatttccacattaggcaccaattaattcctttttttctatgcaaattgcacttccatttgttgtagttgccatattttagtcatgtactctgcttttgaatttctgcaacttcaattataattttcagcaaataccttttgctttcattatagctggattttctcttgaacatgttgcgcataataaatttttagccaatcatggattggagaaacaatacagttttgtttctgccgatataggatgaatatcgccgtttttgcaaattctattataaacatatgcaactttagttataaattttgagcaacaataacttgccatagttctggctggtctctgcgggcttgtgattgtttttgtgtgtttggctctaaacatctcttgttttaaatttgtttcttttctcccttatttcttgatttgcctataaaatagaaccagtagaaatgaaattttagatatctagcatcttaaaaacacatgctatatcgacatcatatgaaaactatgttgattggtaacgtttttatgattattgtcaacatatgtcgagggctatatttgttttttggcatgcagtagaccatagatccaccctgtggggctcatcaggttgatttgctttttgatggggatgtgatgggcaatttttaaatcaatttcatgtatgttgattcttgatttgattttgtgtgttttgtgttctgataattttctcttacaactagacaaaaaatttgtttttttaatagcatggctttaattaatttttccattctagtaacgtttatgtttagccatctacaacatgcagttcaacagtttttccattggtaaaattagaatacaaaataataaaaaaatgttgttaaatttgttctatgtcatttttacacttccctattgttgaggtcgccattttcaaatctgcaaagttttggttataaatttgtgtaactttagttataaatttgtgcaaccattgatttgtttttctgtaattatttcatgtttgtgtaggattggcaaagggacaattttaaatgttccatcagaagattacgacttgttttggatgtaattgatcctaaatgtaatgtgttcagtgaaacagatctttgtattacgagtatttaccttggaaaactttgttatgtgacatgttcttccacaaattatgtcggttagggggagaccataacagaaggcaaattttcagccatgtgtggtatcaaattttgtataggtcaatgcatttgttgtttctaaaccagaagcatcaactaatttgatttgcacatatactattcttttctatcttaattctgcataggctaactttcgttcttgatgcttcccaattgagtttttttaagagaacacatgataatggacaaaaagccttgaaaattaagttcttttgcccaacaatggtaaggaacaaaagcctgcccaacatgcattggaaaaaaaaaggcccaaacgcgttcaactaaaaaataaaccacaacaaagtctcataaggatttagtgggtacccgttaagaattcatgtgggcccattaaggttcctagttcttgtgtatatatgtacatgtgatggcttcttttattgtttctctgcccacctttagatccgcagcggatggcctaataaatccattgatggggagaggtaaataccatacgactgccaaataggcaatcccaatttaattagtaattgtttgatcgttcgtcaggctccgtcggatgctagctgcctaaccttgcagctcttccacttatgtttttttctttcacgtttcccctaattcccattccgttgtttcacacatatttatattgctaatccaaaaccatctctcgggtggcctctattcatttatacatggccattgaacatatcaagccaacatatcaattatgtagttttacagaagtaatcaattactaatggtctatcatctattatagtgcttcctattactgatctatataacttggagtagttttgaagggacataaatcaattactcagttttattagccatgctaatcgatcaacaacttagtatttttaaactgggatcaacaacttaattccttcaccccttcatcagtttggccgacagcgccgggtgacccacctatttctactataagtgggttcgttgattggcccgcttgcgcccttacagccggccaaataacgagttagcaaaaataacaatattaatcattgatttgttgtgctgtggtattatgatcaaattacttatctatcctttaacttaaattttaagtcaagataccttttgtcataaaccgttaaattagaagcaacgaacatatcttataaattccaagcacaataaaaagatctcatatatgacacctcttcaaggtgatgggaaacaatagcccacattgataagacccgtttagattcatcttcaaagctttgcatatactttctcataacagaaagtatcatagatatggtttgagttgtcagtgcatgattaagtggtttaaaccatattgtctatatacactcacaagcaagcacgcctttagtaagaataaacggaagggactacccattaattttttttcaaaaattggtcaaatgtaaatacagtgtaattacattgtagcttatatgtaactgcagtctaatttgttctaacatcctgaaaattaagtagtattttctaattatgcatcatgccgattcttatgttcttaataacctcctaaacttaggaaattaaaaattagaggtaacctcctaaaattaaccttcatagaatccgtctatattatttaaaatcttttgtggtttttattttaaaattgatcttgttaaaattgaggtattttctttgatttgatttttgaatcttaaaccttcttataacaaaattcctttattcaaattatttgaaatccttttatgaattatggtccaagaaaccctccaatattacccgtaaacctaaaccaaagcaattccaattttattggaattatttcttaaacccaacctttgatctagaccttactctaatacttctccatccaaacattttatgattccttcttctccatccaaacattttatgattccttctatagatattccaattatcaaattcctatctagtctccaatttaatttatatagctcaattccctcctaattctctcactggcacaagaatagtattattaaaaatattgtgagtaattgctcttgtgataggaaaatatatttgatccttccatcccaaatccaaaacctcatttagcccataattaattctctaataaatatcataccacatattttcctccctccgtattcctttcagattctcaaaaatatattcaaattaggaaccctactattcatattcataaatacccctccctcatttgagtgctttgatatttagtccactatattttatctctcaaaatattcaactcaaactggaaaatatctctttttagaaattaccttccaatataatttcctttcaaacattcccattcaaatacaaattctatctaaacaaaactctctcaaaaatttagaaacaactctctgggccggaatccacttccttctcctctcggcccatctcccttcttccgacccatcccttttcctcttctttcccttccctcttccttccggcagcagtggcccaataatttggcacagcccagccgccccaagaggcagccgcctccttcctccttcccgtgggtgctgccaccgtgcgccatgggcgccaccgtgcgccgctctaccattgccacccgccgcttgtatggctttgagtaccgcctccactgacctgctgtcgatgccagggaatcatcgccgaccttattcatgacgtcatcctgctgaggtcagtgtgccgttgtcgcccagacgaaccaacattatcgtccaatcagaagacgagggcggcggttgtgctcttcttcttcacatcaccgtcatcgtggccaagtcgacaatcgcctctcgccgcctataaaaggacgatgccccctcccccctcccccccccgatgaaccctgatctccacttgagaaactcacgtctatgattggcccgatctttcggtgagttgaagataattacgattcgggataaacgttgacctttccctcgggctacagtgtcgccgcccattgtaagttcaagtgccttaatttggttttggtgattaatgacaaatctaattatatgagactaacgtttttacgagcctttctttgactagtcttatttggatatgaaaataaaaatgatgagaggtatgtattaaacttcacatattctaacttggtctctcttgtgaatccaaaatatagtgtgagctccctcattgatcttgattgattatgtgcatatgtgttcctttatatccatatgtatgcacatcttgagggggagcttattctatattttgtttattataagatttctatcttgatttgaaatcatcttccatctcatctctctaattgtttatatcaggttattatccatcaccaaagagagaagattgaaagatcttggattaaacaatttgtgtaattgttactttggtgatagatgataaaccgatgtttatgggattaacctctcttttgcataagttgtctactaggttatttcccgataatgaggtgtggaagacatgcattattttttgatggaccttaatcatgacaaggatgaaatgcatggagataaaacgatatgtaccacttcttatctcctactttttgataggttcatatatatgatttccatgttattgatatataagtgtgaaactaatgtttactcgagtcttatcttatttagtctcatttacattgagaacatggagatcatgaaggtatatgttttatgttggtctacatcattactacatatgccttctctatgtgtataggataaacccccattgatcattctctaattatgcatacacttgcatctcttgtatatttatttgtatgcatatatttagggggagcaaatcctatatatttattgtgcatgttctagatctatgttgttcactgttggcggttgttaaatgccgattctataccgccaacatctgcataaagttcggataataaaacatccaacatagtgataggtgcttaatctcacatattccacaagtgttggaatatatttgtatgcagacgacaaaccccgatgttgggaggaaaatcagactacagtgaggagattcacgtatccatataaggaggggttgtaaacttcatccaaacaccaataattcaacccaaaactccgagaaatggatagaggaggtccaggggagaagatgggccaagagccaggccagatgggcccagcccaggttcggccgaaccagagccatccaggctggggttttgatgaggacataactagctcggatataaccatgactaccttatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtcctgatcttccgataggtattgataaacagtcaatttgggcggagtcgcgacacaactcgatccggcttctgaatgaatacactactgagccccgcaatcgcagcaccacgtctcctctggttatcaaccgtgccgaaatccggttgacctcgccgagagggctaatccctgcatgcgaatcgaag

SEQ ID NO: 63960 - DNA, 9070 bp, Oryza sativa
cgtcctagggttgtcctagggcgcacacccccttggcctaagcccacgacataattacaaggcccaaaactcaaatcagattcggactggatgagatacgtggtttgttttgcagtttcccggcagctcggtaggaattttgacgtgggaccaaaaccatctgaaagtagactccataagctttccaacaagtactcatgggccgtgaaattccttctagatcagcggctaggttcatttgaagttgatgctgtcaggaggcccgaatccgaatccaaaacgtgtaaaactttatctcttgttttctatgaaccaaaagtgacgtggtgagataaaagaagacttggacaaggtcttggtttggtccccaatcaacttcttcaatcatccatgcattccttacgctcggtctcttttctttcacccaagcaagtacctctgcaaacaaaaacacacgaaactcattgtgcagcaacgtttgttcaactatataacaagtaaatctaatgtagaacatatgcacctttattttattaatacataaggtactcatggttatatctgagcaagttatgtcctcatcaggtttggcgtggacgctccagatcattccctaatggcggttacggggcatttcggacatttccccttcgccaaccgtcatatctacccctatataaagacatcagtccctcacttcacacacacacttccaagcttgagctgaattataagaggctctattgtactatattgtatactagaataggaagagagtagagtaggagttggaagaattccggagttgtcgctaatcttctcctatttcttttattctgtttattactctgaattcaatataatattcttcttgagtaatttagatttatcttgtgagaattatctcttggttagttcctaaatagcatataggattattgttcactataattaactaaaatatagtgattgctttgatgagttataaacactaaagtagatattaattgcttagacgtggtgtttaggtaattgttatccagtaattgctgcgtatcccacagtacgtttgaggtgggtgtagaggtggtgacagccctcgagatcacttaagtcctccctgttcgagtacgtagtagagcgacatctggaaacagtgggttgccagtgcctgaagtattgcgttggaattgaagttaagctttccctagacactgtttctcactagtgaatcctctctatcctggcctatcctttgcttggtgtccttggatgaaccagaggaagatctgaccacacacgttcccttggattcgatacccttggaatactccgtaggggaagtgctacatcggtatatccgtgcgcttgcggattttatttgtgaccgtattaaataccaacaagcatttctggcgccgttgccggggaacggttgctgatcattttcgaacccagttcatcctttatcctttttcattttttattctaccttcacccctgctatcctagagaagtattcctgtcaaactcttctcgaccttggagcaacctctttttgagctatctgctcctcggggcgaattctacgagccacctccttcatcggagcccatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagacaagaaactgtgcggtggaaattgttctcgttctctcttcaagagagagcaaagcaatggtatacctctaccgttggatgtgtaaacggtagctaggaaaagctgcaagacagattctgtcttgccttcttcccagttacttgtatcactgcccttcgagtagaaattctcagttttaagcaaatcgaaaatgaatcaatcggtgcagcttggtccagattcactaatttagtgcagtccggaccaaccctgtccttacccgagtatgtgcttctccaacatttccatacgggtttggataaggagtctgcattctatctggacataactgctggaggatcattcatgcacaaaacgccgtcagaaggaaaaacgattttggatcgcattctagaaaatacttccttcatgatgcagtccaatgaaccccagctggaggcatccgtgtccaagatagaggaacttctaacaatcgagccacttgctgaaccatccacttctgctagctcgattgatgagaaggttcctgtgtagccgtccgtcgggaatgaagaaattcagactccggattgtaccgtaattatgttcagggacagttttgacgaagactacggcaataccctgaactattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtcggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaattttcaattccattctcgcgggcaaggatcaccttgaccgattctctcccagaaattgagtcagcggaagaggttaccgcagtccctcctcatgagtctcctgaagcccttctggaagatgaggtcccagacttcatcaaggaagaagcagatcccggtgagactctcgacctgccaatcatggaaccgccacctcgacctccgcttgagcttaaacctctacctccaagcctatgatatgccttcctacataatgatagagaggccctgtcacaccccgaagttctcctcccaagcctaaatttaatttataaatgaccctaagaaaataccggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctttttttttcgaatgggccgccggcccattctttccttcctccccctcctccctgctgggccggccgcaggccgaggcccagctaggccgccccgccgccctcctctcccggggtcgccgacaggtgggacccacctgtcgggtccttcccccacctcccgccgctcccggcgcgccgccgcgcccgcaaccgccgccgcgcccacgtctccgcctccttcgggcctcgtcgaccacgtccgcgcgtgcgcgtctcccgcgcccactcccctctctctcccgctcgcgcccgcgcccgagatggccgggattcgattttcgaatcccgcctctctctcctcccccactcccccacgtcggccggcgattcccgcctctcccggccacgtccggttctctctctccctatttaatcttctccgtcaccccctctcgctttttccccatttcgccgaactctctgtgcctcccatcgctcccgcgccgtgcaacctcttgccgccgccgtttccgctactccggccgccgttagccgccgctagggtcgccgccgcaccacgccgtttcgccgtcgggttcgcaaggctaagccccaccccgaccgccccttccccgtcgagtttcgtcgccgaaattcgcatcccctcgcgctccggtgagttcaaccgctaccgccgctttcggccgtgaataccggtcgccgtggttcatctccctctctctaatccctctcttctccttccttagggcaccccgaagctcgtccgccggttgccgtcatcctcccgtggctcgccgtcgccgttcgccatcgtcttcctccgcgccggccaccctcggtgaggcatccctcccctcttttccccttcctctcctcctagtgccgcgccgccgcttcaagtcgcgcgccatcgccttcgaccaccgccgccgcctcccgtgccgccggtcgccgccgtcgtcggccgcatgccgtcgccgctagacctggccggccggtcggctttgatgccgagccgagtcggcggccgcctttatcgccgcccattccctccccttcctagccgccgcttagcgcagccgccttcgcgtcgccttttgcgccgtcgctttcgccgccggttgccgtcgccggcaacgcgttcgcgcgcgcgccatcgccgtcgccgcggtcggtcggccggccttgagccaagccgagccgcgtgccgccgccctttctttccccccctgagccgctgaccggtggggcccgcatgtcggcgccgcttcccctgtgctgacgtcagccctggaaaatattgcgcaataaattatttaaggatttctgttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggttgtttacctattgtcatagccatgcgattgttgtaccttgtttctttgtcaacttggggttctaacatgattagagttaggactggggattgcttagccatgcttagttcagctagttcacattggggaaaatcctattaatgtttagactgttggttccaatggtgttgttggattagtgacaccgttttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagatgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgattaatattaattaattattacaaccgtttaaatctttcaatttctgcttataaatgctcgctttatgcaaatgaaccacttcagctctcctttgatgattccctgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttcaagtcaaggcttagctcctgttgtctttctttctttccgctgcattttttgtaagacttttatgatgtttgtaagacgtggatctgaatgtcaacattgtcgtttgtgtaccccggccggtcctggacggggaatttaatgcacattctgcttgaaattctattcgggaatttctgggcgtgacaggcccctgtctcataatcagtgacaagctctctgaagacgagactcaacgtcttctcaccgtgttagaaaagcatcgttctgttcttggctactcgcttcaggaccttagggggattaatcccgcgctttgcacccatcgtattcctattgaccccgagagtactccctccagggaacctcaacgatggctcaataatgcaatgcgagaggttgtaaagaaagaggtcttgaaactcctgcatgccgggattatttatcccgtaccatacagtgagtgggttagcccagtccaggttgtgccgaaaaaggagaaatgacggtcgttgcaaatgctcaaaatgaactaattccgcaacgaaccgtaaccggacaacctcaccggagagccaacaccggcgaatcaactcatcccggtggaaaattacacagtggaaggggtgaatgcactgtgggtgcagcccctcgcagcagtgccgggctcccctgaaaatctggagcccgtcgacgagctccctggttcgaccaaaccaggggttcggccaaacccttctcggccccgttcggccccctgttcggcagcgcgatccctctcccctcgccatgtcacaaggacaaaaattcggggggattcgcctgctcaacggctgacgatgggagagctcggtctcttaaaggcatgtcgcctttttcaagatgacgggaaggccgcgccgcctcccaccgagtgttatgtgggcaccctgttcaccaaggcagtggatgaggtgctcacaagtacaccacacccaccgctactccatccactccgaaggaggagcgattccgcattcagggagtgcgaactcccgcggtaggtatggtaagggtttactccggcctttgatggcatcagagaaggagggggcagcggaatcccgtagccatccacctatgaaggtgaagcgtcacttgacgccccctccaattgtgagggctcccggccaattccaagaaaatgaggtgaaatcaccggagccctcgatccataagctcgctgcgcaagtgaagaaactccgcaaggagaacatagagcttagggatcgcaacgcggagctaggggtagagcttgctgaaattaggaataatttcgatacccttagtcatggtttgtgcgctaaaatcaagcgtgcattcatagatatggggaagaaaaatatatattatgctaattagatgtttcctttcccatgaataaaatagtagtaggtgcttggttttatttttccaatcatgtaagcacttgctatgaataatgtggcacaatggtgttaaccccaatgtttgccaaagtttgttttgtttcatgcttaataaagttcagattttgaataagtgtgggggagatatcccagcttctgacgtgcacataatctgaaaattgctgaatatttgaacacctagaaggcaccaaactctgcagcaatttgcagaaggattgggcaccagagtggttcggccgaaccaagtctggccccaaaccctctcaactttcaatggtaaacaggtgagcacgtcttttatctgtatatctccaccatggtatagtactagagctgaaaattcagaaaacaactggttgaagcataagtgaaagataaaatttccaactaatgaaattcttcatatgattgatcgtgtatattcattattctcagctgaacttgtgcttgtgaacaaccatccatgattagggaaccttatacatctaagtgattgctttatgtgagatgattaagatgaaaggaatccttgcaactttgttatgactcttggggatttgttttcaaaaataaaattgtttttaaaggctcaatcctccaattgattttaccttatacataccaaggccatatgcaggtatatcattgataaaccttagtatgcatatgactgcttgacattatattgagctttgtcaaatttgtgtgacttgtgttagatatctttcatactctcatgatcaaggggtcaattccaccttcatgtccacatataaaattaagctaagcttctacactggaagttggctttccacaaaaaaaaatatccattcaaataaactcctacattgaactatgctttcttctcctagaaaagttctcggcaaaaagaaaatgagaaaaggagggaaaggcatggctgtgaaaaaaagagagaaggaaataaagtttgctctcaaaacattgagcaaagaaaatatagccaagccccttccataaccatgccaagagaaccaattggagagaaagtataggaaaaagggagaatcattttctttactccatcattccacaaaaatattttactttttcattttccaccataaataaagacccttgatctaggaatatgattgattatcttcttgagtctatctttttggatttgcaatatatatgatgcaggtacgtcacaatttatccctaccaagctccacatattagccttagaatagggataagttctggcacattttgccttggtgaggatccaaagaaaatatacatctttgagagacaagagagaaagtcataaaaatcccatgagtctggcagagaagcaagaaggactggaatcaagatcattccatttatcaattactcaagatggtaagatagccacttataaagttcacaggtacaggtatggttgtgaatgatttata

SEQ ID NO: 63961 - DNA, 1181 bp, Oryza sativa
ctataccgccaacatctgcataaagttcggataataaaacatccaacatagtgataggtgcttaatctcacatattccataagtgttggtatatatttgtatgcagacgacaaaccccgatgttgggaggaaaatcagactacagtgaggagattcacgtatccatataaggaagggttgtgaacttcatccaaacaccagtaaatcaacccaaaactccgagaaatggatagaggaggtccaggggagaagatgggccaagagccaggccagatgggcctagcccaggttcggccgaaccacaatctcagccatccaggctggggtttggcgtggacgctccagatcactccctaatggcggttgtggggcatttcggacattttcccttcgccaaccgtcatacctacctctatataaagacatcactccctcacttcacacacacatttccaagcttgagctgaattataagaggctctattgtactatattgtatactagaatagaaagagagtagagtggaagaagtcggaagaattctggagttgtcggtaatcttctcctatttcttttattctgtttattactctgaattcaatataatattcttcttgagtaatttagatttatcttgtgagaattatctcatggttagttcctaaatagcatacgggattattgttcactataattaactaaaacatagtgattgctttggtgagttataaacactaaagtagatattaattgcttagacgtggtgtttaggtaattgttatccaataattgttgcgtatcccacagtacgtttgaggtgggtgtagaggtggtgacagccctcgagatcacttaagtcctccctgtccgggtacatagtagagcgacatctgggaacagcgggttgccagtgcctgaagtattgcgttgggattgaagttaagctttccttagacactgtttctcactagtgaatcctctctatcctgtcctatcctttgcttggtgtccttggatgaaccggagaaagatttgaccacacacgttcccttggattcgatacccttggaatactccgtaggggaagtgccatatcggtatatccgtgcgcttgcggattttctctgtgaccgtattaaataccaacattcacctattatttatatcggatctttgcactt

SEQ ID NO: 63962 - DNA, 9607 bp, Oryza sativa
ttacatagagtccaagaacgtcaaattctgagatccgagtcaagagatatcgccgttttactaactgttggttgtgctgaaaagtgacctacggtctgaccgtgggccataggacggtctgaccaaggatgttagccggtctgaccggcgtggtaaggccggtctgaccgtccccactggtctgttgcactggtctggtttttagtggctatacagaaccaccagagccgcaaccggtcagaccgagccgacggcggtctgaccgagccatggacggtctgaccggccactacactacggtcagaccagccaggttgagtgggctcaatgattgccctgtaacggctagttttctagccgttacaaagtagtctggtctgaccggccactctatggcggtctgaccggcagagcacagagttggggatttcgactccaacggctagttttggtggttgggggtatatatatacccattccccagcagcaagggtaggtttttggcactccattgcattatcttgaacccaagagctctcacacccttgtgcacttagtttatctagtgaggtgttggagagtgagttaagccaatccaagtgcattgcttcattgttagagctactgtggcacttgatcatcctcggcaagcatcctagacttgttactcttggaggttgccacctcctagacggcttgcggaggtgttgcccggtgacctctccgaggagattgtggaggaggcccggcgccggttgtaagtggtttggagttcaccaccttcggagtgaaggaagaactaccctagtaatcgaggcttgagtagtcctctccgtgggccggcgtgcccaccccttgacgaagggggcgtgcggtggcttcgtggttgagcagtggagttgggctcgcgtcaacggggattaggaaaccggcgagtttccgaacctcggtgaaaaatcccttgtctcttgtctcatttatttgttgcatttacatttgagcaagtttacatactagagcttatttgtgctattatcaccctaggcttgcaaaccttaacatatgctagtttctttgtgcacttacttgagactagttgatttaggttttgaattgtgcaaaaccgttctgatttacgcttccgcatacaaaactcggttttagcaaaaagttttaaaaccgcctattcacccccctctagtcggcctccttgatcctacacccgtggtccacctccactggttgttggaacgctgagagacgccttcctcagcgcggcctcaccgctggtggagtttacaccgctgcattgacatgaagctcatctgtgtcgtcccttcggaccacagccttgctgctttcgtcgtcttcctcaccgcccgtgtatcgacaccctcatcgtccgcactggtcatcttcagccatcgggatcttcttcgactgcttcgagcatcatcgctgcatttttaagttgccaccgtcaccgctctaggccagtggtctagctacgtcttcatggctaccgacatcaccgtttcaagtcgttggtcccactacttcgcctttgtctttgtccaacttgcctcattgccaatgtcaccgtatctttctcgactacacttcgctcttctctggcaatcgtgtgttgctctgacaatccccccctccacgtcgttctcgcgccgcaaccgtcatggaggtcttctctactagtctcctccgacattggtgtatgattcatggtagtctcctatctcgcccgcgtggtattggcaacatcgtagcgtgcattcgtcccgagttgtccccgggtctagcaaacccggcatgacgtctcgtcctatacggttcgacaacatcaactcttcggcgtcatcttcctcaatgacttccacgaacgcatcaccgtcatcatcttcagtactgcgttctaggcttctcgcccatgaccacatactctacggcgccccatgcgcgccctgcggctaggcaacctcgacatcattggctccccgactttggctacattgaccatgactactctatgcatggcttcattgaccatggatccctcgcacccttcgcttcatctacatcgactatggcacaacgagctatcatccgtattaagcactcttgtcggtttcttctccagtcaaagtgtttgcattgctcacgcttggacggcgagggtatgttagagtatatggcagttagagtcatattaggatagaatttatttgtatggactccttccatttctgtaatcctttcttatctcctcgccatgtactccaatatataccgcccccctgaagctcaacgtgtccaataaaaacaatatcctttctccctatactattcaatacataggagttatatactggagacggggagactcccgagtgtcaaaaacacttgccaatgcatgaaaaacactccgtaacagagttacctagtcccacactcagtaatcttcgcccaggagtgatttctccttcccgtgcatagttggcgtgtgtcctaggtacatacactccgtaacagagtgagaatttccgggtgctctaggcactcggtaacattttcactccactgtccaacagaattccataggcaacggtgacggcacagttgcgtagtgcagagaaagttacagtgtgtttttcaatcggacacacacggtaaaccttctcttgttcccgggtgtcgacatagcatgacacacgttaactttccaagaaacacacagcaacagtgccgttgttaacgtgtgttcagtttaggacactgtaagttgacacacaggaactctacttgagggcaaaactaaaatgggtttgctgatacatttatattatttgcttacaccagaatagtaggagcttaataacacatcataggcgatcacacatacaatggaagaatggattccaatgcattgacatccacgttcaattaatcgatttgacaacaatctaatgtgaattacaatagcaatgccaatctcatagacatctacaactgagatgaaatttgaatattacttcttaaggttagataaccaaggaggtagggaaacgagaaaagagttgacgaatggcattgcaggcagtccgacaacacctcaaataatatgaagatgagccagttgacttgcaaatcctgagattgcacaaaagaggtaagattaattacgtaggcgagctttatttcaaaacaacattttatgtacatgtatctaaaacagtgatagcacatttatatgaaatagcattagcaacaagtttatttaaatgatctatgccaataagaaaaaaaaactacctgaacttattcatgctttcttcaagaattgtctaggtttgttacaaaattcaggtataacaacagtaattaatattggaaacatttattgatggcacatgccaagaagcgctatgcacccaagtaggggtggacgaaaattcgtagctcgttagctcgctcgacttgcgacaagctcggctcgactcgtttcattttcctaacgagccgagctagccttttagctcgttagagataacgagccagctcgagctggctcgcgagccgtaacgagatttgacaacccagcaggcaacagcaatcccagtccacaagcccacaaggccacgaggccacaaagcccacacaagaccacgaggcccatcagagcatgtaaagtactaatactataccacaaaccctacctgcctctcgagagtctcgatctctccttttcactctgcctatccgccgccagtctgccgctcatcgcccagcatgcacctcgcagccacgccgcgctgccccttccttcccggtctctagtgcttgcgccatcgccacctccctgtcgcgaccatctgccaatctgcgctgagggctgcagcaccgtcggtcgtcgcggcgttgccccagcttggccgtcgcgtgcgctgtcaccttggcaccgcagatttttgtgtcgtcggtcatcgcactcgaactcgccgctgcggtctgcctgtctgccttgccgtcgaccgtcgtgctcgtcctcgccgctgcaggccgctcgtcggctcacgttccgttgtcctagctcttctaatcttgatgtctgatatcttgccctctccagctcgcgagccgaaacgagctagctcgagctactgaccgagccgagccgagctgcgttttctgctcgtttagataatgagccgagccgagccagctcgttatctaaacgagctagagcaagtcgagccgagccgagccgagctggctcggcatccatccctacacccaagtgactggtcaagtgctcatttaagttctttttttatactagccaagtgctcatgtattgcactgaaatccaaataaatgattgcacatgttcaaaataggggaaaatgtaaaattgaaatcaaacttctcttatagaacttcatgattcctggtatataatgtaatttaggataaaaatgattatgatcctaactcaaacaattcttgctcatctatcaaaattttatcttactatcaacattttaatgggatttgtataaacatactcatcaatttgctagcaccaaaattgtaaatcatgtaatcagaaatccaatggtatgagaagaatcaattgagagaatatacaatagtaaattcaatattcagacatcatagtagacaagggaactttgcttgtagtacctgcttcggtgtcactcttcacctactagacagcaccaattgattgagaatctactgccttgtctatcccaatgcttgtcattgtcctgaaatgaatgcacagagtgaccttaggtgggtaaaattgctgtggcttattccatgataattaagttgggcctgttaatttatgatttaactaagaaaaaggaacgcatgccaacttgagagaaagaaatggctccctggctttgcagtgagtagaatgtctttgaggtgatgcctatgatggcttgaaatggagccgagctggattggttcagtactggaacagacattgcaattttggaatgacttcttggaacatggctccaatcttctgaaaaaaaaaagaataataaattcacacaagaaaattttaggcatctctaaatcaaactacagatatatgcacagttggttcatactccatatgattttagttgtgttgtactgggtggctcatggaagcaatcctcaaggaaaggaattgcatcatatagataaaacaagaattttatctccacttggttctgcaaggatagtacataagtgacaatctcatccaaaattgtttcttctcactaacaggggctctaataaagtggagaattcgataatctgattcctcttgtaaatagctacaatttatcattatgaaggatgaaaaaaatagtttcattgtcagagatcggtttaaaccctgaaaacaaatgaacactgaagaaaggtgctatcaaaaagtacatgacaagttgaatataagtacttcctccgtttcacaatgtaagtcattctagcatttcctacattcatattgatactacattcatattgatattaatgaatctaaatagatatatatatatctatattcattaacatcaatatgtatgtggaaaatgctagaatgacttacatcgtgaaacggatggagtatgtcttagtcactagctacactagaaatcaaatccgagctaccagttagaagctccaagttctccgcctgaaaccaaaaaagctccgtagttctatatttagagggaaaaaaatcatattccagcaaaaagccctttgcggctgtccaggtgaaaagtaaaatgcttctcttcacaaatcaaatccacaaggacccttctccatgcgtgcaggagggaagaaagagacagagaggtggggaagagagagatcataccatggagaggcagctagcatgtaagtcttgcccgggtccttcttcacccaacttcttcactaacctaaaaaaaaaatccccaattagaaaagtcttgaatgaaccacataacttggggaataatccagatattatagatctgggacaaaggagcttgtgggaaggaattgaccagtggagggatgaggagggcagcgcggcccctggccatcgtcgcaccggagcagctgccatgggtgaggtggcgctggatctggatgcccccggactcatcgctggcagtctggtggccccattgctccggcgagccaaaggtagaggatccatgtccaggatgttgtggagggagggctagagctggagcagcgggaggagggggcacgccgccatgccgccacggagagggaagagaaggggcgcgtgcgtcggtgctttgcctggctgtggagtgtagtgttgactgtggactgtgaacctggcctggctgggtggaagagataaggaggggaaattgtattcccgcacgcgccacagcaaattagaaatttggggcgggggattttcgttttacaagcacatcaagcaatttatcattattttgctctacatggttttttacataattgaagcaatggaatgtaagccaaagatagataaccacgcaacaaaatatacctgtggagtaagatatttatacttttctcgagtaaagaaaatttttattctaaaaataatttcactctaaagttaatgttagaatatactttccatacttttagaaagtaagtttagactgcatccttgttggaacatgctgcaaatgacatcaagtacagtcaagcaaagcgagaaagcatgattaattaagtattaattattttaaacttaaaaagtagatttatctgatattctaaagaaagatttttagagaatttttttcataaaatacatcgtttagcagtttgaaacatatgctaatagaaactgaggtaaaatctatatcttacttagaaaaaaaatcagaaaagactcgggtataagacttctctaattttagagccaaataaattgttaatggttgaaaagccagggttgaatgaccaagcaaacaagaaaaacataagtttatttaaattatgagtgaattacactttacatcgggtaaaatgcatatgtttcattttgcatcaggtttagcatagtgttgtgttttgaaataattaagattcactttacagtacgatacatcatcgaacctacaaaattttcatgattatgaaagaaatattgtaaaacatggtataaggcaacaagtttcgtttttattcaaattataagaaacgcaggatcgcgtatatggtgtggtgcaaaaaaacatgggaccgacgggcgacgcaaccccagcgtgggcgcgcggcaccgcgtcagtccctttagccagccaagctcatcgtgcggacccgcttgctggtcatgcaagaccggcgtgcttgcgtcgctacaactgttggtcggtcgcgcgtggctggctcacgccaccgcttggccggttcgcgatgttgcgcgtctggggcgtgggaccgacgtggtgccgcgtttcccagctacgggacaaacgcggtgccgcgtttccaagctgtgggaccgtatcggtctcacgcgttctagttggccactgcattgacatgctttcgaggcgcgggaccgtcgtggtgctgcacttccgacctatgggaacgtggcggttccgctcacccgtgctgcaagaatgatccggctggtggcgtacccacatcctcgttgcaggacgaatatatgtgtgctaatccttcccctacatatatataaacgtaaattattaaaacaaatgtatattcacaaactttttcggttgccattatcgtcacctagcaatacgttctagggaaaaccttgtttgccagtactatgcttttttcttatttatcactcaactatggctataactttcttttcttgtttctatttttttaatgtgtgcttttgttatttatatcttcatgttataagatatgattttatataggtactccctccgtctcagaatatagaaaactaagatcggatgtgacgtatcctaggactacgaatctggacataccccctgtctagattcgtagtactatggtacatcacatctggtcttaggttgctatattctgcgacggagggagtaggtagctacgaaaatatttgtttttatttaagcttggcgattattttgttcaaccgtgaataatttgatttttttatgaacgtggggaactttggattaaactagctcttggtgtgaacggtaataagactatattggttgttttttctttctttttttatgtaacattctgccccaggaacggtgggcttaatggagaattttctgctatttgattgacatgtggccccaaccattgactgctccgttagtttagttagaattaccgagttcctatcccacatagcactgtagcccaccgtgatttccgttcccgttcgcgccacgttgctgctaacgaaataccgttcgcgccaacgaaaagttctgggaagattggtgcgggccccacattgcctagtttaacctcaaaacacaccgtactctttacgataatgctattcgtcggtcgaccgacgggggagaaaaaaaaatcgggtgctccccccgtggccccgttcccgcgcacagtgatattgttggccccaccataatatctgtccctacctgcaacaaatcaactatatattttgaaaaccctatattaaaagaatttggtttatttttttgttccacaaaaaatattgcatatagtatactcacaatgtttcattatgtataaatctaatgttgcagtgagctaaaatattccattgcaaacaaaaaaaacccacatattttagaaacccctattaagggaaatcgttttattttttgttccaccgaaaaatgtttcacctagaatttgttccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattcaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaata

SEQ ID NO: 63963 - DNA, 958 bp, Oryza sativa
aaaagttccaatctcccagataagttagaaataaacctttctaataaaatttaccttgcggatcaacttctgtaactgtttcttgtcctctggaggttgaattttcttgatggcatcaatactcctgtgagttatttcaatccccctctcataaacaagaaaacccaaaaacagaccagccgatacaccaaaagcgcactttgtgggattcatcttcaggccatatttccttgttctctcaaaaactttcctcaaatcggatatgtggtcctctacctcttttgacttaacaaccacatcatcaatgtaaacttcaaccaacaagccgatcaaatcatggaatatataattcatggccctctgatatgtagccccagcactcttcaagccaaaagtcatcacaacccattcaaataaaccgattgcaccaggacacctgaaagtagtcttatgaatatcttcttctgccataaaaatttgattgtaacctgcattgccatccataaaactaataatcttatgtcctgaagcagcatcaaccaattgatcggcaatcggcattgggtacccatccttaggggtagccttatttaaatctcaaaaatcaatgcacaccctaagcttgccgttcttcttgatgaccggggctatattagaaatccactcagcatatcggcacggtctaatgaaactagcatcatataagcgagtaacctcagccttgatagcgtcatacatattggctttacacctccttggaggttgctgatgtggtttaaatcctggcttaataggcagccgatgttcaacaatcgatcggctgagtcctgacatctcataatattcccaagcaaagcaatctctatattcttttaatagctctatcaacttggttctgaattctgcagataaattcttactgataaatgttggccttggcctatcccctggaccaata

SEQ ID NO: 63964 - DNA, 2108 bp, Oryza sativa
aataagaggtgctaatgaaagcaaggagtaggcaaacctatggtcatccaaagccccattaatagttgaatcatcactactaggagaggtgacatcaattcccatagcagtaacatatatctttccatctcgaccaccagcgtagaaaatatgactccttgggtctaacgccactgaatcagtaatagaaggaaatgaaatgcttcttagcattctaccctcggatagactccaaatctaggaaagagggggaacaaaaagttaaatgctaataaaaatgactagaccatatagtcaagtacaattctacaaaatatacagctcaaagacaaagtacaagtagattgcatactttacaggtgtgatcctctgaagatgatacagcaattgctccatgacagcaagcaacatcggttacaggaagtgcgtgctgattaaagctgtatatgtgttgtgtctttgcctccaatcttgattgctcatcaagcatcctgcagtaaacaacacaaattaagtaaaccaaacaagcaatcagtgtggtcagtattaccataatcacatacgtgaggagatcccaaactttgatgctaccgtcttcagaccccgagataagcaaaaagtcatagagtgcaaggcacctaacagcacgataatgtgcatgccactggacaagcaactccccactagccacctacacacacaaccaccatagagaatggggtgtaagaaagaacgaattttattatcaaagacagagttactggatgaattaggaacatggagtggaaatgttaaatttctatgcaaaatgccaaaatcaaacaaataggaatataattcactaaaagaggaccagatagaatttagcacactttgtgtcctgtgaagacagataccaaatataaagaggcaacatttcaacacaagaaaacaacacagatgattgtacttgcacaccaggtgaaaaaagtgcaaaatttcaagaaaggtatgaaagcacaaatagattaggcaaaatctgaactctaagaagctgcctgacagaaaagttgaaacagaaacagaaggcatattttagggggaaaagtagcgaagcaaacataagatccataacatgtcataagcttataagtctaggtcaatttactagcaacaccaaaaattgccccgggcgtaaatgcactatatgggtgtgtttggttgcttgtatgcccttagcctgacccgtatgccccatcctggtggagtttagcctggctagccacatgcaagttgatgcaacagggtttgtttgattatcagttatgtctggatcgtgtgcgatgttgtttggttagttgaatattaatgcatgtatgctagggattttgtttggttggttgtatgaatttggcaaattatgctataggacactcaaagtttgtggcctttactgtgagacactcaaagaacgtatatcttcctatggacactgcaaaaatatggtaattagctactggacacccgaggcattattttattatttccagtgaaaacgtcgagagaaagaacgtagaaagtaccaaaatgcccctggacattgttcttcttcctgcttcagctctcttttctttcttctcctctcttctattctcttcttcaacgagcctgggaggccgccagcggcaaagggtggagtggcggtgggtgagcgcagcagaggaggtagacggtgggcgggggaaggggcggcgcccctgaagcagccacacaccctgttgccggagaaggaaaaggagcagggacaggagatctccgcttctagcgccgcctcccgctagtccaccttccggttctcgacatcaggctgctacacggcgtgggcgtccacggcagcgacagtgagggtgcgggcagagagcgcaacatggcagagcgagcagaggcatgcgcgtacgtgcccacccgcgcagcagagaagcatggcgtcgatggcgccgcactgtgcgcggcgtgcctcatcaggaggaagaggacaaaccgtcgcggccatggaacctccgcacccgccgctccgccaccgtggcgcccaatgcgtcgaagctgcgccgggggggggggggggggga

SEQ ID NO: 63965 - DNA, 6388 bp, Oryza sativa
gctgcacccgcatgcgttgtccccggtgatcgcgagaacaggagcttctccgttgcgctcaccagggaggagatggtcgtggacttcatcgccatccgtggcatggcgccgcctcgccggcccaagaagcgctcgcgcgccgtggtggagaaagagcaggcaagggcaaacttgtcctttttaaatctctctccgcgtttttatcaaatataataaaataatgtctcgagtgttgaacagctaattaccacatttttgcagtctgtcgacaagaagatacacgttctttggatatctcacagcaaattgcacaaactttgagtgtcctgtagcaaattttgcctatgaattttgagtgcagttacccctttgcttgcatgttgaggctgctttctttaaaaagattaaaaacacaaagttgcaataaaatttgtatgccaaaaaaatcatcctatttttgcttgaaacaaattactactatatactgtagcatctttacttcattattttactgtatgtatacatatatgaatctatttatctgtatgagcctatgaaaacaacaaaacgaataaaggaataaacaaaaaaggaaagggaatgggaaagtggccacaacatcttggtggcctctagtggaaacgccggctgctcggtttgtatcgacagtcgctagctcgctgcctcagttggattcgacggctgctgtgtcactgccatcaaatcagcagcccaacaccggatctgacagacaagtgctagtggcctccggctccaggtagaaggggagaagatgagcttgttgagggtggagaaaagctcagcgacgatgagacgaacttggtgacagaggacagcagcagaggcatgttggaagttggaggtccatcgtcaccctcgtcattgagcccatgccttgctgctcgagccgccgcattggccagatctggcacctgagcagttggggctgccgtattcggcgtgtgcacggtcgtagacaccgaatccaaacgagaaaaggagcggatgggctagatgacgacgagaagaggagggcaacgatgatgcgacttgggaggtgaggcaagtcgatgcaaatgggagatggggtgagggatgcgccctgcttgcactgtctgcacccgcacgtgctcgcttgcatccgcggccacatgagccagacctggctgagaagcgaaaggtgaaaacctgcatctcttaggcctggctcttggggccgaattgcatctgctcatcctcgatcgcgagcacacctaaccaaacaagatattcactgcatctctcatgtgtccgggcaaccaaacacaccctgtatgaactacacgagtttcccaaatatgtatgttcttcagaaaatagcatagttgcatctcactgaatgccaaaattcaaatgcccaaacagaacaggcatctccaacataaccaccacagtacgacaagactgaattattgtacaataaaggttatttttttatgaaaactaaactgatgattaaataaaattactcaatatacctaaacaaccatgggtgtataggctgtggttagttcccttcaaacttccaacttttccgtcacatcaaatgtttgaacacatgcatagagcattaaatgtgtacgaaaaaaaccaattacacagtttgcaggtaaattacgagatgaatcttttgagcataattacgccatgatttgacaatgtggtgctacagtaaacatttgctaatgacagattaattagacttaatagattcatctcgcaatttacagggagaatatgtaatttgttttgttattagtctacgtttaatacttcaaatgtgtgtccgtatacgtcaaaaaaaattgccaaaacaactaaacacgaccataaccttccgaaacagtacacaaagtgcacaaaaagcagcaatgacaactgtttgttccccaaaactagcgagtgttttaccatagaagaagaaatcaatagcaaatgctctgacctcccaaaagaatatgtcgccagagatcccaccgccgatgaggtagctcccctccggatcagcgatgagcgcgcgtatcggctcaaccgggaagctcttgacggccacctggggctgcaggggaccaacaaaggacatgaagctccgcctccgagatagggttttgtgagtttaaaggaccgtgggttaaggtcgagtgatttaccttgtcccagtggtagtagtggatgggtgctgagttgccggcgggggcctgggaggcggcgaggaagcggccggcgacgacggtgagagcgcgggggcgggaggcgcaggtgcggtggcggatggcctcggcgcccgtgcggaggtcccacgcggcaacgccggcgtcggtggaagaggccgcgagcaccagctgctgcggcggcgccatggtgtgttggaggggacggaagacagggagcggcggacgtgatggcgcggccgcgtgggagaaggccctgcagggggagcgcctccaaggcgacctacttagggttagagtatagctgtcaaatgggccggaccaagacccggccggggcacggccgtactctaggactgggctggccggcacggctaccacaacccatgggccggcacgacacgacccaagcacgagacacggcccggctgacccatacattttattctaaccaaaaaaaaaaaagtccgtgcgttgcaacagatgaaagttattttaatcttattattgttatacattttagttaaggtgaaatctattgtaagaactcgtttggatatatatttttttaagaaaatcatgcgctgcaattaggactctgatcgtttcaaggtagcatgcaagttttttttaaagagatttcttatgcgattccttctatattttaaaaactaaacgaacttaaaaaccgactctatatttttctcagaaaatcatgatctgcaattaggagtccggtcatttcaagttagcatgcgagtttttttaaaagaggtttgttatacgattctttttatatttccaaaagcgaacgaacttaaaaaccgacttaaatacggaactgtatttccaaaaagaacaaacttgaaaaccaactcatgcacggatgacgtaccaaagtaccggcaaaaatatcttcaatttttatattttattcttactagaaaaaatgcccgtgcgttgcaacaggtgaagtctattttaatcttattattgttatatggtttagttaagatgaaattcactgtgggagttcgcttggatatatatatagaaaatcatgagctgcagttaagagtcagatcgtctcaagttagcatgtgagtttttttaaacagatttcttatatgattccttctgtattaccaaaagtgagcgatcttaaaaaccgactcaaatacggatatgtattttcaaaagcaaataaacttaaaaaccgactcatacacggatgacgtacaaaataccgacaaaaacatcttcaatttttataatagttgagatagagatagaaaagagatatagattaaaaccaaaacataaaattaaaaccaactcaaacatagatgacgaaccgcagaaatatctttaatttttataaccgactcaaacacggatgatggaccgcggaaacatcttcaatttttataatagtacagactaggaaaatgtccgtgcgttgcaacgggtaaaaacgtttttgatagctatacattatactcgtttggttttggaccgaaagctcattcattcattcctttccagcccgatcccggttcgctacctcactacgctcggcctttcactcttcgggccagcccaaacgtggagttgtaggtccaactcgcacaacccattgtcgtcttcaaccttcggaagatagtcccttcctcgtacgatgtcgagctgatcctccccattaaatctagtcgaatctttctcgatcttccaaaattggtttagggttttttatctacttgatttcctctttcctttttttttatcaaaatcggaccgcaaaactcggataaaaatggcgatggatagatggagattaaatccattcaattaaagccttggaaaggaagatcaagcggaaaatgatgaggtagcagcggggaatcgatttttcagtctgaatcggctgaagatgatcggatcaaggacagccgatacagccgatggggttgatacagccgattccagtggcgatggctttggggctgtttctagaatctatcaacatgcttcacaaggattgccacgatggagataaagctctcggaaaggcaattgtatctattaattaggatatttttataatttccttagagatatgtttgggcaaaagtctgccgcaaagagttatggtatcttagaatttgttagatataagagtcgtgtccggcaaggacatattttgtaatctcgggtataaataggacccgaacccatgtaatcaattaacacacgttcaataacaatttcggcgcatcgccaccctgtttactttcgttctatttcgacgagttcttactttcggattgagctgcatcgattcgatcttcaactagatgtaaacttatcatggcggcttgcgttctcaggattagtgcttccatctttatgacactctaatcatgtttatgtaattcgtcgagttatcatatacacgttacagtctttgttagttgcgttatataacttgttatcgggtagttcttattgtcaggaagtgaccgatagtgttatgtttggttattaagttagattatatcgtgtatccaccatcacttagaggttttcatcatcttgtttagatcccacgattatctttatgcttaatgctgcatcagttgagttcaatctgttgagttttacttataattgtgatatctggcttgttttatgattatcgagagagatagtatcggggtttcaaccgatcttacttgatttagctactttatatctcatatgcttaattaatatgctagatatgccctttatattaagatcttattgcattaagttatattaggcttcttgtttcaatattctgtttgtcttgatattttaatatagagtggtatcggagtattagccgatacatgctagatctatttgatcagctatgctataaacatctatataatcagtactttactttatatttcgacttaagtgatttatactatctcggcatggcgaccaatttatcccaatcatttagtttaaatatgtattgaagtaaggattatatgttgtcaatatctatagccgatcgagtagatttagtcttatcttatttactcatgactaccgatcgattcaaatatgacatcggcttgaagataaatgatatgtcatcggcgactagtcgatcggttatcgtttatggatttaaccgttgtttttcttgtctttctttcttgctgattgtaggatcaaatcaattggcacgttcacgaacctaaaggcaagattttggacctgcactgaagttaagtagatcttccaggccagtgtgtgtttttcacatcaacacgcttttggcacgcccagtgggaccgagttgcgacaactttttctcatggcagaaaaacaatcaccggcatcgacaggcaaggctccaaaccctccatggtccaagcctccaaatcctccggggaccaagcatccaaaacctccaaggactactcaaccatcatctgaagtcagactgcgaacattgtcccatatagataagttatcaccagaacagaagaagcagtttgagcaagtgatgaagagcgctcaggagcaattcatgaactcattcaatgaaatccgccagggaacagtcattcagaagtataaggtgaaggtggttgctgccgatgaacctggaacaagctcatcccaaggtgataacaccaaggggacaaaaagtgctgcggatggctcaggtaataaaggtgagggacttcaagatggtacagtcgaggatgttgatgaagatgatgatgaggagcaagaggagcctttgaggtgcaacaatttccaagaccaggttgactatgctgttcaacatgccttgatcaaccaatcaggggtgcttgtcaatactttaacaaatatgattaaatctgtggttgatggcacgatagctgagcatcaaaacacttggccagtctttctaccaggtggcgtcttcccaccatacaggaatttggtgacaggcaaccagcaacatactaccaatgcaccatcggtttagccgatggcagcggtttcgtctccagcaccagttgcaccattctcagcacaaaggcaggtggttaatcctcaagtcttgaccgggaagcaaccacaacatgttggcagaacgccaatcg

SEQ ID NO: 63966 - DNA, 1100 bp, Oryza sativa
ttccataaccaacattggactcaatggagctattttacaaatattatcccatggatttattggggctacactttttttcttagcgggaacggcttgtgatagaatgcgccttgtttatctcgaagaactgggaggggtaactatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggatttttttttcttctactagtccgctctatattccatagtggaaatactaaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctataggatcccaattccagtaggatccccacgcctcattagcccatactgctccacaaagaatacctatggttaaaagggtaaaccctagactaatgacacgataactccaagaatccaaacactcaattaattgatatttgtaataatttggaaataaaggaaaaaagg

SEQ ID NO: 63967 - DNA, 1958 bp, Oryza sativa
catttaaaaataattcaataataagctaaaaataatttcgtcggaatatatccatgtgtggtcttgctttagagatttaattgcaacgatttaatggtgcaatcggatcaagctttggataagtaatttaagagaaaaatcagtttaaaatagtttttacacgtaaatcgggcgctgacatcagggcccgattttaatcggctcccatcaggcgcccgacggggagtcacgtcctaatctttagttgttcccgggtgttcaataggtacgctccgtaacaacattagttacgtagtgttccacctaaacaccccgcaagttacctggtgctagataaacaccccgtaatttttcagctcacactcggtatagtctccaatcttggtagtcctacgttgctatattgctatattgtgggaatgatagagtaatttgtgctcagaattcaatcaattcatggccggctattaattggtcaacgtcctctattctttcttaggctgtgtttagtttcacaccgaaattgaaagtttaactgaaattgaaagtttaaagaaaaaagttgaaagttggtgtgagtaagaaagtttttgatgtgatgaaaaagttgaaggtttgaaggaaaagttggaaactaaggccttaattaactcttgtcgtgtcccctctgcaggcgctgttcatcgtcgtcatagcacgtcgctctccgaacgctgactatagcaggccaaacgggcggcccggcccagcacggcacggcatgccgacggcacggcccactagggcacagcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcatgctacagtaaacgtgccgtgccgtgccagcccacgggctgaggcatcggcccaaacacggcacgggataacgggccgtgccggcacggcccacaggctggcgtgccgtgccgggcatgggccggctacagtactgccgtgctcgggccggcccggcttggcacggcccatttggccaggtctaacgctgacgtataacgaattgatcgatctcctagaaaaattgatcaatcaaagaagtgtacaggacatcaacgcaaattaattgacttttttttaaaaaaaacgaaggaatgcggtgtgtgttatactctagttagtcatatgatccagattacggcataaacgttttcttggaagcaagctaatcctgccattgcattaaaaaaaatcctgagaatacaaatcaaagaaactcggggttgaccaaaagaaagaaggaacaacagtgaggagaaatggtatatgctcaatttattctatatactcagaatatataactttgacaattactattatatacatgctccttacaatcataaataaatatctggtgcttaggataggaaatttggtcaaacttgggaagttccaaccatcaataatcacaaatatttagttcttctgaaaaaaatagttatatgatttatctcgaaagtattatcataatatgtcataaagttgttgcaaataaaattgattgtcgaaattttttaattttgacttaatcttttcataagcgtcaaatatttataactag

SEQ ID NO: 63968 - DNA, 1348 bp, Oryza sativa
aggacctccgcaggctgaggatacggtgggtggactacgtgcacgcggtgttcacggcgttgggcttcatgaccgtggcgttcagcagcaccgccgtgcagagctgctacttccccgaggccggcgacaacgtgaagcagctgctcaccaaccttcccctcggcgccggcttcctgtccaccaccgtcttcctcgtcttcccgaccacgcgcaaagggatcggatatggcggccagtccaccaattaacgtacgtgcaatcgcctagctagctacaaggcttgctttacttgtgcagtgatgctaattaattatatattgttgttggccaagcctttcatttggtgtagcgtgcacgtgtgcaacttttccatgtgcactagtcatgtaaagcagtttagtttgtcacgatttgtgttatgcgcatatgattctttgcaattgcaccgaagatgcacgcacgattaattcggtttacggttttgctataaatgatagattgttaattttcgcttcaaatttgtcaatttttcagccgttagattaacctcatgattcgtgcatgctttcgtttctttgacgttcgcgggcgaagagcagcgggctcagcgcgcgcgatggcacggcagacacaggggtagacacggtctttaatttgcatgcacatctttttccttttcattgatgaaccctgtacggctgtaccctcgttaatgctaagagtgtgttaccgctgatgtaagacggttttctctaaaagttacatcttagttatatacaaatgtcgggtcccaaaattagctttcggtaactaacttgtctgcatgtctgtatcaagccctagatgaatagattaatacatgttcaataatatctggatcaccattccatacatttaaacaagggctccaaaagagattttattgcataaaatacaagagcatttacataattgtggctaactattgcagcagaagctatacaatgaaccgactctactattttgctataggctcaaaccttctaattagtctagacttgagggcttatatgattgaactcctggttttggcgagaacttcgaatcaactctggaagggttaaagcaagcactactggagaaccaatctttgctgggtcgaccgaaaaccacattaccctggttccaataagaactgggactaaaaaactccaatgggactatgtgaagatcatctttattcctggtccatcccctgacaaggcctgtcagggggcaggggatctttagtcccagtttgtaataccaactagaactaaagatacctattatttaggttggtaataccaaccaggactaaagattattt

SEQ ID NO: 63969 - DNA, 962 bp, Oryza sativa
  unsure (1)..(962): unsure at all n locations
acgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatttgtgatgttggatggtgagagcccaagtgacatgtatgaccggttgagcaagatcgtcaatgagatcaagggacttggctccaagggcatgaccgatgaggttgtggtcaagaagatggttcgagcaatcactccaaggaactctaccttggtgactatcattcgtgagcgtccggacttcaagactctcacacctcatatttgctcggacgtattcttgcccatgacatgctcgtgcaagagtccaaggatgtcatccaatacatcaatcaaagttcaaccacaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccatcaagtcaagtggaagacactccgcaagagtgtgctacgtgtgcaaagagcccgggcacttcattgcggattgccctcacctcaaggatggttcccacatcaaggaagataagaagaagggtgagaagaagatgagaagaaggagaagcacaagcatagcaagcgggaacattatggccaagctcaccttgngatgatcttcggctccgactccgagtcaagctcaagtgatgaagaaggagtcgccacatttgccgtcaagccttcatcaccaccgagactcttcgactactcaagtgatgaggatgc

SEQ ID NO: 63970 - DNA, 706 bp, Oryza sativa
cgcgtgatgtgacatttgacgaaactaatggctctcaagtagagcaagttgactcacatgtgttaggtgaagaggaggatccgagcgaggcaatcaaaacattggctcttggggacgtacgtcctagggagccacaacaaggagcctcttcctcaacacaagtggagccacttacatcaacccaagccgacgatccctctatctcaagcttggatcaaggtgaagaaggcgagcaagtgccaccctcaccgatcatcttagctcgcccaagaatccatcaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctctaaatgatccggattgggtgatggcgatgcaagaggagttgaacaatttcacccggcaaaatgtgattggcacaaagtggatcttccgcaacaagcaagacgaggccggggtcgtaataaggaacaaggcaaggttagtggcgcaagggttcacccaaatcgaaggattagatttcggtgaaacttttgcgccggtagctagacttgagtcgattcgcatattgcttgcttttgctactaacctcaattttaagctatatcaaatggatgtcaaaagcgcctttct

SEQ ID NO: 63971 - DNA, 8958 bp, Oryza sativa
ctcgtgaaaaacggctttgaaatcgggaaagccgattcaaccctctttactaaaagacatgataataatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaatcaagcaactcaaggaaggaaccttcatttgccaaacaaagtatttgaaggacatgctcaagaagtttgggatggagaacgccaagccaattcacactcccatgccatcaaatggccacctcgacctcagcgagcaaggtaacaacgtcgatcaaaaggtatactgttccatcattggctcacttctttacctttgtgcatctaggcccaatattatgcttagtgtgtgcatgtgtgcaagatttcaagccgctccgaaggagtgtcaccttgtggccgtgaagagaattcttagatatttagtgcacacccctaaccttggtctttggtatcctaagggagcgaggtttgatctcattggctatgccgatgcggattatgccgggtgcaaagtggataggaaaagcacattgggtacttgccaattcttgggtaggtcccttgtttcttggtcttccaagaagcaaaactccgtcgccctatccaccgccgaagcggaatatgtttcggtggggagttgttgtgctcaacttctttggatgaagcaaaccttgagagactatggcctcaatgtatccaaaatcccactcctatgtgacaatgagagcgccattaagatagccaacaaccccgttcaacactcccgaaccaaacatatcgatattcgccaccatttcttgagagatcattccacaagaggcgacatagacatccaacatgtgagaaccgacaaacaattggcggatatatttaccaagcctctagataaagctaggttttgtgagttgaggagtgaactaaatattttggattctcggaatgtggcttgatctattgcatgcatgtttgcttggtagaataggtttgcataccactttgtgacaaaatggtcattcaattcatggatggacactagtcattttttttgtggagattttgaatctatgtgtatggggatctcatttttcaatgaattttggtcctagcacaacttgaaatagattcacacattccctctctcgagggtgaattatcttgtctcatggtaattccccctcttttgatcccttagatcgtccatttgacttgtggctattgttttgtgtgattgattgtgtgctagtcacaagttcaaatggagcctctagtgctcgaccatcccttcctttctatatcctatcaaaaatccttgtaaaaattgttttttgtcaaaattcctttaaaatgtttgaaaaatagtttcatcaaaattcccggcgaaatctcattgcaaagctgtgttttccaagaatttttggactttccgaaaaattttcggacattccgaaaatctctatcctgtcgctctttcaattgctgcaatcccaggatttttcggactttccgaaaatttttcggacatatccgaaaatcatcagaaccgtgcgccactcttctgtatcctttcggacatatctgaaaattttcggaaatatccgaaaaatttcggggtcttcatatatcaccccgtggactcccttctctctcctttccacttcttttccccacgggttgcctccctcctccctccccaccggtgactccccggcgacctcctcctctccggcgacctcccgcgacacccctcctctccaacctcgagggagcacgtttggggcacttcttgggccctacattgtcgatcttcaccgtgttcttcccgtgttcttcacgttcttgaggtatttgcccttcaatcaaatccctagattcctcaagatttctcttgcgatttcctttggtggagatgttcccctagtgccttaggccctgcagattcaatttcacaagtttttgttggcggatttgtgcggcatctgagttatagagttcggcaaaatttttcggacttgtccgaaaattttcggatatatccgaaaattcctggccgacccctatcacttcagatttgcatgtttcttgctctcaatcacttgtttcttgtctccttggcttccatatctgactccttgtatctctattgtttgaaggatgcctctccacaagcaaacctcccacaagtccaagcgcccgagggatcgctctcccactccatcttctcatgatgattcggacagtgattggtccggtggagaggatgcggttcctcaggttgcgcgggtggctcgacggtctactcatgctcatgatggtggtggtgatggtgagggctcctctcgtcaaccgcaaacgccgccgcaccaacccaatgtccccattgggcctctccgcattcatacccccgagagggatccggcggtgattcgccaagtgtatgattggcggcgcaagtctgaggttgttgctcctcgtcgggatgaggatccgcgctcccttcgccgcaccgacacggatccgcggttttggactctctttcaacaagacttttatgagtctgtaattaaggtccaaagctcatcccactgttcccatgcaatggatcaattgggaggagctgcaggcacataatgatctggtgatcaactctgtgattgccaattgtgatctcatggatatccgctccttcatgacgttgcagcaaaattggtgcaacgagatcattgctcagttttacgccaccgtatactggatgactcaggggtcctggtactctgtttcttatcagcagttgtctgagatctggggcttccgtcttcgttctttgctaaaccttgatgaccttcataatcttcaaattcctgccaacacagacttgcttcccctttacactcaaaatgatccaaatgtggtgttgggcaaggtcgacggcctcaagctgtactttgcctacttgaaccggatgtttcaccggtcttttgtgcctaaggatggtgatgctagcagcattaaccatctctctaggaccgtgcttctccggtttgatccccctcctcatcgcttccatgtctatcactttgtgtgggaggagatccgcatggcttcaattcagtacaagaaggggttggtctatgcccctcacattatgcggatgatcgagactgtgactcagctccagtttcgccatgatgtgactcattctcagcttcacttgcgccttcttaaggccccctgctcctcagctgctcgggacataccctcctcttctacccagccgcctcctgctcctgagcgccctgcctctgtggctcgtcgtgagccgtctcccttattccgcattttgcggagtctttttggtctttgctccgaggaggccaaaaagaaccgctgattgcggaattcggcgaagaagacggctcgtgatgtcaagttcctaaaggcacggtattatgaggaccaccacattgatatccctccttctcctccgggtttcgaggccgagcccgatgagccggaggatgaagagattgaggatccttttgccgggttgccttccgacttcgacttctttggatatggccatggctatggctatcctcctccaccacctcccgaggatcctcctcaggcgcccttcgcttgagtcgtcagctcatcgtcctctctttttggtgtcttgctgccaaagggggagaatatctatcatagctttagtttatctatcttatccttagcgtcgagcacggttggtttttatctgtatgatattttttgtgttttttatgttaagtttaaagctttgtaagtctattgtttaattatgaatgcttgtgatgtaatggatcctattatctttaatgtggtgcaatatcttatcctctttatatggtgcttgtgatgagatgtaattattcatttgcatgtgatgtgttggatgtgatgagcatatgtgatatatttattctcttgtgagcttcaatgtggatgcaataatttagggggagctctccacttgcttttatgcacactcttagggggagcttccactaaaactttgcaccaaaaaccttaaattatattcattctctcttgtgttctaatcgtattgtcatcaatcaccaaaaagggtgagattgaaagtgcatctaggcccctaatgattttggtgattaattacaatgcgattagagaggactaacatttttatttaagcaaatgtgaaggttgtcatgtcctcaaagagttagcgtaatgcatatcccgtggaatacgttgatgtgatgtgatgcggcaaatgagaaaatgatattttgtacgttttcgtttccttgagttaataggaaagccgcactattaagaggaatgatgcattgacatacgaggagtgatcaaagtgctcaaaatctatttttaaaaggtgtttctcctcagtttggtgtgttctggattttttcggagttttccgaaactcaatttcggactttccgaaaacacacagaaccaaattgtcgcttctggaaattttcggatatgtccgaaagtgattttcggacttttcgaaaaaaactgcgaaggcaaaagtggttctgtatattttcggacttgtccgaaactgattttcggattttccgaaaatcatcagtagagtcaattttgcatctgtatattttcggacttgtccgaaagttattttcggacttttccgagaacatccagaacgatgttgttggtactagaaattttcggacttgtccgaaaagttttcggaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctctttagtacttttgagccttgctttcttgtttcccctcttacccgtgttcgatttggatttggtgtgtgtgtgtgtgagagttgtggattcgagtttgtgtgagtgcttcttgttgacttcgtgaagatttgtgagcacttgcatcatctccgggagttctttacttcatttgttactcttggaggttgaggactcctaggcggctaggtgtcgctcccgagccaccgatctacttgtggttggccgggggaagtttgtgaaggtcggatctcacctccgaaagggaagagatagccttagtggaaagaggagtgcttagtgcaacctcttgaggaaagggttagccaagacccggctcttagtgagctcctcaacggagagtagaatcccctcaaggattcgaacttcgggaacaacctcgtgagcttcatctttggtgactttacttcctccctctcctctagctttgcttgtttgagccgctataggtctagttgctgtttgtgctagcatattcttgttgtaggcaactagatctaggatttactttcctgtttgtgctgactctgaaaattttcggatatatccgaaaatttcggaaatatccgaaaattactgcttccgcttttagttgatttttgaattagcctattcacccccctctaggcctaattgacactttcaatcggagtacgaacgaagtcccagggattgaaacgacgtgggccgttagatctccttttagtctttttatatataaaaaaaagaaaaaagaaaaggaaaaaggagagcgctacagccagccatagccaccacacgcctgcgctcttgccactgccgccctcgtcctggttgccgccgccgtctttgcgccgccaccacggccatagccggaggccacggacgtcgtcatctatcgccaccggtggtttcttttcgttttgcttatttgtggtgagttcgtgctgctgctcttcttctttcgtttccctgctgtagccgatctgatggcttgttgttgctgctgccatgatctgctgctggctgctgctgccgcgatatgctttttgctgctgctagggctgctgctggctgctgctgcgtgtggagattatggataccccatacctacacggcatgtataaccgactgggtatggggtgccatgtatagatagaatatctttaaagggactcgggttaaatattaaacttgtatgtcaaggaaatatccagggttctagtcggttaagattgtattttatctgtaactacctattccgttagggatatggtctgtactttgtaatatggactcctctcctatataaggaggggtccgggtgcctctaggggcacgattttttctcccagatcatacaatcaataatatactcggcagatcaatccccagacaggagtagggtattacttcttgaataagaaggcctgaacctgtataaaattccttgtctctgaacacatctacttttccagcttgatagccacccccttttagtatgccgaaatcttgtttcgccagttggcgcgccaggtaggggtagcgtcaagttcttcgccgactagtacgatgggttccgtctccggcatcgacgacttcgtcttccctcccgggtaggcatttcgattcggcggcctcgacttcatcaccaacgacttcggcaagatttctctcctcgactcggattcgaaccagtcgggaagaggccagatctctgccccgttcggtatcccgaactcggccgaggtctactccaagatcatctctcccgagttggcttcaaaccactcggacgagatccaatctactccaacacgaccagatcaagatgatgggtcctatcccccaatcctaatgagacttcccgacgatctggctgctgtcttcatgaccaaggcgtctcccatccgaagacctagacgggattcggctttagcccagatccaatctagctctaaggaggtcggcgttatactccaacctctcgggacggtctcgactgaagaattggatggctacctcagctctcccggcgtcagttcctgaccaacggagatcctcgagtacgacgacttcggctaccactacgactacggcaacttcaacggcttcgacgatggctatgaggacgactacacgcctctctttttcggcgtatttatggccgacaacgagacggcagaacaacgccgagcccgagaagcggaagaagagcgcacgcgacaagaagccgaacgtcgccgactggaggaagaacgacaacaacaagagcgagaacgactacagcgtgaacaacaagatcgcgaacgggttgcgaaggaggttgaggatcgacgacagcgcgccttggaatccgggcgacgagcacgagatctcatcgggcaacaagacgtcgacgggacagcggttttccgcacaccccagcaaaacgcggttgcagtgatcaccctcctcgacaccctcctcaaggaagatgcgctcaatcaggccgatcatgtcgtcaacatcttgaatcagacgaagaccatgatcgccgcctcgatcccggctaactccgcaagcacccgcacgccgactggcagccgagtcctccctctccgatctcaagactatcaccaaccaagcctcagcgtcgttggcgccggatccaatcgcaggagcaggggtcacgacgagcgatctgtccattcacctcccgaacgacacagggagcgccgagttgaacgacctcgcaggcaccccatcgatcttcacgataccatcaaccagcgccgcgcggcaagaggctacgctccccaccgttcaccagactgctacgatgacgacgtggatggtgtagctaccttcacggccgacctgcgtcgagtggattggccagccggcttcaaaccgactggaatcgagaagtaggacggcaccactaacccggagtcctggctcaccgtctacggtctcgcgatccgcgctgcaggaggagatagcaaagccatggcgaattatctgcctgtggccctagcggattctgcccggtcctagcttcacgggttaccccgtggcacaattggatcttgggtggaacttcgcgaacacttcatcgccaatttccagggcaccttcgaacgccctggcactcagtttgatctttccaacgttgtccagaagtccagagaatccctgcgagattatatccgacgtttctctgaacaacgcaataagatctccgacatcaccgatgacgtcatcatcgccgccttcaccaagggcattcaccacgaagatctagtcggcaagttcgggcgtaagcctcccaggacagtcaagcagatgtttgaaaaagctaatgagtatgccaaagccgaagatgctatttccacgtccaagcagtcgagcaccacttggaagccgaagaaagatacgccgactactggggggagtggaagtactcatcacaaggatcgcaagcgtaagcccgaggaacttgtggcaactactgcgccaacctcccgacaacgttcgcgcgtcaacaccttcgacaagatcatgaactcccaatgtccgcaccatccaaattctaaccacgcagccaaagattgcttcgtctacaaacaatttgcagagcagtacgccaagaatacacgcaaaggcactgacggagatcaaagtacgtcaaagaagaaggatgacgaagatgttgccccgactgattttcaagaccatcgcaaggaattcaaccacatctttggcggacccctggcttatgaatccaagagaaaacaaaatttgactgaacgagagatcaatgctgtccagcccgacatgccccaatatcttcggtggtcagaaacgacaatcaagtttgaccgctcggatcat

SEQ ID NO: 63972 - DNA, 2227 bp, Oryza sativa
tctccatcatcatcgatgatcggctcaaatcttggagatcttgcatcgactaatggtggccgattgacaaccatcctggtgtgcaaatttagccagatccgcagtaaccaccatggaccccctgtaccgaataattctccagaggctatcttgttaattgcggtattgagagtctgatatagatagcctagcaagtattttccaagggggaagtgcttcttttctaccaagttctcggctacacgctgccagtttgcggtaggaccacagcttggaccgcagaacaagaatttttcgagccacatcataaggaaagctgcatgttcccttggagagactggcccagttcccatgttcttcgcaacataacttgtccaaccgcctatgcttctagtcttgaactcgtgggtgagttgggtatccaaactagacaagttagccgatgaagtgacatctagcccggtgatcatgatggaatctaacagggttggggtcatcggcccttgggagaaaaggaaggtattcatggctctggaccagaagtaagaagtggctgccatcataggctcatctcttgccatatccgctgcagttaaggccaaggcttgggatatgccgatttcttcccagtgggttgatttggtagccgatatcctcttataccaagcaggccaagcttttttcggccaacggccaggatttgaaggtgttcttccagcagctcagatctaggttagcaaatctaaagggaatttggttggtttctccattgataaattctgtggggtctagattgccgattaggccaaggaaaaactggaattcatcagttatacaaggaaacgcaacttggtgggtgagatgctacagaagaagagaaatcgaggattgagcggaagaagaaccaatcttgtgcagtaaagaaagggatttagccaatggtacttgtcacgcccgaaatttctatccaaaattccaaacgcttacatgtgtgttaaatcctcgtccaggaatcagccgaggcacacaataacaaattgataatagagtattattaaacagctaattaatactcgcaaaataataagttattacaaaggtggatagttcctctcaaaagaataaaattctacgcagcggaacaataaacaaaagactaaatagctatggcggctccactccacaagcaacttgacccgaacaaagcctaatcctcctgatcatcaccttcagtgaagtactcctcctctgatgaatgaatattgcaagaatgagcatatgacatactcaacaagccacacagcaaatatggaagtgcacaggataacaaaggatgacatagtatagcttatttgcataaacaacatttaatgaacatttgagagaatagtaaaacagttgagtaattaagcaatattaaataaacaccatacaacacacccgtgttgcataggcccaacctcatctgaacaaccaaccccggttgtacaaatcaaacctccatactaggaatataccattccaaaccaggagtcaatttaaatatcacaggttatcaccattaatgagtagtgtgaaactaatcacgaaaaacattgttagactcgcccataaccgcgcacacggctatttgaatagttttactctggccagatatgtaccactgtacccacaagacacagctccacgacatgtcaccatgcgcctcaatacaaccacggtacctcggaaaggaactgtgacagtacccttcgcacaacacacaacacaactcaccacagtgcaccatacctggatcataatcacctcctctacaactagaggcatggacatcccagcgacccccacggacctctcgccgcttctcagtctggcaccccgtaatgaaccatgctattcaaaaggtaaagctgtgacgtgcacacgtctatggatcacgtgtgacgagaagttgtggcccgatcttctcaaaggatccacgaacttgataactatcgccgagagtctgcacacgcgacgaactatcgagacaatcacccttccacgtaccgacgaagccagcccacgcaatcacaccataaagatgtgaaggcacaaactaggtgaaccgtagttcggcgttctacaattccctcgggaattgaaagaacaaatttgcaagcctctcgagactcacatggaaagaagaactcaaatagtttgtatttctaaattggcagccaaaaag

SEQ ID NO: 63973 - DNA, 2150 bp, Oryza sativa
agcgttcacctgagagtgaatttccttctctaattgtttggctctgctccttgtaattggacccactatatcagatgcacgtttattaggaggtggggaagagtggctgctagggatgtcctcatcaagctgttgcccacactggcttgtggttggcacggttaatgtttcacaacagtagctcgcgaactggtccttaattgtcatgagcacgaccatcaaaaccatgtgctcataacccacctttaatcgggttttaattatcaattaattatcataacacgattaaccatcgtgagctaccattatatataaccataaataataatgtagtgtgattcatcccattaatgagctaatgtttctaggcatggctaaacaattatatatatagcatttagctgaaccaaaccaatatataaggttcaagccaatcaatttataacccataggaaaataaagtcatctttggccataattaattggaaaaggctccccacctgatgacattcgaaaataatgcataagttgaaataaaatattagctttaaacgggttcatcatgctcaaagggttgtttgggatctgtgtgacttgccttgagcttcttcaaatgcttctgaaccttcctcaacgtaaacgctctcctacggaacatcggaaactaaagcaaataaacaaaatcaacaaaacagttaaaaaaacaagcataaacagtatatgtggatatttttaacatgtagatctcgattttagatgaatttagcaacttgaaccacttgaatctgagttacgatgatttagttatgatattccgaagtttaatcagtttttcacctaatacagaaaattattaagatttaaataaaatatttatgatgtcaggatgacatccctgccgggtatggttctggaccacacaaccgccggcgaacgaaggcacaacggcgcaaacagagagcaccatcacaacgagcacgacgagaggaacccaccggtggtgacggcgacgacaatcgatgagagaaaatgaccggcgacgaactccgacggcgacatggctcggcttgacgacggcggcgactctccagcggtcttcggcggctgcgaaggggcggacgggatgctcctccacctggcgaatctgacagtggtgacggaaggcggcggtgacgatcatagcggcggctgaagcggctacggtggcgtcggcgctagggtttccgcggcggcggcttggacttgaggcaaacggaagaggacgactaggggatgctttatataggcatgggtgagggagatcggactccaaacgagaggatttgagccggaaaatccgacggttagtttggagagataaactcgaaaacgaatccaaattcgcatcgaactcaaagggataaaatcggatttttggggaaagggatagaagaggataaaggaaacaaatctcctcaactaattttagaaatgcacgtgaggaaaggccggaattggaggggaaaaaccgagccaattcggtctcgggtcggctgacagaggttgaagaagaacagtgcatagggaggcatagtagactttcggtcttgggccggctgaaaataaaacaaagaaagaaagagaagggggaagctcggctgggccgacttgggccacacagcactcgcgcgagggaagagagttgggctgaaaacagcccaacggcttaggggaagatttaaaaactttttcaattaaaataatttgtgaaatgatgtttcatttattaaaaatactttccttactcaaataattcccagaaaaaatctaaaaaatagataaacaagtaaagtatttaatgaaattttatccaacttagttttatgttgcgatttttcctagattattagagtttaacttgtaagcttttaaaataatttctaaaaatgcattagagaatgaattattaaattaggcgattttcagggcgtgacagtacttacctcgacatattcggtggccgatgcgcttggtggactggtagaggtcgacattgctagtgatgaagattggagttgcggagaatcgcctttgggtcgccggaaacttcgaagttgtcgtcggagagctcaaggaggagatcggggaaagttttcactagagtggttaaa

SEQ ID NO: 63974 - DNA, 1583 bp, Oryza sativa
ttggtaagacatgaaccaggttcggcattgggatcgaagcggattcggcaaagagttagattcaaataacagcgtgcgcatcggctgtcaagacatcggctagagtctgaatcggttgaagatgatcggatgaaggatagcagatatagctgatggggttgatacaaccgattccagtggcgatggctttggggctgtttcttctagaatctatcaacgtgtttcacaaggattgccacgatggagataaagctctcggaaaggcaattgtatctattaattaggatatttttataatttccttagagatatgtttgggcaaaagtctgccacaaagaattatggtatcttagagtttgttagagataagagtcgtgtccggcaaggacatattttgtaatcttgggtataaatatgacccgaacccatgtagtaatcaattaacacacattcaataacaatttcggtgcatcgccaccctatttactttcgttctatttcgacgagtttttgctttcgggttgagctgcatcgattcgatcttcaactcgaggtaaacttgtcatggcggcttgcgttctccggattagtgcttccatctttatgacactctaatcatgtttacgtaatttatcgagttatcatatacacattacaatctttgttagttgcgttatataacttgttatcggctagttcttattgtcaggaagtgaccgatagcgttatgtttcgttattaagttagattatatcgtgtatccaccatctcttagaggttttcatcatcttgtttagatcccacaattatctttatgcttaatgctgcatcggttgagtttgatctgttgagttttacttataattgtgatatctggcttgttttatgattatcgagagagatagtattggggtttcagccgatcttacctgatttagctactttatatctcatatgcttatttaatatgctagatttgccctttatattgagatcttattgcattaagttatattaggcttcttgtttaatatattctgtttgtcttgatatcttaatatagagtggtatcggagtattagccgatacatgctatatctatttgatcagctatgctataaacatctatataatcagtactttactatatatttcgacttaagtgatttatactgtctcggcatggcgaccgatctatcccaatcacttagtttaaatatgtattgaagtaaggattatatgttgtcaatatctacagccgatcgagtatatttagtcttatcttatttactcatgactaccgatcgattcaaatatgacatcggcttgaagataaatgatatgtcatcgacgaccagccgatcggctatcgattatggatttaaccgtggttttttttcttgtctttctttctcgttgattgcaggatcaaatcaactggcacgctcacgaacctaaaggcaagattttggacctgcactgaagttaagcggatcttctaggccagtgtgtatttttcacatcaacagacacgcatgaggagatatatcgacgtggcggtggcgtggccggcgatgtaaaaa

SEQ ID NO: 63975 - DNA, 2019 bp, Oryza sativa
  unsure (1)..(2019): unsure at all n locations
tccgattactccgacatgcaacctttattctctgtctagtagcggtgtaccccctcccatattctttcccacgccacccacatccggtgctactccgcgcctccatgtcgaggaccgtcgaagccaacgacctcgctgatctcctccgcgcggccgctgcccaagcatcacgaatataggcaactgccgaccagagctgccccctaccatcgccacgcgcatcgctgatctactccgcgtctctacctcgggggcagttccgcgtctctacctcggaggccacaccgtcgtctccatggtgctactccgcgcctccatgtcgaggaccgccgaagccaacgaccttgccgatctcctccgcgcgaccgctgcccaagcatcaccgatataggcaactgccgaccagagctgcccactaccatcgccatgcgcatcgctgatctactccatgtctctacctcgggggtggttctgcgtctctacctctggggccacaccgccgtctccacgccacaacagacaggcgcctccaaaacccaccgtcgatttgtccgcaccaccaccgaccttcaaggacagaaaaagttcataatagagtaaaataatactccctccatctacttttgatagtcatatttcatcttggcacacagaccaatgataagtaattctgtttatcatctatttaaacatgctactagtcattcctcgtaaaaaagcgattcattaatatttatatttctcgatgcccatgtagccaatcatatgtggaagaatggagagtcacgcattaaatccgagaaagtcattagatgataagttgttggattgaaaaatatgcctatcaaaaataaatttttcagattcggaaatatgactataaaaagtagatggagagagtattttaagaaatagtctataacagacctccctccccaccgtcgatttgtccgcaccaccaccaactgtcgaggacaaaaaagttcataatagagtaaaataatattttaagaaatagtctataacagacatccctccagaaccgcgtagccagcccatccgacaggcgggcccacttacacatatcacacttacactttcgtcctcgcttcatgtaaaagggttaacctgggagtgatatggtaggagggaagatgtcttataagttagttccactcatgctaaactagtaaggtggtactaaacatgcacacactactcacatggggcacactgacttcatcctaattaggctaggatgtcacatagtcatcggcacaagtattcataataaacaatcaagcaacattaaataaggagctaccctcctagttttaatagtatgtttatttttttaaaaaaatattgctatatttttctataaatttggtcaaagttatagatatttaacttggaaaaaagttatggcgttttataattattaaatggagggagtagcaatcccgattaaatattcatgctaagcttttgttgattacgctttcaacttgtcacatgaatcactttttgcttaaccaaacagagtgaaatgacaaataagttgtgataggtccaggttagtaaaatcccgagttaatgaaatcacacaaatacattaaacagctcaaaggcagagaactatagagcatccgaagaatattactactaggataaggttcatcaaccctgtgttgaccggcttgaatcatagtacaagatcatattaaaacacatggacgatgataacgaaacgtaagacctccatcctttgaaggtctgattattgctcgagagttacctccacttcagcgccgtcttgtacctcgtcatttgtaatttcagccctgctttcggtttccctcggtagagtgctttggataccaacagaatcttttaggagtatgttcctagattgataatctgtactgtaatacccatcattttcttcggagnnnnnnnnnnnnnnnnnnnnnnnnnnnnnnnnnnnnnnnnnnnnnnnnnnnnnnnnnnnnnnnnnnn

SEQ ID NO: 63976 - DNA, 722 bp, Oryza sativa
taacaaccaactgagaattccacggacgatcagacgccgaatgcccaaagagatcgcgatccttaatccatgaagcagcgcctcatactctgccacattatgggacgcagaaaaatgtatccacaatacgtagctcaatctttctccagtcagggagatcaaaacaaccccagctccagtgcctgaaagcctcttcgacccatcaaaatgcatggtccaatactccatcttctcctcgggcatgtcttcttggcactcggtccacttggcgacaaagtcggctaaagcttgggacttaatcgaagttcgtggcttgaaggatatatccagggacatcaattctaaggcccactttgcgattcgtccatttgcttcgcgattacgaagtatatccccgagtgggaacgatgtgaccaccgtgaccgagtgaccttggaagtagtgagataatttcctaacggtaattaagataccatataataacttttgaacctgaggatatcttgtcttggagtcggccaaaacctcgctaacgaagtagattggtcgttggactttttgaacatggccttcttcttcatgctcaacaaccaggaccgtgctcacaacctgagaagtcgctgacacgtataacaatagtggctcttgcagatatggtgaggccaaaattggtggagtagtgagaagtttcttgaagtcttcaaaggctttttgtgcttcgg

SEQ ID NO: 63977 - DNA, 1488 bp, Oryza sativa
aaatggagaaaatctcacttcctataaccagtgatggagtttgagtgaactatcaatgggggaccaaaaagttaacggtattcattaacacactattaaaataccaaatttagtactaaaaatacactacgaatctattacacactaatatcaggcctaactgccacatgcttaatggacattgctttcacagatccagttacttctttccacggtgtgtagctctctcgtcagtcaccacacaagaaacaaagataagcagcagtgagcaattaatatggcaagtccatcaaaattcaggaactaagcctaactgttgctgctatgctgcatactactagctaccacacatgggcttgtgtgccaattgctgctgcatagtagctaaaggaaaattttctgggggaccacaaccctgttaagtccacactatcctccgaccctgcctataaccacagctctgcatactacagataacataatcaagtttaaacaatcatgaacctttaatacttacatgctatgtaaatccttgccaagtttctgctctatcactattttgatatcttgaaagttacatggagttgcctgaattattacaaaaatgttaaataaacaaaaactaatgaggctatgcagtgtacactaacattaagatagaaattaactagtaaacctgatcttgcagacaagagagtgttgatgagtattcttttggtacttgtcttattgtacttgcgtttaggcattattgtacttgcatggttatgcactcccgttaatcttagtgctacttttgaagtttggatatttgatctgcttgtatgctatcaaggaaaaacaaatcttgtattgagcccttatttgtttctttctttatgccaaatctgttgttcagatatgctccagccacacaactttggagaggcagcatatcatgtgatgggtagcatatctgaacaagcccagatatctgaactttggagataggcataaactttggagaggtagcatacaaagttgtgatgggtggcagcaaagaggataggcatgaacctgagcttgaacattggagcattgcagtaaaggatgggaaagccctggaaaacgagtggatgagtgagataccaatcccacgtcgcggccctcatagatctataacttcccctccccatgatttctattgttgccatttttgttggaaagtaatgttgctatacacctaaatgtcttgatgtttagcatctgttatattcagacttttatggtgctccccacaatatgtatgcttctaggctatttctttgatcaagtatctagattaaaattagttctgggccagaaatctgtttgcatgccatacaaagttcttgtggcatataagtatataacctgttcccgagaatggtcctgtcattaacaagcagcttaatcatgatttttctcttttgctaccagggcttttgttgttgctaatgataagctact

SEQ ID NO: 63978 - DNA, 1738 bp, Oryza sativa
aatgtatacatgcttgatgatggaatgagatggaaagaacttccacctatgccaaagccagattcacatatagagtttgctttgggtgaatgttaacaattctcattattgctgggggaaccactgaaaagcacccaataaccaaaaaaaaggttttagttggtgaagtgtttctgttcaacttgaacacactggtacacacctttccttgctccttattttagataaaacacttaaaagtgataagaaatgatggattatgacatgaaaggtatgaaacattacctatcaactgcctgttgtttgtttcatctcgcagtggtcgcgcagatggctccccgcggggccgaaccctaaccccggctgctagggcccctccagatcactagaggttgtggacgacgacctgtacagtatacaatcaggtgattgatcgatccacctgattgttaatgatttcgtgtaagcagttgtaaacttgaaaattttgttacttttttaagaaaataattggtggtgtcaactagcaatgcagtcggttttcaatttttcttctgtatttaccagggagcaagctgttagctgttttgtgaatcacttctaatttactgtttattaatgcttgttctgtgatatatggatgctggatgcgctgagaatggaatggtacttggtacttgtcgttgtgagtgtgcgcccattgggaatgaaccctgtgctctattgggacaattttttacaaaaccgcccgcttcctcatcagtaatttcgcgaataaccccccgagcttccttaccttctcttgcatctggactcatgccgctcgtcgtccccaaaggaagcttcatctccatctccgtccggcaagacgatggtagctccaaatcaatgctatctgccaatcgactactgcttgctagacggaggccctatatagcacatacataaagctgcaatatactaatttatacgcgaataatccttaatacatcgagtatcatggattcaacatcagcagctctgaaaattgagattcttgtagcataactgatccctcccaagtcccaggtccctcaaactcgctgagagtgaatcactatattacaatcagaaaactcagttcaatctgccaatgtctgagaaccaaaaaaaatcagaaaatccaacaaaacaatttctcagagaaattgggggttctaccaagagagacacaaagctagcaagaaagattgagtcctgcctttgtgcaggtttagtcaaaaacattgaagtcccccgcaagagtgacggatttttttatggttggatttgaggactcaaggtgcatggacaggaggaaaatggataaaacggaacttgactcgtcgactagcctctccactccgtctccagtctccatggagcatggttttcgggggattagatccgccgtcgcccactggttgagagacgaggtttcggggacgattaggagcgccagcagcctcagggggttatttgcgaaatcaccagtgaaaaagcaggcggttttgtgaaaaaaatttccccattggttctaaaccttccgattaagatcctagggtgggtgcacagtcactgagtgcatgagtgccttaagatgtaccagagagcttaaccattcaaaagcaaagcaaagcaaacataaagcacttcaaaacagcacttcaaaacagagtgcaactagtctcttcttaggccagaggttctcataatatat

SEQ ID NO: 63979 - DNA, 3674 bp, Oryza sativa
agaacatcttggcactacggtatcatattcctactcaaaatatcttcccatccggactcaaaagattttccacactacttctggatattcacactactaatcttttcaggcagtcttaatcacttgattcgtacccctcatgatgtggcacatagtcatcatcactttcatctggaacaaaatcatcatccgaagaatgagactcctcttcatctggaacatagtcatcatcttcggtagaccgatactcatcatcatcgacaaatccataaagggctggaagaaccacctcgtcccctacctccacagccacctcaagaacctcctcccctacctctacagcagcttcaccgtccaactgcccctcccctcctacagcagcttcaccatccaagtgcccctcccctccatctgctggctcaggcaagagaagagcagcccactgttcagggtctagatcatgtccttcaggaccggcaatggctgcaaagtgttgggcccgagcatctatggctagttcttcgagagcttcaccatgagcaaggcctgacagaatgctagccctaacggtggctctaacgtttggtaggaatttgtactgcaggaaatgatatattaccccatcttcttccataagcaccggcggcaagacgacacggcgtctgaatcgaatcccaccattgatctcgaaagtaggcaatgcaatgccattaggcaagacaagcgattgcacattgttctctggtgtcctggtcaaatcgtcatcagtatagaaacgccaaccagttgcatcagctccattgttgatcatcatcacatttagcacctaggaagataaaaaagcaaaatttaaaaggaatcctaggcatctgccatgtgatattttgataaaaaaaatcatccaacaggctgaaaaaaaataccgaacagacagcaaaaagaaattaaattcatcatgcacaacatcaaaaatcaggtcaagtatgattaccgcatcatcatgcacaacatcaaaaatcaggtcaagtatgattaccgcatcagagactacgatattttcaaactctttgtggtcctcggagtccaatgggggatcagcaactgcatatcttgctccgttcattagtttggcacatacttcagtagcaaaagagaacctagaacccgcatttgccatagaatattccaaagcgccagcagaatcaaagcaatgaaataatactccacgccactgcataaaaaatgaaaaaaggaaagatgagccggatacacgttatatcacccagatacaagcacaactaagtactattcacagattagctatcactatgatgacaaggaattcagacatcacaaaataactgtgaacaaaaagacattcaatctgtacctcatcattggcagcaccagccatcatgaagtcgcgtactggccttggaagtaaaaacctgttagcaaacaacatgtgcaattaaacccaagaataagtggagcaagaacaatctatgaactggatacgaaaccctagcagaacaaaaaagtatataggattttgtatttttgggatctacatagaaaaatatatcctaagctaccacagaagggagatacagataaaaataaagtggaaaacatgaaatcaacttcaagaagcagcatgaatcatagtggatcccgtgagctcaaggaacaaatacaaacgaatctagcggccataaagcgatcaaacaataggcatctggaattcaaataaatttctataaactcatgcattcgcattcgttgcaagcgaatgataactgatatcatacaaagcagatatacgacaggaatatgaacacgttgcatatgaataaatgaggagaggagatcaagggggatcatggcatactaacaaattgcatatcagaaaactaagaatagaagattaacaaattggagaccagaaaactaaaaaatagatagggaatcatgtctatgaacagatcacaattgcacataggaaaactaagaatagacagggaaccatggctatgaacggaacgcaattgtagatcacaaaacaagaatagatatgaacatgtcgcaattgcagatcacaaaacaagaatagagaatcatggctatgaacggatcgcggcacacatcgatgttagggaatcatggatatgaacagatcgcagcatcagaggagaaaacgaggatcacggcacacatcgatgctagggaatcatggatatgaacagatcgcagcatcagaaatcagaagagaaaacgagaagagaaggggagggatcgagatgcacttacagtacttgcggcggcgaagtcaggttgaaaaagtggagaagtgggtatttatatagaaagattgtgagctagggcatcgtgcttatccgtcggatcctcgacggacggacagatttctctcgtggagattatgggaagtgggccacggatccagcccactaggagctcgtcggccgtgtgtgtgggccgaacggttcagaaacagaaagttcagttgaggtccctcatcttgtcacccatagatttataaaatcatccttaaaccaaaatacgaaatcttataaaacgggattaaatttccttcggcagtatacatgcccggtttggctgacgtggatatttgacctgatccactcgtgctgattgggcacttgcatgataaaaataaaaagtaggtcccacgtgtcatacttagggcccctttgaatcacaggaatgaaaaaacgaaggaatattaaaacataggattctgatagaaatacgagtgtaaaacagaggattgtaaaacataggaaaaatataaaaatgaccgtttgattgagccgtaggaaaaatacaggaatttgaaaagagagataaaaactcaaaggattcttaccatgaggtagaacctcatgctaaatttcctccaaaacttgcatagaaagagacatttcataggaatttcatgggattacataggattcattcctctaattcaaaggccgatatagaaaaaatttctataggaatgaaatcctttaaaattcctatgaattttctttgaatcaaaaggaagccttactctattccattcctctcgctctcttccgtttctctttccatctctcgagcgagagacgggcgaccgcaaagggacaacaggcgcgggtggtctaggcgtttggcagcgagggccctcgtcggcgggcttggcggcgctgcgtcgtcgaggttgttgggacgtctccggagcccgaggtcggtgtagcatcgagggacggaggtcgccacgtttggtcggtccagcatattctttgcttgaagagaagaactgttaatgcaaattagatatcccaaaacaaacaaacccacaataaataagatacgtaataaaaaaaataccgattctatttagctctacaatacaaacactgaatgaatcaaaatgccagtgagcacatggacacgcacacgccaggcatcaatgaaaacagacatcacaggtttcatctcagttgagcgtaacatccatgaatgtctctctttttgtcttcgaagaaaaaagaaaaaataacaacagtaataaactctctttttaggcttcatagtttaactgcttttgctgaatgaatatagatttaattggcagaggctgcaggaat

SEQ ID NO: 63980 - DNA, 5413 bp, Oryza sativa
aaatatttcagggtgctttacaactgtcgcggccttcgatggatacgagtacatttgatcttttaacagtgactgccacggctcaaccaacaactaactgctgccgaatctaattcaagttggcccattagctgcttctgcggtggtgaggtcagctgctttagattgaactttgcgagcactgtgtacctctcgatcactccaaccatacatataatctgtccagaaatcaaacaagtccatcagaatctgaagtgaaaccaacttagcaaagcttcaaagcgtaaccagatgtgcaattcaaacaacgtaatgtactagagttcacacttcaaattttgaaaaggaaaaatgcaggaataaaaattagatgagataatcatatcgaatggagtagcaaactgaaaaggagatgcaactagaatgaaccaagagtatgctcttagattcactgagattgggagtcatttactttgcagctggtacatcaatcatgagccatggaatgggttggcaggcacgatatttatgacaaacaagtactacctccgtttcacaatgtaagtcattctagcatttctcacattcatattgatgttaatgaatctagacatatatatctatctagattcattcacatcaatatgaatgtgggaaatactagaatgacttacattgtgaaacgaagtagtcatgaacttgaatgggatggcaaatcatttagaagaacaatacaagaacatcagtttggatcatgacatgtacatgtgttttcactcacaatgtaccaatgtcatggacttggcagagttaaacaaaaggtggaaagcaaaagcatcataaacaacgtttttataagtccattttgtttatccaatgtcggtgccatcaggatgccaaaatggaatcaagccgaaaagatgatgggccctaaattatataatcatgtttataaccctaggtgatcatatctgtcttatctaatgctccattattagaataaatttgcaggtgtgcctggcttctagtacatagagagatcatggagcagtatatgttccttcactcctgaactatataatgccaactaatcattatggcataatttgcaggcatggctgctgcctagatagagatcatggagaagttacttctctcctgaacaataaaatgccaactaatcattatggcacatttcccagactagttaaaaactgctccagtaactgcatgatccttttcagccggtttcagtattggttaacttaaccacagagcagtacgcaaaagaacatgtcatcatattttattaaattgagcagtcaacaagaacttctgagttgcaaagtagagcgtcttcagcttgttcaaaaagtggttaggataacaataaagaaagaaaaaggacctcaatcaatgtaagatgcttcccctgtctattgggcattgaaaacactacaactacaagagtgtattattacttattaaatgcgatcaaggggggtattcttctgcaaaatctgtgtgactaaaaatagctttcagtacaattacatgaaatgtgacagcaactaattcaaaagcttcatgaaagcggttcttacagcattaaattctgaagttacaaagctttaaccgcccatgtgcttgagtcatggatcaggccttggagctatataaattgtttgccagaaatcaaactctaaattccaaacatgttgtattcatttgaataaacaactgttccaataggttctgggtgaaaatgataggatatatgattagtttaataacaaaacattatgtggattatggaccattacactagaaatccacaaacaatcaaaatgcattaaagatcaacgaaaatttaccttctcaatctgcacaataataatcctgtttggactgttaaggtcaaccttgtgaggttgaggaacagatttggatactgcattgataattttcatcctattgattcttgtattcgaccttgcttcataaaacacaccaaaactgcaaagattaaaatatccaagtaaagaagcataattttagcaaaataacatggggaaaactcaattcacattttcttagtactacagtcagctcttgcaacttcctgtatttacttggcaatcgtggtgtatgtcgcatatatttttgtattgggtggataaggggcataaaatattgtttggtcacctctactccctctgttcccaaatataaacatttctaggtttttagcagagattaaggttaaggagaaaagactatggtgccctcctaactgagaataggagggtggttggggtaagattggaagaaatttgactgagtggtggttggtgggaatagtactctaggaatgctttatatttgtatacaccagtaccatattccaaggctcattatgtttgaacttcaaatggagaacaatgtaatgaaattaggaaaccaaacttatagggaaattaaattgaagcatatgagcccacagacaaatcaatgtaccatactcaaaaaggaaaatagatcgaatgtacataccagtcaacctacacagcaatagaaaaggacgttgacccatttggcacaaacaccattgtctgagattttcattagtagcccaattcctatcaatatgccaaatcaaggccaaaagcatgaatgcatcaagagtttagtggtagaaaaaactatatgtagttctttccaccacactttataatttaggtgtgagctgagctaagataattaaaataatacaggcaagtggtgctatttgtagtattatcaaaagtcagtaaagcaaagtgtcaacaggcgagaaatattcacccagggagaagaaaaccatatgttgaataaccaggcctttgcagtggtgttctaccaaggtagcaatggtacattagcaacgaagttatcggtatagctagcccaataaggcagtcatagaaatattttcccatttaaatcagctattgcaatatagaaaacttgcattagctttttttttctccctaaccaggattattggcaattgctctggcatcccaactaataaatcatgctataattctaccactaaactatatgtaattacatctaccatatgatttgcaagaaaacagggcgatggattttgcctggtgttgccaatgctgaagcttgtcagtgtgggtatcctggtcaaatgtcagctgctgattttgctccccattgccaccgattttggtccccattgtcgctaattcaaaatccttgacaccagtgcagcccaaaacagagcaagttctgtgggagtgaacacacattagttttggttcctggaggtttaagttcccttaaaagacagtacatgttctggattttttattcagtaatatgtgtttcagcattaacaccttaatctattctccccccatacatgctactaaaaagtgcaattattagtggtgacatatcctgtaaagatgtagaagtatatgcgatcacaatacccaagtcaccaggcaataatgcctcagagctagggagaccaacctgcatgcactgctttgaattgtgtccaaacaacccacaaacaaagcaaggcttcttccgccttttcattggatagctcacaactacatgatcctccctcctcagcaaggtatctcccaggatcaaaatatcttggtatgccctgatcatgagcagaagcaactaactattatcttgtgcagcttgtacatatatacaaggaaattcactttgaacttacagtactgtcaaataaaggggcatcaggcccatcttcagtgagcactgactctacggtgctggtttttgcctcctgaataatccattcccaacaaagaaacatctgacgtcaattccaactcacaaacataaatcagttccctatatgtaaggtttccataccataataaattcacaattagttcaatacgcatattttctaagagataacaacataagacattatttttaacttggattctacagaactgaaagagcctttccattaaaaaaaacattgcattgtctttcagccattttcaaagacagatattactcagtatagctcacaatccaagtcgattctggctgcgtttgtttaaataaggcctccgattttcttagtcatccatgaatcacagatttgcttgctgaactaaatgcataaatagtacatgaacaagatcaagggaaaagacctactcgtacctactcctcgatggcggccggttcagcctcgggtgcctccttccgcgctgcttctgctcctcctcctccttgcgcccggcctccacgggcacggcgcaaccgggcccgccggaatcgcgcggtaggcggcggcctagcggtggtctagtcacggccatggaaaagagaggagtgacggacgacggactgccgtgcgaggtcggggagaagggcggtcggatcttggagtgttctgcgacgagggcgagtcctgcgatcggctgcagcggctgaacggagcggcgacgacgacggaggtgatcgggatcggcgacgagccgcggcgctagggttagagcgggggaggggcggagcagtgtcagcgcgtcctctcgatgatggtgaggagttcagtgttttgtgtacattttctttgtgcatttaagaaagaaatgaacggcttcgttttatattaaaaaaatagaaacattatattagcatagataaacaaagaacaatagcagttagtatacccacgttactacattcgtcccaaaatataacaatcgaatataggatgtgacataaacaaataattatagtgacaaaataggtagaaaaattcaactcaactgtgcggtcaaatttatcagttggttttataactcttaatcactatctgacacttgatgtgtatggagtgcttgggcgagccggccaagcccgatgaacacagcggcgctgcccgggtacagcgtgatggcctggtcgtactgtcgcagcgcactcgccgtaattgtccttgtaccgctcgttcccagccccgggtcacctcctcctgaagactcactccctttgctgcattgatggggcaggtcaactcgccggagaccttgagtagctgccgtggtacggactagctcccaccacaaaaaagaagcagctcttccacgactctgtcaccattgactctatttattattatggtaaatcattgtatcaagatgtcaatcttagatcttattccagttcgatacatccacctacgattggtaagggggtcgacgattccatagcttctcgaatagtgagattcagttttaagggaggaaggaaattaaaaggaaggagagttgggaaccaatggcaaaaaaagtagagagaattctttatatgccactgaaaattggtctga

SEQ ID NO: 63981 - DNA, 3713 bp, Oryza sativa
cagtagcatataagggattatctcaaaaaagtatcatgttgctcctcggaaaacgcgtatagtagtctcattggccttcgtcgatgggatgtgtattttcatattaagagttcttaaaagttatcaactcaaagcccaaacgctacaatgttcgaaattctcaacttaacactagcgtcaatgctgcttcttgtgcacggagttcctaacgtaaagtcagagagatgtgggagccacttcccttcttgggagccacactgtccctcactagaccattcacaatgctttcatgtgacattcagcagaagcagagggaaacaaatattcgctgccacctcctccaccagcggagctttgccaagactatgtagctcaagtttgccaccggttcctcgtcagtttttgcaggagtggcctacgctagcactccgtgctaccgaaggagaaagagagaagaggagagagatgtgtcgtcgtccccatgctccacgtcgctgagctcgtcgcgaaggggaggagggtgaccgggcaccgtcctcgccggagaagttcgccggctcgatggggaaagcgacggccgcggtgaaggtcgatttggcgccggtgaactcaagaaagaggggagatccggcgagtcgtcgccatcgccgcccgaggctagatccggcaagcacaagccgaatatgcctgccccgccgccactccgcctggcgccatcgctgctctactcagctccgcgaggaccaccacgccgctactccactcggctccgcgaaacgttgctgccgctgtcgtcgttggggaaggacgagagtccatcggtagtgaggaaaagaggggggggtggggagagagaggaagaggagctcgagactgagacgacgaggtggagccccattccatgctgctcgtcgccaccactctgcttgccgccactcgggccgctcgaggaaggggagatgaggcagccggaggaggggaggcgtgcgattagtgggggaggagtggcgctgagaggataaggagagagaaaattacattttttatttgtgtggacctcacttaaagttacaaagcactgttaaacttgtggcaaacattattcttaggtgttattgaacctacgtgtcacatgaggttcggcaaaacatgaagccgcactgctaatacccttatgctaacatggtcatagtccccctcgccggatccaaggctggcgcgtcgctatgaaacaaaaggaaagcattctaggtgcgatatgacatggctggaatgctacgaaactctgctatccttttgttgcatgcattgcaagttgtgcaatatgcttgcaatgggaaatctgagcttaattttatatgagtttgcattttcatatgttcattgttgtgtatgctggttaaattgcgttgaatatgtcgctatatttttttatgaacttataatgtgacttgtggtttttcttataaatttgacttaacataaatccaaactgacttgtaatgtgaataatgtgcaacaaaagaagtagcaaacactaagtccgtcctaaaatataagaaattttgtatggatataacgcataagagattttagatggatataacacttcccttgtccaggtttattgtatatcttggggcggagggaatatacatacatacattcgatgctatataaccaattttatccatatataaaatcttgcatagccaacaatggttgaatttgataacttaaagtagtaatccatatgtcaacaagatacaccactttacacaaacacttatgttgctggtgagaattcaacccccaaaaaaaaaacactaactggaccgcatgtttttcttatcacgctacatcatcatcaatcaataactcccctaaccccaccgtttttcttatttttttgaatttttttaggctttctcgttgttttacacgtagctgctaacccctcctgctcctcgcgcgcgtgggggcaaccgcccataagaggtgcgccggttaatcaaaatttggtcgctgtggtggtgtgcatacgtcgttgagaaaatggggattataccatcctcaaaacagggcttcgctgaaatgccatcctataattgggattcgcccaaataccactttcaactgagcccaacccgctgaaatgccatcccaaatcattttcatcaaaaataaaagattttactctacttttcacatgagttgatgaaattacccctcagtcaatttcatccttagaaatcaatcggctgggagagcgagacgcatagggttagggtttcgtccgcggcgccgatctgggtgccgccgcgcaacctccctagcgccgccgcgccgccctgcccttccctccagccaccgctccgtcgtgccctcccctcgcaccgacgcctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcacgccgcggctctcccctggcgccgacgaggtctcccctcacgccgcggctcggccggcgccctcccctcgcgccgacgcttggccggcgcgccctcccctcgcaccacggctcggctggcgccctcccctagcgtcgcggctcggccggcggcctcccctcacgccgtcctacgctcggctgtactgcggcccctctccacgccggtctgtcgccgtcccggatctacttgcaggagtgatgcagatggattccaatgtttatgatatatgaactcagtttgagtgattatgcattttgtggttgggagtgatttgcgaataatctgggaagcatgctcttaatgatgcttaactggtgttgtttgaatgctgttaatgatgcttaatgagtgatgcttacgtggtgttgtttgaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaaggaagagaatgacatttcagcgggttgggctcagttgaaagtggtatttggacgaatcccaattgtaggatgacatttccgcgaagccctgttttgaggatggtataatccccattttctctacgtcgttgggtggaggggctgctcccggtgggagcctgggaggaccgggtatttttgtaaaaaaatcctcgtgtttgcacggaatatcacatacgtcctcggacagcctgacatcccgttttatttcttgcatataacccctcgtcttccaagaaaatacaatgtgaagaagagaaaattccgtttctagggataacgctgtaaacataaaaaccatagggggttttctgaaaaacgtcctacactaacccccaatcccgaaaccctccgccgttctctccctcccctcccctcccctctcacctctcctctctcggcgcgggttccggccggagctgccgccggagggcggtggcggcagcggccctcccctccggatctggcgagacggctacgtccgcggctagatccggcaccgccgccgtcggatctggcgacctg

SEQ ID NO: 63982 - DNA, 2860 bp, Oryza sativa
ggaagcgacggcaacggcgtgctcaggcgctcgccctccccctcttcccaccaccctctcctcctcggccgcgcctcctgccaacgtccccacctcgcgcagattgggggaagtggattcggcagggaggcatgcccacatggaggtcgtcgacgcggaggagctcgcggccctcgacggcaacgcctacagtgcggagtttgccggcgcggggagcagcaggcggcgactgccgtcctccccgcctcgcacagccctccgcctgctccgctcttccctcctcgccgaaccgatggcgccggctgtcgtcccctacctcacggacggcagggcaccgggaaggactgatcgtgccgatccgacctctccgacgggaagggaggggccatatggctgggctgcagtcgattcgtgggaacgacggcgaggccggaggtagtgctatcgagcgggtggacggtcgccgcggctaccgcagctcgcgtcatcggcggatccggtgccgttgaccaccctccccccagcctcgctccacctgtcggcgtcgttactcccggcgctcttcctccgtccgcgccctcctcctccactgtcgagtttggttgttggtgccggcctcgccgtccttctgagccggccggcgcgttggttgggcgttgcgggcgagacgatgcgttcgtctgacatgctgcgcactgcctcgctgtccacaccatcggccccggtctcacgttgctcaatcctcgtcctggatggacgctctcggggtcactgcccccgttgtttgggtctgcgcggtggtcgtcaccattttttttcgggctgcgcgtggtcctcaccgaagctcctggaacacgtcgtcgactcaagtgccttgccttcacccaccaccaatgcagtttggtttcagcctgagccttctcttctttttctttcgttttttctatgtttctatatcattcactctttgagctgtcactggacagtaatggtttgtgtattcttctcgctgccaaaaagtcactgacgatttgcattctgcattgaagaaccaaagcaggaaagtgtgtgcatcatttctacattactgctactgaagatttagataaccattacagtatgttactgcactgctgcttttaagtgaattcattccggtgaaagaagatgtggattccttttagttgttacaggattctgcttttaaagaactgcttgctgctacaggattaccgtttcagtgctgtgtatatttatctggttttacttgctgcagatcttgaggttgaagatgatagttgaggaatactggttgccaatcctgtcactgctgtatggctcttcctcaacctgcgttggtggaagaatgcagttttggatgcatgaagtaaccaattgttaccttaataagtattgtggtttgatgaagaaaatttactcacagctcacccccttttttttttctcttggcttttattcttgtggtgatgtttttactggatgctcgtcagtgaggcatgtggtttccgaatttgttggcagaaatatagttttgctccttgatgttcaacttttaatcatctattaatattgtcaaaatgaatctgtctatcttattaggcaaaaggataaggtaatgacacattttttgtttcaattttccaaataagtatcaagttgttgatgtttaaagaactcttgttcggtattttgacaaatcatgaataattccagtccttgcattagtgaacgattctgaagctacgccaaaaggatctctaattggcgagaagatcccaaccaactttcctattgaccttcttgagtgtattgttccattgcatttgtatgtaatactgcagaattttggacagaaaatcatgtagcatgttggcaccttggaatacacgacaaatgagcaggagcagtcagcagacattttgttattgctttcatttgtgacctctttctttatcaagaagaagacaaatcagttactctgtccagtcgtatttggagtctgaaaatatggacaccgatccttgaatgccgttgctgtagatgaccatacaacataatgtaactcactgtttttttttcaagttgtgtaatgcaattcactgtatggtagtatattacaagttgtgtacatgacataattacacgtctacttgtgcaattaagagtaattaaagagaaactctcttaacaagattccgattatttatataatgtttgtgatcatggtattaacctttttaggtccacatagaatgcttttgctgttaaccagcccaataatgtttacaagttttttcacttgaagttcatcgctacttgaataataagttatgtatataatatgttgtgagattacctgtttaggttaaatgaaatgaaggaaaacttctaatcagtagcaactaatttgtgtttgatagaatctctggcagcttaaaccacctttgttttggggtctggctaaaccgtatggtcaaactgaccttaattacgtatacttttacctatgtaagtgttagggtgcgcggcgtggcgccgcgctcacatttctagtccatcaataacacccctacccgtaccaattttctccgtgttttggaatttttttcggctcctcgggaagggttaagcgtgatttgcaattttgtaaaaggctccttgtgtttgcacagaatatcgcatatgtcctctgaccgcctgacattccattgtgtttcttacgtataacccctcgtattctagaaaaatataacgcgaagaagagaaaattccatttctaaggctagcgctgtaaacacgaaaaccatagggggttttctacaaaacataccctccccat

SEQ ID NO: 63983 - DNA, 12200 bp, Oryza sativa
ccctcctcgccggcggatccgtcctccgctggcggccgcgtgcaccggccgtcgtccaccgtgcggatggcgctgcgggaggacgggccatccgtggccatcgtgggcgcaacgagcgttgtcggccaggacttcctccgcgtgccgtccgcccgcccccagtcgctgccgtcgtcgtccaccctccatccgccgccgcctacctcgtccgccctccccccgctctcctctacggcgagacgtccgcgctgctcgacgcgtggcgcctcctccgcaccgcagactggcgcgcctgcgcggccgccgtcaccgtccgccgcgccgccgctgggcgcgcgccgcgcaccgtcgaccagtgcaagaatcgcttggattacctcaagaagcgcctcaaggccgagcgctccaggtccaaggggaccccggccccgccgccaccgcctccctcggtcgaccgcctccgtgcgctcctccgcctcgccccctccattctccctggattcactccccggggcggcgccataccaaaggtgggagaggatgccccgttcctggccgtcggtgctgaagcggccgaggacggcggtggcgttgctaccgttgagctcctccacggggcatcagcacggagacggaaggacatcgtgcacggaggtggcggcggcgctggataggctcgccggaacatacgagcgggtggaggtggcgaagcaggaggtgacgcggctggaggagcgacgcctggaggccatgcccgacctcgagatcgagcgcatgcggattctcgtccgcgtcgccatctccgcctccgccgtggccgacgccgccactgccacggcggcgtcctctaattggtatatgccgtgagtcatttcattccgtatttttcgtgtgtgtgcatctgtacattgtgcagcagctcgttgggtggtcataacaagcaaccatgtttgaagattcgtgattctggttggaatttaagcacaacatggctggaaaatttgcacttcgctgataccaaaagcttatcatgataatgtaataatcaaatttggtcagacaataatccatcatattaacaggcaatgctgatatttctgaaactactcacgtgcaaaaactgctttcttgtgatgctctgctcaatctgattttagtagaatcccaattgcaatgttcatgtccaatgagcatgaagtgtactgtcaatcaatgatcttttgatcaccttgatggacttgtcatttgttattcacgatgccattgctgctttgtactcctacaatctgtggaggacacaatcccctgatacttttgtttgtcatctgtttcttgccagaggaactaggacagtagactggccatggtagccatccagattccagtctacttttttcaagagacaattgtagtgtggagaaggcaattgacgtgatgccccggccaaaatttacatcggtttagattacagggaaaggttagccagatataagacaatacatggtgagattttttttttctttttagttcactgatagcaggttagcagcaatgcaagatgagagacttgatttcctgaactgaacatatcatctgatttagagtcagttaatggttagctattgctgtaatcccctcttgtattgaatacaacagcatgccccaaagcataagcaagccgctctgaaaagggcaaactgcaagcgttctgcaatgcctccaaaaccagaatctgcatatccaaatggtgcccagaccaagccaccagttaggttgacaactggtgcactcctctgaccataactgaactcgagtagatgatatcatgatattgctgattaaaaacagtggcactctcaattgtggctaggaacaataaaggtacttatactagcatagaaacttatgtaaatatattgatttttgagtaaatcatcaataaaaaaaactcctactgataccatttttgttggcggcaacgatgagcaaggttggcggatgggagcaggaccactggatgtgtttcgtgtggactccggccccacgctcgccctcccttctgcactttcctctcctcctctcctctctggcggcagaaacagctcaggatggcgcggctcgaggcgacgacagtagagcggtggggctgcacgcgtctacaagttatgaaatggccgtatctttttttaaggaaagcaagaaaggtccattcaaagaaacaaaatatcattttcatgctaattagagtttatgtttttggggagtttaattagtattttcaatagcaatgttaaatcatagttggatgtgcaacatgtaggcgaggtatcgtgagtcttgtggtagatacatatatatttaagggttaatttaatacatgccattaaaaatttgccggtttcaaaatataccactaacattcatatatttggaaatataccattataattttacacattcaaaagataccacaacttactccttggatacatttccaaaaaaaaaaaaaagaaccaaactaccccttttcccctcttcttccttcttcccctttctccttcctcctatcttccttctcagcggcggtgagtggcggagcgagtggtgcgtcggtggagcaagtggcatggcggcagagcaagaagcaacgggaagagagaggtagaagataagggtattctcgtccaatacatgcgaaatacatatcttagtgacaccattgagattacaaacaagtagcagtggcatcgttacaaatacgcaaatagtaatggtatatttttaaaccaacaaaatcttaatggcatagatctaattaaccctatatttaaccgtaatgctttgcttataaagctattataaaaccatatttattgatttgtaatctgagttagtaattggtttccatgccaattcatcccctcacaaacaataagttgggtttgatactcttggttcaggcttacaatggttgtggctgcgcgtgtcgtgtcacggcgcattgacattactgagagatcaatgagtaaatgatagttgttgccgttccacattgagcaaggtggtgttttttttttccagttaagaattggaaagaatgctccatttaagcaagattatgctcttttagtttgagaattggaaagaatgtgatctttggttcacatttaattatgctacgtagccttcactaagctcatgcaaaacattgtcgtgcgcggcgtggcgccgcgcatatccttctagtatctataatagatgtgtagcatactgttaaagatggggcaacaaaggtccgtcaaacagccaagaagaaggcatcaaaggtccatgcactaattggacgattaatccagggaagaaggcatcaaaggtccatacactaattggacgattgatccagggactttcaatagagaacacatcgactctgttcggcggcatcgctgccgcagcagttttgaactgctgcagccgcagccgctgctgtaaaatgccccctccgaacacacccatagtttatttgctcctctagatattctggaggaaaagacctcagcggaaacaagagcccatcaagcctacaaaaagggtacaaaatgaattgcaacagccaatatacaaacaaaaccaatatgttcagaactaaaagaaaaggatgtgtatgctaacacaaaataaatgtatcacattgaacagttaaacatattcaaaaccttcccacagctgtcatttttatcataagtaaaaattctattgcatgaccaggtcatcacatgaacacagcaccctgaggaagatgtgtcaacaattaacctacaactgccttttatcataagtaaaaattagccaggtgaacacagcaccctgagaaagatgtgtcaacaattaacctacaactgccttttatcataagtaaaaattaaccaggtgaacacagcaccctgagaaatatgtgtcaacaattaacctacaacttccgaacaaaaggtggacaccacaagagatcttactgaaattgaatacctgactttacgctctatatctttttacccaatatacatacaaaagatataaattttatatcatctttattagtgactcttgttgggtttcatctctagcctaccaaaacttgtttgggacatataggcttttattttcatcatggttgtaattatgcgcttttgcaccacaaaagagtggacgacatgatttttgtgattaacacaaccatgcgattgttaattttaaactattagtaattgtgatgcacaaagctataaagtgcacaataatcatacatctagcaaataacaaagctaaatgcagaaggatatttctaaatttctcaagacaataaactatatacataatgctaggttgtaattgcataggaaataccagcataaacccatcttgatgctgaaaaatttgacatcttaagccaatattgttgctatagcatcagtacatcacagttacagttcatccaaaccaaacaccgtctaacagcactagttactaatgttaactgagtttggaaccaaacagcacaaacttgtatgacacctgaatactactccatccatttcatattataagttattaatgttaactgagtttggaaccaaacagcacaaaattgtatgatgcctgaatactactccctccgtttcacattataagttactaatgttaactgagtttggaaccaaacagcacaaaattgtatgacgcctgaatactactccctccgtctcagtcaaacttatttatgtttggccaagtttatagaaaatatattaacattttcaatacaaaacaaacatattatcaaaatatattcaatgttaaatttaatgaaactaatttgatattgtagatgttgctaattttttatataaacttagtcaaacctagagagttttgactaagaaaaggtcaaaacgacttgtaatatgaaatggagggagtacgtaacaagcaaaagtatgacaattgattatatgagaaaaaagagacagtgacacataacttaccccaaaccgcagttcttgcttcaccaaccaaataggctgtcttttactgcaatacatgattcctttattcctacaggacgagaaggattcatgttcatcaactcctcgaaaaaatctctgggagctaaacaaatatgcagagttgagggctcgacttaccaatatctgcgattgcagcaagtaaagatatgatggataagtgtatggggactcggtggtggtttatggaaaatgtctccgtcactagctggagcccaggtaccagtacctaggtcatattgctcaaaacgaaatatatctagtgaactaggatcgacctgcaaactatgcatgcaaatgatagagttagacaaatcggagggaaggatcttactcccctccttgttatttgagagtgagacacagagacaacgttcatcaaggaacaaggcgtggtctccaatggtcgttactggctcaatccttccactgacaaggtcagcaagtctgtatactagcagctttgaacgagaaacaccattataggcaaccagcaagagctctgaaccacattcagcaaagttgagcaggtatagaaatttgtccattgggcattcagcaatcttcactggcaatggcagatgaagcaatcccttgtcgttatcttggcatggtggattaaactggtagatgtataccttatgtatgtcgtaagatgagagctgcaaagcatagagtttgccttggaaagatacgggtttgacaaaaggtttgagcgtccaggcagagagagtccaccgttggtcaccgggagtggcgtaggctacgcggtgcaggatttcaagggccagcatgacggtgatggtgccagtggaggtgacggtaacagatgcgcaaactttcattagtctgctgtgcttgcttcgctggctgcggtcgcggctctcggattccatctgtggcaggagggaagccagcggcgggaggtcggcgacatcgccggtgaaggggtggaggaggcggatggctgtgtcgtggtcgcggtgcaggagcaggaggccgtcgaccgagtcgatgatgacgtggtcgcgtaggagcggtagatggacacggaccaaggcggcggtggagaggttgaagaagcggacgtagccgcggaggtcgggatggccggggtagaggccgtggccctccggtagcatcatccaccgccgcgggtggaaacgccggtcggtgacgccgcggccgagtgggcggacggtgcttgcgctccagtgagagcagacggcgcggaaccggacgtagtcccgcatgtcgtcgccggcaagcacccgccccccgatcagccccaccagatcctggtcaagcgaagcccaatccggcgacatcttgccggcgtcgctggggatgggcgtcaggcggcggcgcttgctgctccgaatcataggcggcggcaaaaactgcaatcaacgataacggcggatcgaacacgattaacgaaacccccctctctgttgttctctagcagatactcctatcctatatagagagtttggatcagatctaaacggaagaaatatcggttcggaaaacacttacgagacagactctccaaatatccgtccgctgtcgaatcgcatcagaattagtctcccggcctggaactaccagccgccccaaactccatcgatctacacggaatcaatctaaaatggattgctagggtaaacgcaaagggatgaggaggagaggggatggatatatcagccgccatcgccccccgtcttcagagaggttggggaagaggatacttcacagcctgggcctacttgggccgtgtggctcaccgacatgggaagcccctatcagttcactttgggtccctctatttgtcaccccgtccgaatttgaattttgtccctccatcgcaaaatcgagtacgacgatttttttttcccttcaacctatgaaaccgtttaaataagggccctaggcagtattgtgcttggttttgtctaaggtggcgcctacatggctcatgttgactaggttgtccaacgtgtcattgtcgtggcgcttacgtggcaattagatccgcaaaaaataacaaaacctgtggggcccacaagtcagttgcacacacaatttataaataatattgggcccatgtggacccacacgtcgtcctcactatcctctactctctatccccccctctctctccctcttctcactctccaaccggcggagcggggtgggtagtggccgaagtgggcgacagcggtggagcggcagccggagtgggtgacaggcggggcagagcggcggcggacggagcaaagaggtggagtggggcaaagcagaggggcggagtggcgacgaccggagtaggccggcggagcggagcggaccgtcgtcttcaaccacgtcactcaccacgtccagctcgaatggtgaggccgaggcctcctcgtcggcgtcaatcgtgctgctgctgacggcgtcgtcgtcgctcgtggcagacggctcaccacgcggacctcacacaccaaccgcaccgcgcacatctatcgcactcgccggtgaccgctcgagcaggccggagcgaggcgagcggatctatgtcgtcgcggccatcgaccttgccggggagaggagcgacggagccgggcgggagaggagacgcgagcgcaggagcagacgattcgatggcgacgacaacgacattgaagccagtgtgcgcacatgaagcactccagctactcaacagtgcggccgactcgagttacttcactctggtcatcggccgctccaccccgttcgtagcccgcttcagtcgccgcccactccgtcggagagcaagaggagggggaagagaggatagagagaagagagcagtgatgatggcacgtaggtccacatgggcccaccattttttattatttgtgtgtgcaactgacacgtggggcccacaagttttattattttttgctgatctaaatgccacgcaagcaccacgtcaatgacacgttggacaaagacctaatcaaaaagagccacgtatgcgccactttagccaaaaccgaacacaatactgccgagagaccttacttaaacggtttcgtaagttggaagacccgttgtacccggttttgcgaccaagggacgaaaatcggactgggcgacaaatagagggacccaaagtgaatttattcctaggtggaataagtccacttggataggtgaagcatctaagcccccggtgttaattttggtaattaatgacaagcgctaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttatttttagtttcgccgtactattaagaggggtaatgacctagcaaaaagatgattataattgccacattaggtcattgcattttcatttgtgctctcttttttatcacacacacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggcggcacttgcgcggtcagactggccccctggaggccgagatggtgctgctcgggatggccgatacagagccgacgaagccgtattcggtcagaccgagccgatggcggtctgaccgagccgaggccggtctgaccggccaccccatgccggtctgaccggccaggccgatggggtcctctgacagggctacaacgactagttttctagccgttgcagagtagcacggtctgaccggctacatacctccggtcagaccggcagagcacagagttgggggatttcgcccccaacggctagttttggtgggtgggagtataaatatactcccccaccagcagcaagggggttctcttggcacccaattcaattgcatatactccttgcacctctctcacactcacttgagctttgtgttcatccatctagtgtgttagagggttgtttagccaagagtcaagtgcatttgcttccattgtagagctagtgtggcacttgatcatctccacaccgagtcattgcttgttactcttggaggttgccgcctcctagacggcttgtagaggagttgctcggtgacctctccgtgaagattgtggaggaggcccggcgccggtttgtgagtggtttggagttcaccaccttcggagtgaaggaagaactaccccgagtgatcgagacttgggtagtcctctccgtgggccggctcccgtcttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttatatttctagagacatacttgagatcatatcaccctaggattgcaaaacattgacataggagtgtgatttactttcctagagatataattgagccactatcatcctaggtttgcaaaacataacttagttgcttagttagagttcaccctcaccaagcctagcaacttaggttagatttgattaggtgttatttagtttttaaatcgcctattcagccctccccctctagtcgacatctcgatcctacaatagagaaaaagtacaccgaaggtccctcaacttgtcatcgagttacaaaatcattcctcaactacaaaactagatatatgacatccgttaacttacaaaaccgttcactttaggcccttcagaggttttgactctggttttatccaacatagtggctgagtctgcgtgagacccacttggacccatcattatgtccacgtcaccacctactctctttcccctcttctctttctctgtttctctccttccttccttcctctcgctctctgctcttgcatgggcatagggatgccggtgctagggctggcgcccatggtggtgcggccggcgatgacggctcctggggggtcttagcttccccaaggtggtggcgcgcgggctcgagacagcgcgagctcgctggcctccccgtccccctcgtgcgggccggccggcgaggcgaggcaagcacgcggtcctgccctcgcctgcgacaatcgtcgccgggtgcgacgcggggatcacgatcactgactcctcactgacctgcaccatcaccttctggtaccttctcaccttctcgctgtgctcctcctcttcctgttcattctctctgccccactcatcccttctccttccgtgctggtgaggttggagaaggacgacctcttgccggtgaggctggacagcttgatttcccactcagaacccgagccgtcgccgccgtgggagcacgacttgcttagctcccgtgtctgctcctctagcgccatcgcgatctcgtcaccctcccactgcctttggatcaccttctccaattcttcccgacgaatctaatccaaacaagaaatccaagaacacaaatgaaatcaatcaagaatgttctagaagagccatggtgatgagcaccgacgtacgttgaacgccgcctcctccgcgtcgtcgtcctcctcctcgccgctgaacatcaccgagatggccgagctgaatagctgatgcgccggtcgcaggaaaaggtctgcctagagctcgccgaccacaacagggtaatcgaggacagcctcccaaacatttgaccaacgcttattataatataaattaaattttatttgctaaaaatatatcattgaattgacatttgaatttactttcatatggttataatttttctaccgcagacttataatatatgataaagtataagacaaagattagtttttgagaccgtgccaagtttaaccgtgccttatatcatggaactgagagagtatttactttgaaaactattgttttttctatatttatatttttttgaaaaaaaattaacttatcaaagtttaaatataaacagtggttggtgacatgtatttggaagtggatagagtaattccttgttgttagtaaggactatttttttttcatacaaagcaaatgggattttcctcttaaaactgtactacctctaattttttttataacgcttgactatttatcttatttaattttttttcataaatatgtaaacgtataatttaatgttagagtaatgataaaacaagtcataataaaaatatatactacctccgtttcaagttataagactttctagcattgcatatatatatatatatatatatatatatatatatatatatatatatatatacacacaaacacgtgggcaatgctagaaagtctaataatatgaaacggaagaaatagcatttatataaatctttttactaagacaaataatcaaaacgaatggcataatatattgcttcctccgtttcatattttaagtcgtttgacttttttttctaattaagtttgactaagtttatagaaaaatatattagtatttccaacacacaacaaacgtatcatcaaaatatattcaatgttagattttatgaaactagtttggcgttttaaatattgctaaatttttctattagattggccaaacttgaataggaaaaaagtcaaactacttgtaacgtgaaacggaggagtaaaaaaatggagggagtataacttttccatttcttattgtcaattaattttttttatcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgcactaaatccaacgattcaaaatt

SEQ ID NO: 63984 - DNA, 6957 bp, Oryza sativa
aatttgtcgacaaatgtataggtagtccctttttttattaatccgagaaataaacaagcacttgaaatggttttcgcagatgggctaattgggccggtggcccggctgattccgacccatccaagcatctcctctcctccgaatctcctccacctctcccacacatctcctctcctcccctcgccgccgtcgacgcagaggcttggctcatcgcggcgccagtgactgatcgatggccgcggcctccatccccgcgagctcccagcccttcaaggtttgctcccgggagcagctccgccgattaatctcttcttgtttgaggagcgaccgagcgagtctaatcaatccgttcttgctacttttgctgtggcttcgtcgcagctgatcctggggtcatcgtcggtggccaggaagcatatactcgccgagatggggctcgaattcgaagtcatggtgggtttgcgccgcttttctcttgcctcttgcccactcccgttctgcattttcgccccccttttttggtggggatttcttgctttcgggactgtctcttgggggatgaactgattctgtggtttcagactgcagatatcgacgagaagagcatcaggagggagaaccccgacgagctagtgacgatccttgcggaggccaaggtgcggccttttctctctttttccccccatttctttggaagtttttacagcttcagcattggcgtcccattcccatcgctacagtagcaaatgcgtcgccgagtgccatgtattaatattacttgtgcataatattagatggtatttatggtgatatttggtctgtaccaagtgcttgaatttctgagaaatgaaaccttggcagcttcaatgggacatttggatcggacttgaccgagtaggtttcgatttagttatggacttgaattgtaactctaaattaaagaatggaaggcactggttcatctctggttgtttctattgctgctgaattggtcctagaagaaagagcataccatgacttcgtgttgatctcctgcattgtgatgctgtttctatgttgtcaattttttccccttgtaacaaaaactgaccactttgacatctttcaggctgatgctatcatgtccagattgaatatttctgattaccagaaagaaggcgacaggccaacactcctgatcacttctgacatagtatgccttgatttcctttgctatgctattttacgtggaacttggatgctttattaatcacaaaatactatgtttgaaatttgaccatgcctcaatttcagttctcctttgatgtttttttcttagctaggagttccatggattgtacatcaatttaagtatgactattttggtgccatgtttttgttattacacatttgtgtagataggccttttcgatatcaccaaatccaaatgtcatacagataaattagtcaattggaatcaatcctgaatatgaaattttaaattcctgagatgtgcattgtcaatgctgaatagatcaatacattcgcttatttaagaatgatgtcctgtgtgaaccataagtttggtaatgatgcatagcgcaagtcattcctgtttcaactttttgttcggcatgttctcttcgttctagagttcatgggcatgtggttgaacatatctgctttaggacccccatcatttgcattatccggggaatagccaaacgtcatatttgcaaacaaaaaataatttgtgaataaaacttttatatacatgttcttacgatctaaaagcaaaggctgaaaaataaactttgatgaaaaaaaccctaaaatcaactccaaatttgaggttggaaattcaaattttggttgataagcataagcataagcgaaaagatgaggttgttatttactagaatgttgtcattcgcattactgtcatactgaactgaagttgaccttgaggtggtcgtccatgaagggattatcagagaaaagccaaccacgaaggaagaagcacgccaattcctgaaaggtgtgcccacatgtcgaggcaacatgcatcttatattcttgttctccaatattttattgtattatttattacttgaacttttactttctccaggttattctggcagccatgtcgcaaccgtggggtctgtagtcgtaactaatctgacaactgggaagaggcttggaagcctagacaaagctgaggtaatttacttttgtagttcagcacttatttgatgagaaaattcctttgatagaagctgtttgtattcaagtcagatttggcaatgcgggtgatcccattgatatgtgcgcccaaaggctattgatcaacatctttgacagaacataattcacccaagctctgcaaatgtgtaaaaacaccaaaggatattttcaccatccagtgactaatgacaattgtagttttcagacttgtttgtgtggcaagctttgttgtgtgcatctagctagatatagctactacggttcttggtcatctttttgttatattaaatcaacaataaaaagtttgtctctttgagtttcttatcgtgtgttcaggaggaactattaaaagatgatgtcattcaaattctattactgcaaagcaacaatttagtttgttctctaatgttagtatttaggacaattatgggaaaattcagtagataatatttaatttctgccagtcaaaaagtaactggattgtgtatgtatatcatggaaaatttagttaaggttgccttttgtcgtcattttgcaggtgtacttccatgatataccagatgaggtcattgaaaacctggttggcctcgtttattccactctatgtaatatattaattgattatttgctaaatctaacatttataattgtagcaacagtgccagttagaatactatcatcataggatccaatctttaaaaaattgcaaatgtttttatgccactgacctgctctctctacccgtttgaatgtcaacagatcgatgagggggtagtatttagggtcgcaggtggcctgttgcttgaacatccattgacattaccatttgttgaagcagtggttagtgtctatctcaccttatttttcacaagtcttatatatacacggcattttaaactaatgcaaacttggtctccttttcatgtaggttggttctagtgacagtgtaatggggatctcgaaggatcttgcaaacaaattaatccaggatgcattgtagcctagcaatatttggtgctctgttcattcatcacatttattactgctcccaaagagatactacctatcggtgaaaatatgtcagggacatggtggtatactggtatctcatagtcatttttgtagctcaaaagcttttgaaggatttcagaacctgacacacgaagacgcatggcgttcaagaacacttcagttcctctgtctactgttttgatgagatttttatcattgtacttacacctttactgaatatatacactgtcattgtgaagcgttcagtcgataccttaatggaaaacgaggatgttgccaaagaattcgcaatttaaatgttaaatcgagaaagacttgtgtcatgtttgcaatgtgtgaattgaactgtttgcagtgaacattttgcaaccattaccttgatgcctgggtataaaatgggctgggttcgatttttattaatttttggcctaaaaatatttaagggctagagttgtgaaagaacccatgcatggcctaacccattaccacccctacctacaaaattacagtctgatcttattgtatacgatctgagtgtgacaatacaggaagtactctccagcttccaaaattctgcaaattccacgtgaaacagttcatttatatgggcccagcccaactttatatgggcccacatgtagattacactaccgttccagaccaacataatatgggcctgcacctcggtgacaatccctttacggcccaacgtaatttgggaccacatgtgggtgaaatcccgtctcggcccaacttggtttgggcccgcaaagaggtgaccatccggtttcgtctccgtttcgtcttcttcttcttcttcttcttcggtgacaatctccgtttcgtcttcttcttcttcttctccgccgtgacacgcacacggcgaagcggaggcagccgccgccggcgaccatctcgcgtcgctcctccggccatctcttcagctcctccactccccgaagctgccgcccgcgcgatccaccgaatgaggccggcggaggaggcggcgagggcggcggcgctggccggcccgctcggcgagctcctcccgccggtggacttctgctgcgcgtacggctccacgctcctccacgcccgccccgaagcgtcctccatggtcgactacatcctcggcgtccccgacccgctccagtggcactccgaggtagggtgggtgactgagccccccccccccctctcctgttctactcttccagattattccatccaattggtccccttcttggtttgatactctttgatgcgatcttggttcttggatggtttcttggttggttaattggtgcagaatttggagaggaaccctgatcactactccggatggatggctcgcctcggccccggcgctgtaagctcccatttcccaccccaaattcacactccttttacttggttaccccggttgattgctcctctgactgtgtgattgattggttgttgcttgtgccttgtggaagttcagattactcgacttgcggataacatcggcgttggggtgtacttcaatccatttgttgagtggagggacaaggttagcatttgcaatgaagcctcctgaattttgtagcctgatgctttgtgtgcattgtggtttacttgtcttcatgtatgtgcatttagttctgagtgacaaaattgtagctatgtggatgcagaggataaagtacggggtggtgaggatgaaggacctggccatggatgtcttgacctgggaccggttctacctcagtggccgactacagaaacctgtatgtatgccctcttgttgatatctgtgggaaggaagatgcgagcactgataatcttgttttgccactgtagtggttcctgatccagggtgtatcaccattcatgtttagttcaacccctgttttaattttagtgcatgtatatgcctggtagtgcagatttgacatcagagctagtatttgtcttttgtattcatgtaggttcatgttcttgttgataattgggatataaggaagattaacacaattaatctgaaaatggcaacatcagcttctctactccttttgccagcagaattcactgaggtttagtgtcactgtatcagcattgttgttacaaccatgatatggttctatgcttgttttcaccttccctttttattccttttgtgcagtatgacctgtacgcccaaatttgcagcctatcatatatgggtgatttaagaatgctcttcgccgaagacaaaaacaaggtaaattgataagatgtatactacgttgttattcttaaatattttcctgtaatttatttcagctcaattaacatcagaaataacattccttcctcacaatagtgacgctgtcaatatggatgtctgaaagccaactctactatacaccttgaaaaatgaaatggcgtgttattttttttttttaaaaaagaagtggaccacaaaaaaaatcaaatattacatgggacgcttcttataaaaaaagcatgggatgcatggtacacagtagttcgtgtaattcattctaagtgtgatgcatgtcattatctaaaaaaaagtgtgatttatgtgatatgtttagtatgtcatcctgcacatacatgcacctatggcatataaaaaaagatgtacaatttggctgtattgagcacattagtgagttactgctgtttgctgggttttgtgggaaggactgacaagcaaattgactgtgtttctgttggaagattatttatagtgtctattgctgttgttagtctgctgtatggttgaaagatcaatatatggttgttattcttcatgctgttttttttttcccatgacaatggaacttatgaattggtgccaattatactctgctgtgaatcaggtcaagaaaattgttgagggtagtttcccatcatttcaatcgatgtacagaaccctgatacaagagtacattgctgaaggactactgaagacatcatcttatggacaacagaaggctttccatcaggcctgtgtttccttttgctcatgcatacagtttgttgaaacagtgttaaatgtttagcctctcactgagatgctttcttgctatcacaaatgcatcattggtggcccaccaagatgtttaaacttttctcgtaatgtttatcatattggcgtgttctcgcaaatgtggtatatttatctcctttgaaacttataagatattttattggcactctatgaaagtctttttcttttggaacttcataaactaaaactgataagagttttatatttgcaggattgtggtgcatctgcaacaaacgaactgttctcttatctcccatggacaatccaaaggcgaacgcaaggaagatttgcatcgaattgcaaaggtactgtcgtcatttgcgtcgagattagtaccgtcgaatctgtaacacattctgataaattgtttaatttccagaaatgccaactggtgccgcagtttcttcaaaaaatgtagcagcaacctgtgtccgcaaggctttgaggcgccgggtaatggtctcaagtgcacgtcaagcggtgtctggactgcttgcctctggtggcactgttgctgctagatatctggggaagaagatatccaaagcctggaaatcaagaacagtttaagttgttgctgacacctgatgctttatatacacctttgttagttacggatttagggtaggttttgctct

SEQ ID NO: 63985 - DNA, 1840 bp, Oryza sativa
tatggagtccttgcctcctgactttctcaccatacttcgaacagagtaagcaatatttttgtcagtgcataagcatgttacactgctttcgtctttacccatttttgctgcttacacttgtgatatttacttcagtggactactgaggtcaattttaggtaatctaggtgcaccacgccatgtgcgacttcttacctatgcaaaatgcgctttgtacggccttgaagaacagcccaaatcacagtcaggtgtgtttcagttaacttcatttatcgaaaatagtttagaccttatatcttagcttcaatataagtctgattctgatatctccaatatcctgagctgttctattgcatttaggctcaatcaagcgtacattcttgcaagtcaaaataaacattagctatcttcgtctgaggatacttatcggtaatttacaatggtgccactttacagtcctttttatctatccagtttgtatacatactgatctgctaattgacgtgaaaattggttatactcacatgttgatcctgaaaaattcctttgtatccttttttttcagaattagcagggtttttaatgcaaattaatgatcttaggcataagatcatgagcagattcagacgtatcctccagaacactagctgagctttctcttctgatgttacagacctcttaactcttaagtaatgttcaagtcgaccgaacaggacaggaaagagcccatcgatacttaagcatttctagagtatagttttagcatcaatcaaactgtacaattaaaacttagaacctgggatcctgatgctgatgaattgtaatcacacctcaattatatgtaaacacaaaatttgggctccgactaatactgatttgctatgaatgaagtcttcggtttcatgacaaattttcggatgacaaacaagatggaagaaaattgtcatcatactgtgtatgccatgcatggtcatctgtgtcattaactcattatgctgagtgatcctacaaaacttgcggcttagcacaagatgctgacaatgaccaagctccaaccttgcttcaaagtcatcaactttactcaagtcaaataattttattagatacagaacacagtccgtgcaggctttttcagtcaaagaataaatgggtaaagtactatagaatatgaatacatgctcatcttttgctgttctttttcttcttatttcaaagaatccaataatatctgaatgactgaaatgattttccacatttttacagttttgacaagtacgcatcaggctttgttgggaaaaggtcataagcatgtacctttcgatagtcctcccagtgaatattacgggaaagtacttagcatatttgccaacaccaaactgttcacctaactccagaattttttgagaatccaacaatatcaacgctttccacagctgacaatagtccaatctgaacttttggtctaattctttataaattccatgatcaagcagcactgcaaaaatatggatcacttaaccaactaaaaattatttaaagctcactttataaaatagaatctaatgactggaatatattaagtgtctactctcttcaaaccatgtgcttctcaccataccgtacattctcagagccccattgctttgcacaaataagccaaagcaaaagccaaaatttaaattttcaaacttaattttgaagttgattttaagatattttaaacataatttctttttcagtattggcttttaagtcgctatgaacacatatataaaagttttacctacaaattaatttttgttccttaataagccattttagcttattaagaaatatgggg

SEQ ID NO: 63986 - DNA, 1110 bp, Oryza sativa
gttattctggcaatacatcctgtctaatgcctaccttggtaattttcacactgtttgtcaggtctgctgtaatgatcaggggccatacttttgctttgctcgcggaaacaacatatggctcatatatgacaacaacagaagacccatggtaattcccgatcaactttgcgtatttatgttttgactcacatttggtcgagcattactcgatatcattatttgtgtttgttttgtccttccagtatgctgaatcctgggaagcatcaatccagcagtacagtcaggccaacctctgtcctgaaatcatcttctttgagcgtgtcgaggatccagaattgggcacccaccgcgaccagactgcgccttgaaccattccattacttttaaggtttgatgtggctcagtggctgtagagattggttggttttgccattggaggcttgctgattgttgtggtgcttgtttgctggggcgttttgagtgggcaaactcctgtgcttttgagatcatcgtgcccacggcattcatgctcatgcatatatactggagtacttgacgttctctgcttggcgatggcgagatctggcatttctttgctggcctctggatcatgtagggtaggaaagtagtatcagtcgtttgtttgttcttccttgttgctcctgcaaatacctttattgctgtacatacaacaacgttctgtaacgcacaattctgggttcgtatatacggcgatagagcttgccttttctttgattacgagtactgatctagcaatggatatgcatttgcctgctctccactgcaattttgtatatctccggtactccctccgtctcataatataagagattttagatagatatgatatatactagtactacgaatctagataggcgtcacgtacctccaaaatccttagaattggatggaggcagtaccgcagtagtagtgattgttatacccacccaactatgctcatcagtagtagtgacgcagtttaggcccatccatttttaagcccgtacttcagcccatttttttcggccgaagcacgacgcggcccaaatacaaggcggaacattcaattttttacaaagcaccctcccc

SEQ ID NO: 63987 - DNA, 2824 bp, Oryza sativa
gtttccggaccgagaagggcaagggaatcgtggctcctattgagtcggtggcgcccaagtggccgccggagagcgccgacctcgaccatgctcgccatcgctggagccgcatgagcgaggaggagcggcaagccttcctcacggtgagttttcaagatatgaagtcgcatttcctttcaagatcaggaacgtcgcggtggcagacgagacgtgcgctctcaggtgctgaggagctcgtcaacgggtgtgggtcgttttcgttcggctttgccctttctgcttcgtcatctttgtggatgctacggagttcatgtcgcacatcgacagcttccacattgcgggttgcaagaaagaattgcggtcatcaatgcctgaaagagtaactggctgtgagatggagcttctcaaatcatggagatgggagccgatgccaagcgatggagatgatttggcagagagggcattgatcttgagcaagcttaagagcattgtttcttggctcattgataaggatgccgtttctctcagccttctgtacatcatgtacaagttcatcatgagccgggtcaggccagtaaaaccttctgtggatccatgtgcggctcctgcgggattggacagttgagttctgcgcccctcaaggaactgcttgatttgcttaagtggcttccacatacccatacagactataaacaagagaaccagaaggattcgcttggtttggctacatggatggaagagtcaggcaccttgttttttgattatcggaagaatgcttcaagaaaaactgatgattctagccagccagatgaattttttgactggctattctgcgaatctttgcttgaggatcgctgtgaatcatggcttggcatgcgggaaaaatgtgttaatcttggacctgccatctttaaaaagataactgaagaattggataaactgaagctgaaatgcagctcatgtgaagaactaaaacaaaaaggaggtgtatatttccttcctaaggccatccttgagagtgatattgacatcgagccttatttttatgatggggtatcgccttcctttttactgcattctgtttgctcttcagttttgtaaacagcatcttgaacttgttgatcaatgcttaaatcctacttgctgtatttgcagattggctctgtacagactgaaatgctattaattgatgctgaggtggattaccagaagaaaaggcttttggaagcctgtaaagtggattatcttgcagccattttacctattgcaaagtcttacctttgggtcagtacagttcttctatcaccaactgatgaactcctatgcactttttctgtaactttttcttcagtgtgctatttattgttgacaggccaaattgaataataacccccctgagaaggttttacctcttcctccaccaaatggtcttcaactacaagctcctttgaatgtgattctccgggtaacttgtgtttgcctcattcatttttctatatttagctattgcctattggtttagttttctctaatttctgctgactatctgcagtctttgtggcacataaggcgattccatgatactctccagaagattccacgtgaatgtcgtgatgttacagttggagactttcaaattgagaaggaattgcttgaaatctttgattcttgggatcttgtgaaagacggcaaaccatgtgaaccaagtggttcgacgagatttgcagattttacaagttctctgataaaaaaggtccgttccattcactatttgtttccaacctatttaattgcaatctgtgacctccagcaaaagatgacacatacttttgtaaccagagtgaaccatctccatgtctcaacagtagactcttagttatgtcagataagctgtagatatgtataaagtagataaggtcctactcactatccattgttctgactccatagtccccttgagcaacacttttagccattttgtgcacctcaatctgaagttctttggagcagattagattaaaatcctttttgtccggatagaatatggcaggttaaattctgcaaattattctgtgactaatttgatccttgaataacctttatactgtccttagactagaccaggttcagttctacttccatttctgcagataggctcatagctaatgagaaaatgttttttgttttttgcagagtggaaaaatgactgcatccaaaattgtgaaaagcctttttcagaggctgcactcgtcacatactcctttgcattttgagttcaggggtgaaacttcggaactgcaaacaccaaccgagccaagtttagtgggttgtatatgcctagtgcatgatctctttgggttacacctttatgaaaataaattcaactgtctgaatatggtgcacaccaaatttgcgtactctattgaattgggcgctggaggagaaactaaggtgcacacttcacagtgtattttttttccttccttttttttatatatttagttccattagttagtaaactaacatctcttcactttttcagttcaagtctttcagcgaactcttggtagctagagagtccaggaatggaagtgttgggcagaaggttgcccagtactctcttttatgtccaccacgtttgttcatgaccggtagggttgccttctcaactgaactgacatttcaatgtaaattgtttgaatatgtttcatctatttaggagaaaaagtaaggtcagtggatgaaatcatttgatcggtatggcatatgatgttttttttttctgaaaagtgaaaactaattcaatcgttgaatataaaatata

SEQ ID NO: 63988 - DNA, 884 bp, Oryza sativa
cccatctattgagcttagctcttatcctaatgataatatttacaattgcaaacttatttgatttctcttattttgctgttttctcacagtttttgattgggaggatatcaatgggagctacaataacatgcatgaagtattgatcagcttagcaacagagttggacattagtcatatctacagaggtctgcattcaggatgcatgtatactctggtttctgcggtatgtgctgggagaaatctctgttatctttgaaaatgtgaattcacttgtcctgatattgacatgtgttttcctcttcttctaagttttagtgtgctctcaactgaggctgtcggctgtccattacttctactaggggacatagggaggaagtaaatgtagttagccatttgattgtattagttagcttgaagctgttcaactgtcacaataattgtacgtgtgaatcctttgtggctgctctggtatcaaatgttaaagactagttactcttccctgagatacacatacgagcatttctattttggatgctactcattagctattacagatcctaagtattctgctcccggagtgattttaagatatgttgtaatttgtgccggaaatatatattgtcatttatgttatacttgtcagatcagttaacttgaaatatttctgtgctatcatattgagaaagttacgcttattggaacatcactgtaaatttttattttcctttttgtgggctgcttagttgctagccgatagatgttacattggttctttattgtcagattatcacaagtaataatacttgtcttaccagtgtgaagttttacttctattgttctctcaattgcatctgtgtgctactccagtcagaactatttgacgc

SEQ ID NO: 63989 - DNA, 9283 bp, Oryza sativa
attcctgcagccccattggagaactttccaccgcccgtttatctatctattattatattattaaaagaatagaaaaaggagtctccacgttcgttctcatggcctagaaattctcacattaatcggagaaaaagaaaaagcagagtccatatagaaatacaatttagaaatagttgaaattcggaattaaaaaaataaggaatattagaagaggagactagagtccatatagaaatacaatttaaaaatagttgaaattcggaattaaaaaataaggaatattagaagaggagactagagtccatatagatatacaattagaaaataactgaaattaggaattaaaaataaggaatattagaagtagagtatatattccatatagaaatacaattaagaaaaaaaatagaaattcgaaattaaaaataaggaatattagaagtagagtatagagtccatataaaaatacaattaagaaaaaaaatagaaattcggaattaaaaaaggaatattagaagtagagtatagagtccatataggaatttaaaactaattaaaattcggaataaacataataaaattaaaagtaatgtttagagtccatataaaaatacaatttacaaataactaaaattcgaaattaataaaaacatgtgaagaagattttaaaatcaatataggaatataatttagaagtaactgaaatttgaaattaaaaattaaagaatattgaaagatgagtttagagtccacatagtaatacaattagaaataataaaaattcagaattaaaaaaaaagaaatattaaaagacaagtatagagtccatataggaatatatataatttacaaataatattaaaaataattaataactaacacatatataaaatacaatatgaatattacactttagtagtttcgtaaagttattgcaaaatttaaaattatattgtcattttaatatatttgaataatataatgagaaaacatatatgctattatatgagagaaaatataatgatgctggccgcgttatttgcgcgggccaccatgctagtttttttaaatatgcccgtcctacagtattttgaaagcaacgtcatctcctgtttcagacgagaaggtaacgatgggcatatttttgcaaaactttgaaataatagtttatttttgtaaatctttaagaaaaataaatatgaaaaatcctgtataatggtatgcgcaacgctaaaaacaacgcgttggattttaatcatgtctaaaatgctcaagcaaagcccagaattagcatactttgcttcgcagctaaaatattgacaattttaacaccggagggagtatgatgcaggtatggtagcatgctcatgcgatacaaacgggttcccgggccggggatgtgaggataatttttttattttttgaactttttaatttttatttttaaaataaatacttttgaaacttattttcaaaacctgaacttattggccatgccaggcatggcaaaacaatactgtcacatcggtttggctggtatgacaacgttatttggtcacacacaccccttgctgacgtcacagaataaaattgttacactcgttatgtgtggctcgtcagtattgtttttgctacgaatacgagctggtgtgagaaaaagttcatattatgaaaataagttttggagggtctattttaaaattaaaaaaataaaaaataaaataaaattaaggcgaggatgcgtgtgacaacaaatcaagtacaaagattccccacctttgcttgggcgtcgatctgtccgcacgcttggtccaaccctgctggaaacgtgggcaataattatctgtactgatgaaggtgagatgggtaaaggtttgtccatttttcaaactcataccatcaaacaaaaccaaatttattttaaactgaactacaaaatgatggccaatataatataatggttttacagtgtaaataattttattttaaattttaagatttaaagcgtaatatgggctgcgggagaactatataacaaaataatatatatcagttgtaaaatttattttcttgcttactattcaattttcttttatgtgttttctgtatcttgtaccttaatcaattattcataagttataaatgattgagatgcatggtgtggttttttggagaaaatgtgaatttacattctcaatgaatcatccaaaaccaaaagctaaaaaggtgacgttgtttagctagagaagagagaattagcattaactatatttagtgaggatggactttgtagatatatatgatttggattcttgttatataatacacatgggcattaaatgtaggaaaagaaaaggaaaacagaaaacagccaagatatggcgtactggaatggatcagatacagataagctaagctagcctcggaaaattgcttagaatattcgtcgacaaataatacttgaatcaaatcattgcgttttcttacgcacgccatactcctgtagatatcgacaggtatgctattcctttgacaggactctatgtactcaatttaatttcaagagtgaagtatttatggtgtgttcagttcacgttaaaattggaagtttggttgaaattggaagtttggttgaaattgaaacgatgtgacggaaatgttggaagtttatgtgtagaaaagtttcgatgtgatgaaaaagttggaagtttgaagaaaaagtttggaactaaactcggccttatgaaagttgtgggacgatggaaacttcgcttcacctttccagtttattttcttatcccattttattttttttatgaagctaaaatcgttttgttagttctatgtttaaaagaagctaaagctctactaccaatctaccaaagagacctcgtatctcgatctcgatcggaacgtgactcagctgacgcacgcaccgaatggggtcatgactgacgagtgttggagccaaacggcatgccagactggcaaaaggcacaagggatatcatatacagtgggcgtcacgctgtatggataattcattttatcgttttatgaccagtagcacgtactccctccgtcccaaacaaaaaaaaataaaagacaaatcctaagttttcgtgtccaacattttgaccgtccatcttatttaaaaaaattataaaaaaaaattaaaaagacaagtcacgcataaagtattaatcatgttttatcatctaacagcaatgaaaatactaattataaaaaaatttcatataaaacggacattcaaacgttggatatggaaatccagtgtttgtcttttttttttttttgatggagagagtatacgcatgtatgtgtgttcatgccaattaaagtgggccgggagaaaagcgcaaatctagggcaaaaattccatcgtacgaaaattcaagttcaaccaggcttggacaccaggttttggggttgccttaatgcaggttatcaaatgttagagctgaaggtatagtactcaacattatgtactgcaggtaaaaaatgggtgttttttcaatcttattaaaatgggtgttttttaatcttattaaatattatattttaagtaagtggattaggatttaggtcctctaatattttgggccttgtggtgattggcaacacggcactatcttaagggtaagtttacagtttatagaaaagcatggatgcctaagaacggaagcatgcctggggtaactaatgcttgaccggttgacattaggcctgtctctaaaatcttgtttaaattttgttaaatcatcgtgtaaattttgtagaaaaccaaaactttgttagttaagcctatgttgatcttaaccctagtcttttgtaatttctaactccgtcactaccgatgccaacgaaaaaataagttggttagagaattgagagacacaaacatatatgattggatataattgacgataatcacttttcccaaggaaacaacaaaactagtagcgatgtgtgaaaaccacggtgtcaatgttgcaatgggaaagagccatcatggttagacaaggtgcatatcaggactacctacggtctactagacgctcaagccagtagattccgtaagagggttgattggggataagccactgtggagtctatggtcacaccaaaaggctactcctcatataagtccgttgagcatattcttcttcttcgaggtaaacttgaggaggtggacaaggagttcaagcaccttagaaaatctcttattttacacatatattgatgtgaaattattccctctcaattttcttcaattccattcaaaccgaacaagtcccgaaggaggaattagacgaataagatttcaatcaatcatgagaaaactcatccccgttgacatagcaatagcaccaaaacccaagtttcaccgtcgaacacctcgggggtttaggttgaaaccacacaccgcttgccattacaccatcaagtacatcacagagctagctagctgctcgcaatctcactatctcagtacccggtggctggtttggcgaccatccatgtgtggaggatcttgccggcgacgtcgtagaaggcgaggctagcctccgccgccgtcagccgcagcgacatgaatccctgcccgtcgtagaagaactccaccttgtccgtgttcgccgtctgcaccccgcgccacgccttcgacccggcccgctcgtcaggtactgaatcttgctgcaatttatttataagttttttttgttcaattcagagtttcagactaggcataaattcagacgaattttatcgagtttgcagagaaattccggcaaattctttacctgtccctgctgctgatgtgctcgaggcagtggtcgtggccgttgaggtagagatcaactccatgtgcctgcaatttttttcatacaaatttacaccatggtgaaaagaagttcagaatatatatttcagatcaccaactcgagtcaagaaatgttggaagcatcggaggtgtggtggtagagtcatgcgtgtatgactccacccataggatggatttaaattccggggttcacaactactgcgtatacgtaggtggcctttcaatagaaatttagtgagatcagagatatatcactagttttcatttattagagtatgtgttagggatgcattcacggaatgtgagcctatataggggtgtgcgcgtatacgtctgccgcgtaatcgaaaaaagaaaaagaaatgcatatactactttgaggattggaaggagatgctccaggagctccttggtatcgccgtgctggctgacgctcctgatggcgtggtgtccgaccacgatcttccacggcgctttggactgctccagtgcatcctccagatcctgaaaacaaaaaaggaattaaattaacacacaagttatgaaaaaaatgagcaaataattcatcaggaactgcaggatcagagcttaatttgttgggattaaatgattaattaatttaccttgaggacatttgcaatgtaggtttcacggggagaaacccctctccagtcgtacttgctgttcttgggatcagtccagtacttgagcacgaacggcgtcgtgtccacgaagaagaaatccgcgatctctgatcagttttaaattttttttcattcaaaaccaaaaccaaaccaacacaaaaatgtgaacgaaatacatataaacacatatccaattcttgatctcaaatggtgccagctaatttaacggatcagagtaaaagatgctaaagattgaatcaagacaaagactctgtcagactgtcagtgtcgtttactcacctgcgctaacgacgaaggacttgatgcagatccagcggctgtcgaccttgcgaagaacagggctcagctgggcgagggcgtcgcccctgtagtcatggttgccaagaactgcatgtttgttatcaatatcgaaattatcaattatcaccatacacaaatagaaaatcaataatctatttctctttcttcagagtaattcagatcagtgcatgaaatttgatggtggcattcagataatcagatcgcattgcatttgatagtgtagtggctgggaaagtgcggtttcaactttgaagttctgtgtttaatttctatcacgctcactatttctttttaaaaaatatttagagagacgtctctgtctccaaattttttttatcgcattgcattttggtgtggtagtagcattcagataagcagattgcattgcgttggattattacttaccggtgtaccatggcttgtggaggctcttggcggtgtagatgtcggagaaggattcttcgaaggccttatcatcgacgccggtgaggccgttcttgtagaagttgtcgccggtggagatgacgaagtcgatgtccatcttctcccctactattcccatctgcatgcacacattttgttgctcatttaattttgttcacttatgtgttgtgcattgggatgcaaaggattggtctcaattcgtcacatactcatatttatttagggcatgttcactttgatgccaaaaaaaaaccttatcaattttggcatagttatcaaaattttggcaacttaccaaaattttcgtatgatttcgggcctgttcactttgatgccaaaaaaaaaccttaccaaattttggcattaccatttcttatatagttaccaaaaatttggcagcaaactaaatgtagccactttctttttgacaactttaccaaaatttggtaagtttgaaaatggcatcaaagtgaacaggcccttcttatatagttaccaaaatttggtagcaaactaaatctagctcttttttggcaactttaccaaaatttggtaagattgaaaatggcatcaaagtgaatatgcccttattatgttgaaaaacgaaaggaggttgttataaactcttcaaagtcaaaattaaattatgttgactgcacacatcctaaagcgtcattcctttttaaaatatactattatcaactgagctagatagatgtgaaaaatccacacacttgcatctagttctatccagggttcccaaaccgtcgtaggtacggttaccgcgcggtaaccgcaataaccatgaaaaaccgtacgaaaccgtgcaaaatttatcaaaaattcaaattattttttaaatttatttgaatctaaggaggttaccacggtatttctattaccgtacctccgcggtaaggccggtaaccgcggtaaccgcgcggttaccaacggtttgggaaacctggttctatcaccactagaataacaattttgtttttttcaaataacaaaaatgttagatatcaaggaggaaattagtatcaattgagtaaagaagataaaaggtgaaaaggcgccctagccagctatgcggctgagttcgggtgtgaggattaacaaccttcactcctagcacctaaaacggaacagttaattagtgtgtaattaattaagtgttaactatttttttaaaaaaacaatatgatttaaagcaactttcctatacaacgtttagccgtttgaaaagcgtgcctgcggaggaaaggtggcgccgaatacagccgtacgtgtagtttaaagtaacttttcgcacattttcttctttaatataatataataccaacaaatttgctctgatttttaatcagtatcttttgatacgcacgtgatagatagtgagtagatactacactctgttttcttccttaaaaaaacaagagagcactaaacatgagcttaatttacaattccacatagcctccaaaaccaacctcctcgttttcttgatttcttctaccttaacccacattgcattacagtatttcataattaggccattaataattaactagccacatttagcaaaacgaaatcatcaccgccaactaatcaatcaaaatcaatcgattacctgcgcggcgaccatcgactggttgtacgcgccgcggcgcccccagtcgccgacggcgaggaggctcagcgacccgtcgcccttgcgcgggtgctccatccgcggcatctccgccgccgcagttgccgcagcgacggcgacgaggaagacgaggagtgtaataactggagcatccatggccgatcgagcagctcgatcgccggccgccggcggcgctccttcacttgctcgtcgcgtggagaggagaggaggctatggctggctcgaggtggaagaagagggtgcgtgcgtgtatttatagggggagaatggcaatggtggtaaatattaggagaaaaaaaaagaggagtggcaatggaggtaaatataattaggaaaacggcacggggacaatgtgcggctgcaggtgggcccggatggggggaatggtgggtggggcccacggtatgagacttggaggttttgctagattgccaggtcacgctttgcctttttgcgcgggaaaataagtacggcacgcatgcttggaacgcatgaattgaacatgttaattttgtctacaatcatgcaacatggaagtgaaagttgtagaaatgagtgaaacaatccattaattaagaagtcatttgaaacatgtaggtggaagtaattcatgatcatcgcaatggctagaaattactttcattatctaaaaccgtaataaaatgattgttaaattctgttattagccgttattgtttgaatccatatgtttgtaataaaaaagtacacctataacgttctatgactagcaagtcgctctacctttgacaagatcggtcaatagttgagtgcagccgcagaaaccacctatgccccaatgatctatgatgctatttcaacaatgtggtcatctatatgactatataatgtagaaacggttggaaataataaaaaaacaaaactacctagattgtagagccagccaaaatatggtgctcgaagctgcttctcatactagagagtctcagcatacaatatttgatgatcaacccctcttttcatgtttggctcacagttgtttcttctcccattcccattttgaacttgtaaggttgcagctcgcaatttctctcagctgtttattttgttcccattgggttcacccctttcggctttcctacctatactttccaaccttcatttaattgattgactagctgacacttgcctccttttcaataaaaagattggaaattcaatctgggtagttagggattaagattcaacactaacggcaaagtagaaatttttcacacaaattaagaaaatgaagtgtatgttttgcaagtaaatttgtatgttgcatctaagctga

SEQ ID NO: 63990 - DNA, 4078 bp, Oryza sativa
attcctgcaccccacaaatctatagcctaattaatccatgattagcctatgtaatgctacagtaaacatgtgctaattatggattaatttggcttaaaaaattatctcgcagattaactcttatttatgcaattagttttgtaagtagtttatatttaatactccaaattagtgttctaacatccgatgtgacatagactaaagtttagtccctaaatccaaacaccctctttagtaaagtaagggagtgacactccctctatttcgttctatctgtccctgaccatgtggcaaaaatacatgtgtggcttggctttatcagtttcgcatcagcacaatccaatagataactaaaaccccatgtcatgggctatttttgagttatactggatggcatccgcgctttgcggtagaatatatgaatgagtatatgttaaatattgtacaaatgatggatggatttggattgaaatatttttaaaatgatttgagaatgatgatttataatgtatatgccgagttttagaatgtaatagttactatgtttgcatgttgagttttaagtgtttagtaagttgatctggcatacttgcatgttaggctttagaaataataataaatacaatttttacatgttaaattttaggtgttcagtgggttataactaattaataatatatttctggctgacaactcaaatgcaggagcaaattaagccattttgttagcatcatgtccaataaaaaaactaatgggctttgaaatggcccatccaacaatgttttttaacacacacacacaattagtccatttagccagcaatactctttagagctcagtggttgcattgagccctaacaggctgacagtggtagacgactgatcatgtgaattcaaagattgattattcattttctatcgtgaacgtatctgtagttgttgggggtcctaatttgtggttatttttgtacaaaatttagattaggtgtgggtgcaatgcctgtgaccatgtgctcataattttgattttcttttttcaaaaataaaaacatagagtttgcagcaattatatgtcggttccttcatatatgaaatccgcatttgctgaatttctcaagaaggagagttagattttgttttttgagggaagagttagataattttaaaaaagattaattagctcctcaccaaaaaaaaggggatcaagtagcagtttggattaccagatgaaacgacattattcatttctgaactacttgaaacaaaagcatttgtacatattttttcgacataatggataaaaatcagatctcatataagcattagcatatacgcacactgaatatcatttagatagccattataacttatcccatgaacttaggatgcaattacaaacagcaacattcttgcatacttacgtatacaaacacacacactatttatacaccgtgcatcttttgtcacagtatatatatcgataactgaagcagtacattgactgttccaatttcacacacataagcagctaattaacacaataattaagtgttgactttgatcactagttggtggaggttgacttggcgagctgccagctgtacaggacggcgccggtgacgtcatagaaggcgaagctggcctccgccatcgtcagctgcatcgacaggaacccttgcccgtcgtagatgaactccagcttgtccgaggtttgcttaaacttccccgcccacgccctcgacccgcccccgctcgtgatgaattcaagtgggctataatttttatttcatcgaattcgataagaaaaagaatttaaacttaacaccaatggtagctagaatggtaaccaatgtaatagtggtatgtgctaaaggacaaattttacatttctcgaatactaaattttgcactacaaaatatatgtgacacctattgatgcctatcaaattttacatgataaaaaaatgatatttgcatacaaaatataatgcccagtacctttcaagatcgtaaaacttttttggtgctaaagttataattacctgtcaatgctggtgatgcgctgcaaacaatgatcatggccgttgatgtacatgtcagccccataggtctgaagttttcgaaagaaaaaaaaaggagtgtttcggtcagggtttggatttaatttgtgtggattttgccagagaatttgaactcagctcatacgtgaacttaaactgatcgatgattcaatgtatagggtgtaccttgaggacagggaggagcatggcgacgaggtcggtggtgttgccgtgctcgcagccgctgctgatggtgtggtgtccaaccacgatcttccacgtcgcattcgactgcgacatcgcgtctcctaaatcctgcatccgtgcaagcaaccgcgattaaataacagctctagttcgtgtacatatgaactatatagcccgccagtaagaatgctttcgtttgtaaaaatcatttttctagtagtgtatagtttctgtttaagcaaaggcctagtttacccaataacttactgtgagtagagtggagaggtaggtgtcacgaggggcgacctgtctccagtcgaacttgctctcgttccaatacttctgcacgaatggcaccgtgtccaccaagaagaactccgcgatatctttaatttcatatattttaaaaaatgagcaattgttacacatatttctttttcttcttcagacgtatcgtcctatggaaagcttttggatgaattggttggtatgatacgacgatgtgtcatatgcaagtacatacctgagtcgacgatgaaggacttgttaatggaggtccaacggctatcgacggcgcgaatggcggggctctgctgtgcgagggcatctccagtgtagtcatggttgccgagaactatacacatgcaattgcgcatataaatatatgtgggtatgagagatgaggaattttacggtacttgagaaaacatttggatttttttaaaaaaaatattttgatacatcgagttacctgatatcaaattttatattagaaaaatatggtacctcctattttttttttttaaggatagtaaaattaactacagaagaccaatctagatcaagacacataaccgatgagatcttgtttatcattgacatctcaatatgtatgtatatggtggacataatattattgttgcaattattattaccaatgtaccaaggcttctggaggctatcagcggtgtagatgttggtgaaggactcctggaagctggccgtgtcgttgtcgccggtgaggccatcgttgtagaaattgtcgccggtggagaggatgaagtcggcagccaactcctccccgatcacgcccatctgcatttacaattcaagtacacacattgtggccagtctttgataggcatgcatgagctggatggcaacttaattgtcatgcatattactaatcaattttgattttgatttggagggaaatgataagctagttattatatccacattagctaattaatttagctataggttcaagttgactggatttttcacattttggtccttttgaaaaacttatttcgcaaatagacccctgaaaaaacatgtcccagaaatagtcctttttggggcgccagagtgggacggcgccagcctctctggcgccgtcctcctgccaccgtggcgcacgcgaaccgacgtggcaggaggaggctagcgccgccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagt

SEQ ID NO: 63991 - DNA, 6083 bp, Oryza sativa
ctccccctagccacctcagcatcgccccgccacgtgggcagggggacggcgccaaagaggctggcgccgtcctgttgaacgacggcgccagccactctggcgccccaaaaaggactatttttaggataagtttttttaggagtctatttacgaaataagttttttaaaaggaccaaaatgtgaaaaatccagttcaagttgacacatgcagggagctagctagtagtagctctcttggggagacccacccaatcaatttaagtttgtggccaacaataatttgaatattgtccatctcaattaatttgaactcgtttgtttgcttcagaaatagcactatataatagtgacatgccttacctaacaaatactttcggctacttatgtaaatgaagaccccatgcatgataagcttcagggcaccaaacatgcatgcattcacattaataataactaaaatttgttagctagttcattattggtgctcattaataggggcctccaaaggcattgagagaagtctttgaggtcaaccgtagtatggtagagtcgatatcgttcacagactaattaatgttgtacttctccatttgtccataaataattgatgggtgccaagatccaatttaacttgcaaaatttgaccatatatagcctatataatatagttagtttcaaaaagtaatgacttcagatatatcttaaaaagtactttgtaatctcctaaacttattgtattttataaatttattctaatataaattgtgcacacgtccaaaagttgaaaaagaaagttttaccagatgaagtactccatccgttgctctattaggatatcatttatgtaataaaaaacataatcataagtaacttaaatacgaatatcataaatttagttagttttttgtcaaaagaaattatatatcctactagtttgttggtcaaaggtttgtcctaccgaaacaaacaaataaacaatatacactttatattttgaaacggatggagtattaatttgtagacaataatcaccgatgacttcatattttcccacgaaaacaaatatatggaaggttgatgtcagttattgtcacctattctactccacacagttgagccttctcctggccccaatataccatgctgccaaagttgaagctatttcatggctcgtgctctataaacagacctggcagctgggtacgtaaaatattaatttgagatagagacatagagttgcctctagtagatctataatcaaaacaattaatgtctacagtaatagcggtcagcgtacgtagtgttagctctttggcttgtgcaagtgttgtcgatctgtagtggttttattttcttttcctgattatagctttccagggctgttgtcttgtaattttttttaatataaaccactgcactttcaaaaaatataatcaaaacaataactacaacggccagctattacactatatggcagccaacaaaatcagtacgagctacactagtactctatgttcttttgttttttttaaaaaaaaagaatattgtgcttgaatataaagaatattgtctctacatataaaggaataatcataggcaggccgttatacagttattctgcaaaattgccttgcggtcagcttaatcatgcatccacctacaataatatggtttcacgaataaattttctacaataatatcatttcacgaacaaattttctacagattgactgtatatagagaaagccattattaaataaacctacggataagttggttgcttgagaaaatcacttttgtccgcctacaaaaatgtaatatgcatattctaattatgtggtcttaagcaccaaaatataagcacttctaaaatactatttatcttatcaaccattccccatttaatatttttcccatatataaccctaaccactctcccatcccaatcatatctagggccatgcattataatcttttctactcaaccttattctttgttaaaactgtaaaataaacatattttgcaatggagctagggagtatatatgcatgtatatatattagctagccctaattaaaaattactcaaagaaatggggaaaaaaaagagtgcagcggtttgaaagcgtggtcgatccacgatcagttggtctcacatcacaaataagcaatgtacataccggttatacctactagtcctctactacctgtattgtagctctacaagagcaataattgatcgacaacataatacattcgtgagcgatggattgatcgaccgatcaagcattgccgccaccggaaaaaaactatagaggcggcgcctaaatttacttcgttgtcagctacacacacgagctcgtaaattcatttataagttaaataaatagataagtcgggtctcagacatgcaatgtaatgtatatacctgggtggcaaccaacgtctggttgtactgccccttcctcccccagtcgccaacgacgagcaccgccagcgacccgtcctccttcgtcgggtgctccacccgagctagctcccccgccaccggcgacgccaccatcacaccaaccatgacgaccaccgcaaccaccgccgccgccgaccaaccacacctcatcatcattctcctcctcaccaccactacacagctccggcgagatgatcgtgagagatagatgatcgatggagaattggagatggcgatcgacttcgaattttgagagaacgaactcgcgggaaagcctactttatagcgacggtcagctggtgccgatgtgaggctgcaggtgggccccacaccagcgtcggttggattcaaagttgcatatataattatgcctatatccatcgtacggctgtggtacgagccacggatcacccaacggcgcggatggacggatgggatcatcgaagctagcttagctcgtacaggatgagtaattaagagaggaagactgcacgccttgtgtttcgtccgatcgagtacgaagttgttaactctctttgaaacaacgtgcgccattaatttattactgttagtggtttttgtaattgtttcgtaaagccatatatatgtgtgtgtgtgtgtgttgcattaattaatttgtgctggtacatacttgtctacgtgtacatgtgtactatgttttgaattaataataattgattagtttgagaaggctctagatgcattggataaggttaaagttagttgattagggttgcatcaagtgattaattttgggctttcatggccggagagggtacgcttactaggctagggcccagggagaaaatgggccacgctgcgcctaccggcttgattaattattagttagtggttaattaattaatgcatcgtaaaggagcacttaacctctaataaatagttttcgacttttttttatctcactttacacaccacatgagaactgctgaatacggctattactactagtatttaacttgctgggagtatatttttttcttatttactatattcaagtaattaaattcaacgcaatacaggaattcagctgatacatacgattaaggccctgctcttttctgattaaaatttgttagcatgcttttctgctaacggtgtgttttgtatgaaaattttctatatacaagttgttttaaaatatcaaatatatccattcactactggagaagtggtttttagtcccggtttgcaacttcctttactcccgggttgcaaactagaaccctgaatccgggactaaagatgggcatcatctttagtcccggttgaaataaccggactaatacgggactaaaaataaaagtgccacgtggttggcgcttttttttttgctacttgcatatttatttcacaccaaactcaacaacaaaatcatccacaaattgacatcacagattcatccgcaacttcatagagacatctaaaaatcatccacaaatttacatcacaaaatcatctacaaattcaaaaaaacatctaaaaatcacccacaaatttacatcacaaaatcatccccaaaatcatcacaaagtaatcgcctctctgcaaatgcccgccgctcgctcgaggataagggagaaaaagaaaaggataaggaggaaagagagagtggagagaggaggaaagggagaaggaattgtttgcgcgcgaggatgagaggataagggtgagggattatatactcgcgttgaattttaccgggactaaaagatagagagggacaggacgatttctgaatcgggaataaaaattatctttagtccggttggtaacaccaaccgggaccaaagatcataaaagtgaggtgggcttgtcaaccaggacaaaaaatgatttttaatcccgattactattggaaccgggactattgtggttttagaccgacctagcaaagatcagttctccagtggtgattaatttgttatgtttgtgataattaaaacttaattaatcatatactaatgactttctttttttacatgcgccgacttaatctttatcggttttaaacaccacctaagagcaagaagttaaaaattaaaatattgaatatatcgatacagtaacttggctcgatcggtagtcgatgtgtttgcatggtgtggttcagatgacagtaatgtcagaaattttgctatgtcagccatccatctaggcgaggatgccacatcagttatatggaacacccctgtgtaaaaccctcctttttttttattttagataatggaatataatatcccggcctttgctcaagaagagctacagccaattattacaaaatagcactcgagataatagtatagttcaaataaaatagaacacacttaaataggaaaagccaaaataagaagaacacatttattccagcctatctgtgaatctccattcatagttggcataaagttgcataaccattgcaaaaccctcctagaaggggttgacggagcttggggctcctcaccgggagaccgcgcaggcccccctttgccggttcggccgggggcgctaagtgaggttcttcgccctcgatctgtggaatattcgcgagagagcaaatgcacgagacacgggcgatgtagacaggttcgggccgctgagaagcgtaataccctactcctgtgttctggtggatctgtgtgtgaaggagttacagagagctggagagcaagggagttcaggctctaaaacccctcttcctgtttctctcctctacgagctaaggtcttctcagagtcgtccctcctattcttcttctggatctcccaaaaaaaaccccttttttcagtgggcaaggtcctccttttatatctcaaggggataccacatgcaccacttctacctacccttcttttgggtggggactcaccctatcttgaccagaacttggctcgcgccttcgcttgaaagctaaatcacagcttgtccttgagtgaggcccagcgccgtcactcacctgacccaggggatcaccctgtcattccttcattaatgggcggagatttgcaatggccgctgtccgaatgacccctccgatgggatgggtcatacctacctccactttgccggaaacggatgcaacgtgggagcacggtttgtttgccgatgacgtgaccggcgtcagaccagtcacagaccggtcattcttgtccaccacgtgtcagtttagcatgccgcacgtctgtccctcttcatacaatgacttccttgcaatggttgcgatgaagcctggaatgtatctggccgggactggcgtgctaactccaggagttagcacgccggctccggctagggacaagtgcctggaggctctcatcattccgatgggacggggcgaggcgtgtgacaggccgcctgctgccacctaacccacgatctgaccggtctgtgaccggtcacatactgcgaccggttacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggggcgccccagccatcggggcc

SEQ ID NO: 63992 - DNA, 11548 bp, Oryza sativa
  unsure (1)..(11548): unsure at all n locations
gggggggggggggtggccacgtcaccctcgggcccgacccccccccgagggggtcaggccacgtgggtgagcgcggctgcccaagcctctagtcacgatactcccggtcccatgtcaccgacaggggtagtgtaaattatatggaacactggatgacaaacccactctttgtgcacattttttcttcaccgattcagacacatatataggcaaaccgagatcgcattcgattgttcaactttacattggatttttttgaacaacacgtataggatagtgtaaattggcatacatcatgggatagtgcaagcacactggatgatttgtcaaaagaacaagctgtagggagttgatcggaatacatcatgggatagtgcaattggcatcaggactacctctccaatcatgtgttgatgctgatgtgcacccttgcccgggtggatgggtgtcgtggcacaaatatcttacatgacaactttagcggtcaaacttacaccttgtcaagttgttgtaccggtatcggcatggtaaatggtcaagtttttacattcaataaaactcaccgatttattatattacaaacgcaaattactctaatcaatattgggagttgagatacaaggtacatgagtggtattgtagataagctatgttttcaatcctggacatccttcctcttagcttgccgacgactggcagccactagagacagagaggaaaggaagtcaagcggatgaaagaaaatgacacttttttttctctactcactgacagatagagaagacaaagcacttccttttttttccttcttatagagtacatgttttcttcttagttcttaaggtgtgggtgacttaagctttgagagatggtttaatgctggtccaaagattgggaattaatagggtaatatttcagtcagattgtttgcaggttgtcgataccatgttgaatggaggttatgcggcaacagcctcaacagctatttacgaagaatgtaatctaatatggagaggttttgatagcacatctattgaacattgtaatagagaagcaaacaaagttgctcatgcattagccatggtagcttttagtaggaaagagtcgtgtatttgggtcgatgaacctcctggctatattctaagtactttggcaaacgatgtaactatgttcaatgatcaataaagctagccaaatggcactaaaataaaaggtgtgggtgacttattatttttctcactggccagatgttctcaaaaatgtctcggttaacgatgtgcggtgcaaagtgagcggtttggaaaaatgaggaatcaatagtatcttaattgaaagtttaagtagaaacaattttaaacttcaacaaaaaaaattaaggatttgcaataagtttcacctgaaaaaagttaaggattttcaataagctatatgtttggaatcatcatatctctcaaacatttatttttcataatagaattcaatccagaccactctgcatcaaagatacatcaatccagccacatattattgatcggcatagcagagaaatagtataatataacaaaccctcatcacaaaacaaccagtacatgtgcagctattggtgatttaatataaaggaatttaaattaaaatttacacgcagttgctcccccaacgtacaccaaaataattaactcttgtcatcagctagctttttttagataatgaaatataatcccagcctttgctgtcataagctagctagctaaccatcatgcaccaatatataatctcgatcgatcacctgacgagcgagtagatggagagcattatgatgagcgccatggcggcggcggcgagcagcatgagcccggcggcggcgtaggccatgttgaagaacctgaccacttcccccggcagcttcgagccaccaaatgcgctcttcgcgtcgtaggtgaggccaaacccggcccccgcccccgtcgccaccagcaacgcgaatatctggcacatagtgaaaattccactagctattgatcaagctcctcagagggtggagcggagctaaggagttgtcgctccaccctcgtatagtgtaatttttcaagatctcgaaagtgtttgatatagttgtaagtgtcaggttttgatcggaccgtcatattgatgtgttattctgtagcggtgagccgtaccaaacgggtatgctgttctagttggtcttgaaattcgaaatgtaattagagctagatgaatgagttaccacatcggcgaagatgaggaacaatgccacattctcgctgcctcctatcatcctcttcctcttggcgatgctgacggcgacgaacgggatctgtagcagggtgtaggcacacccaatgacagcgattgcgaggacatacctatacgatagaacacaaattaattgaaaagttcttttattttgccttttttaccaatacatagaatcgtggcagttctagcatcaccgaaatatatagctagttagaccctttgaaaaagaaaaaaaaaaagctagttgccccacttgtcatgcataattgcgtatgtaggtcacgctcctttctaatgaagggataaatagattaagcatgcttattgaattgaattcctaaacagtacgacttttacaagtactctatatatgaatctcttatgatattgtttcatatttattttcgaaccttataattttgtgtgtaccatcaaataagtatctcaaattattcagctattcaaatcattccgccatttaatggggattttatcagattttcagtgttactccactatagtgatgctgctgcttgtgatggcaggcagcgccagccagctcgatgtctcatatatatgaatatgattcctatcactaggtgctgacctgtaggcgtagacgtccttgaaggtgatcttcttcggcgggaggccaccgccgaagtcgagggtgagcttgtcggcggcgatgacggcgagcgacgccgcgaggagtgccagcgtcaggaggcggagggccagcacggcggacggcagagctgtcctggaagacgacgccattgctgctgctgttgcctcctctgcccgaggaaccggtttttacatgcgtgaccacttattttccgcctgcaatttaacggcggctttaatatggaatgaaaaacggttttcctaatagtggttatctggctagccagctatagaaattggttgttgttcatcgttgagatcgctaagaggttttatatacaagcagctagagcatcggtatctcgcatcggcctgcagggaatttggtggtggctccatccaattgttcattgttcagaacttcagatcgatcgccggccggccgatcgttgttggagctggaacatggcgacgacacattttggctgtagtcttgagatggttggttgttaattatgttgacagttttgatttggtctcgtctgtcttgtccgatatggcgatctattcaaatcgacaagacgtagagcagctgtaccaaaggaccagaggagcaactcgatcgatcgatactttcgatagtgctaagggcatttgtagtgttggttaggtaagtccggttcacagaagtcgaataaacatttgattcgacccctacagcgttaaaatcgattttgggtgggacccatgaaaaaaatcttaatccccaatttcccttccccctcacaacctgtagcaacaagtaattttttatcatcaatgttcgacttctattttgaagtcgctttttcatctgacacatacggttcgcttcccacagtgtgcatagttcggttttttcacgttgaaatcgattttaggtgcgcactggagctgctctaaggggaacaggatctctgacttaagagcaacctacgtcagagcctcagagggacgtccgatgctgcagctacaccgcttgatcggcatcgaacggaggtgaacaagcacccatcccggcagcaaggccctccttacgatcaccatgccgttcaacttgcaggggctcagctcatcgcaaatgccattcactagcaagaagagtgaagattcagcagcgctccatctgagcgtgagctcgaggaggcagctagccatggcccatggctcggccagaagcgctggccccagcgacaggaggtcggcgtaggcgaaccagacactcaacgcggacggcgccgccgcaggatatgctgcgctgcgggcctgcggcaccgtcggcgaagaactcggcggcatatgatgagggaagcggccgggagcgagcctttccgttttcgtgggttgattttgtcagcgtggccgaaaagaagccagatggtctgtcgtgcttgtttacctccgtccgatgccgttacgccgctcgatcggcaacggatggaagtgaacaagcacggtaaattaattggcttcttttgtgctaaggatatgcatggatgatcctaatgcaaaactatccatcgcagcttaatttcatcgcgccggcgttctgtttgtttccttcaaggtattttgggttcgaagtaagtcaaaaattttcaacttcgatcaagcttaagtaattaaggttatagaaaaatttattaatatctaaatcataaaatttactattgagtatactatgtttttatgttatatttgtttttattgaaaatgctattacacttcctataaaactttgtcaatcttttaagaagtctgatcactggtggagaaaccatttttactcccgattgggaaccgctttagttccggttttatcactgatggatggttttccaaccgggagtaaggatccgggactaaagaaacaatagtggtagtaccagatggccccattttcttttttccctttttattttctcccgaatcaagtaggcaaatccccacatcaaagtaacaatgtaacatcccaaattcacatcacaaatcataaagttacttatacacacaaatcaaatacatcacaaaatcgtaaaaattacacacaaatcaaatacatcacagatccaaacaatgaatcatatatttgtatatctcagtgaatcacaaattaaagaaaaaaagaaaaaacaatgccgctgccgcgcttgccacgaccgctgggatgggaaggggaggaggggggatgaggaaggggaggaggtggaggagaggggatgaggaagagaggatagatctaagcaaacggggagatattcgatctgtctaagttgtaactgtgtaggagaggataagtaatagggattatatactacgcgttcaatttgatctttagtctcggttattgacaccaaccggcactaaagattctcggccctctgacatacatctgacaggggatggttaccaaccgggactaaagatcaaaatttttataaccgggactaaaaacaatctttagtctcggttctttttggaatcgggactatcgtggattttgccagaccgaccaaaaatggtttcttcactagtaaattttggacaaatctaaatgacttataatataaggagcagagggaatatgtttttatctttcatccctacgctgtgcaagtacaagatctatctgtcctttgtttgatattgatggcacgaattataccgtgtcaaataaacgtgtcaaataaaagatactactactaaactatgcactgtgacaaaataaacaataagaagattgctaattttcaggtgctgctccctggctatcggactgagccgtcttctacttgtacaccagacatgagaggaaagaagcatctcaaagagaactcgcttgtctaacatcggtccgaagatgatgacagtggcccagattcaggtatccaagggtagctatggtgacgatgggggtaagagagggttgggtggaggaatggctagggttgcagtgggcgacgaagcggcagtagcgtatgcttctagcatgggaaaaaagggtgagttgctagcatcagtggcaggagagccttgttggagtgttatgaggtgggagaccatagtggcgtgtcgtctagcgacacaaatcgtccgattagacctgcaagacgacagagcagatacaactcaccaccgctatgtttggggaggaggggaagggatgtaagaaggggaggggcggaggccggtctagcagaactcggtggcactagtgaggccgagaggcggctcgatgaggtgagagaggggaaggagtggtgatggagctaatcgatctcgacctagccatttcaatcagaccaaggggagggagaacataaggttgctatacaaatcttggcacaatctggaccatccaatagtgactgaaatttgtgtgtatttttaggtgactgtagtcccataaagatgatcaattgtttgtttttttaaaaaaaatgtcacttctggaaagggcaagattgctccatgaagaatatacccctctcatcctagtcttgatcaatctcaatcaatcaccatttaccaagtataccaccatctcctgttgttgttgctaagcacctgtcgaatgagccctccacttcatcggagccgtcaagccccgttggctgacccatctcatatcttcatcttccttctccttctctaccaccaccaacaccgttgttgtctcctctatttctcaagtcaagaaatcttccctgtcctaccttttcttctcactgtatggcttatgactcctaatgacttcaagcatcactgttgtccgaggccgcaccacaactgcctcaccgtttcaccatagctgccgtccattgtcgggcttttgtcccagacatttctcttaaaccatcccctcctctaactggcgacctattctatcaaggttgctggagattggaccaccattaacatctcttcgctgccattagagaaaatacacgaatgagtcttaccgtccatagtcctatttcacctgcctcatcacttatttgaatcagttacgtgaatattatttttgacaattacgtggaactggaagacatacactctctgtcccataaaaaactcaaccctagaagtgaatatgaacatatattatctggagatagtgtatgtccattcaggatttgattatttttagacataggagcatatcatattatcatcagtgatcatttcatctacacacatattccggtttaacaaattgttctttttattcctttttaagataacgggttgcaaatccccaatttttcacaaattcctaatttcaatcgtcttctcgatagaattttttttctcgaacatagcactactctgctactgctcgactgttcctccatcctctctctaaaccccaaacccctacccctcgctgcaatgctccgccgccgccgcggcccgctcctcctcgccgccgccgccgccgccgcggcgggcgccgtgacggctgcgctcccctccggagaaggccgcggcgcagccccctccgtgctccacgccgtcgcccgctcctcccgcgccgtctacacggttcgcccccaaatttgagagacgctaacctctatctctgtgtgtgtgtgtgtgggtgggtgggtgggtaattcggatgcttctcgtgctcattgctgcggatttggttgttccagattggcttcgtggtagtggactacaagtactcgctccgtgggctggctcatgggtcggcggattaccgggataagctctccgaggtttgtatggttgcgctggcggtttgcggattgcacgcgtaagctggttaatggcgatggaaaactgtaatttgtttttttgtttctctctcatggattattaggtaggtaggaatgaagtcattgatttcttcaatgtggaaaatgaacttgtaggattgtgggaagaaggatttattttgatacatgtgaccatgtgacctattgctcctggcctcctaacactgtttcagttggcaaaggaagaacggatatgaggaactttggggataggagaagctgtctcacaatttcttttttttttcctgtacggcatcaaaccaaccgttgttaacagccttatctattctaattatgaattcaacatcgtggtttggtaccaaacagcgtcattgatagctattgcttcttttagaactcaacacttttagttggacagcttccttgacataattttagtttttcgtttcatttgatattttactttagaaggccatcaatcagatatctcaacttttcccatgtcttcgtattttgatggaaacaaagttgcacaatgtgggtgctctgatgctcatttgaatagattatgtttccaggagttccatcagagttagcataacttgattaaacatgcggcatttcgaatgcagttacaaatagcaagagctccagatggttatagatctgtaaatccttaatgtttacttgtatattgtaggttcatttgcgttcagcaaaaaagatactcaaactatgtgaagcgaacagagggttttatgtaaaggctggtcaatttgtttcgtcaataagacaagtaccaaaagaatactcatcaacactctcttgtctgcaagatcaggtttactagttaatttctatcttaatgttagtgtacactgtatagcctcattagtttttttttatttaacatttttgtaataattcaggcaactccatgcaactttcaagatatcaaaatagtgatagagcagaaacttggcaaggatttacatagcatgtaagtattaaaggttcatgattttttaaacttgattgtgttatctgtagtatgcagagctgtggttataggcaggttcggaggatagcgtggacttaacagggttgtggtcccccagaaaattttcctttagctactatgcagcagcaattggcacacaagcccatgtgtggtagctagtagtatgcagcatagcagnnnnnnnnnnnnnnnnnnnnnnnnnnnnnnnnnnnnnnnnnnnnnnnnnnnctcaacagttaggcttagttcgtgaattttgatggacttgccatattagttgctcactgctgcttatctttgtttcttgtgtggggactgatgagagagctacacaccgtggaaagaagtaacaggatctgtgagagcaatgtccattaagcatgtggcagttaggcctgatattagtgtgtaatagattcgtagtgtatttttagtactaaatttggtattttaatagtgtgttaatgaataccattaactttttggtcccccattggtagttcactcaaactccatcactggttataggaagtgaggttttctccattttgtttcttttaaaaaaaaaaaggtgtcatatgtctttatgttgtcattttatggtctcttaaaagattatctaagttcaacatcaaatcttccttaggtatagctaaaaaagggtatcataaacttgttctctactgtatgcagagtgctgaaaagtagagtttgcatgcttttcattgcataaaattatcatataacctgtgatgtacctgatggttactctggtgtggatcattgtcgtcagagtagattgtgcatgagtttactttttagctggttcagtctagacatgccatgggctcttcggtttacttttttaccctttgtcagcctgtgacgtgtgtccttgatagcttgtgtaccttcgcaattggctgctaggatgcttagctaaggttggttgacattagtgctagtgtcatctccttgccatttgcattaagcaatggctatatgaatgcactgactttataacactgttggaccaatttgttcacgtttagctagtagtggtgggttgagtttcccatggttagctctagctgcattcgaactttcatggaccacctgtatcaactaagattaaacttttaggctgagtgggggtgaatgcatgtgttcttgcaagcaggacttacccagggctgtatatttaaaagttgatagctcttgtcagctgtacaaatagctcataattttattgaaattttttgttgattagttgcatagtttccaaattcaggcaataagtgtttaagatttaatacttgagtatcagattcctggaatttgatgaacatccgattgctgctgcatcaattgctcaggttcatcgaggtcggttgaataataatcaggaagtagctgtgaaggttggttgctgtgaacatgtatctcttacctgtcccattattgttctcaaagatattttagtgattgtttgatcctatactgttatgtcttcaccattcaaatgaagcagggtgtaatgtcctgtgctctgcaatacatttatgtaaaccattgaaaatatgtccagcttgatatcatcacactgcatgctcacagtttcaagacagaagtcagagagattgcatttatgtgaaatccaccatccagagttataacttgcacagggacctaacaaatttatatccaccatcccagttctaccttatagctttgcacatctatcaaatttatggatgcttgtcaacagaacttttaatttaaggatggacaactgccaatttcaaactttagtaatttatccaactctttacacaaattacaagttggagtattcttctaaatttcacagccaatgagaaagttggattacctgaaaaattttttgattattaacttaggctacaacaatttctaactttagcttagccatatgaaatgtttatacactaattttacatggaagcagctaagccatccaatatccattgatgtgaacatgaatttttcatctcaattcttttgactcagagcatagcataaactgatctcttgcacctttttttttaaaaaaaaatatagcgatatggttttatcataattttgctagcagaattgtggaaatggacagaagcgaatatttcccctctctttactggagatatccttttatattcaattttgaaatgccatttcatcatttccctataatgtcttgcaaacattgtctttcttggtgtgcatgtatattaatctagaggatttccatcttaactgtgtcatataggttcaatatcctgggcttgagcggcgcatgaagatagacataatgactatgtctttcttgtcaaaatctgtctcttgggtatgttacatgtatcaattttgcgatttccattgatttgcaaattgaatattttgtgcatgcagctcatttacatgaaaacaattttttacccatgcaatttattactatcgtctatacaatattctgaaagaagagcaggtaatgagcacagttcaattatattgtcaactgtcagcttttttaacatcaagattgttactaaaattctaaaaataaaccattcttggagcactagtgtctctggcaaaatccttgtaaaaaagaaagtgagtatgcaatcctaagcaagcaattgttttttttgttgattagcttgactctaactgttttaagtggcagttttcataagcgtacaacgtaaaattttcattgattgtaaagcttgacatgtgccatgatatgtttaaggagtgttatcagtgttttagt

SEQ ID NO: 63993 - DNA, 1048 bp, Oryza sativa
atctatctatctatctatctatctatctagctagctagctattttctatgtatgctaattggacactctgagaaagtttctactttaactgtaaaaatagtggataaatctagccatccctaattataatggcttaaattacaagaagatccccatataattttatcaatcaataatatcaatcaatattggatttattaaaccgagaaatgaaaagtcatataaaagagtattagagtgaatcctgcatataatttaattttaaggactaaatttaaagtttaaaaaatgcttatcaaataattttttttgaagtacttaaaaacattaattatattttccccttaattattcaatcaagaaagctaaaattaagattctatggcaagtatgactttgtatttatttactcttaatctttggagctattaaattaataaatgaagagtagcagaaaatagtgttttcatgaatcatatgtataatttttagtgctaaatctaaaatttaaaaatacttataatttttttattttgttctgaagtacttaaaaccaatgtttacacatatatatagtactatgtactactagcctacacaatggaagatttatataagcaatacttgtcaactttctttcgaaaaggacattatattttaagaacaatttaactaaccaagtgtacactttgtgtcaagttcttcaccctgcaagtattattcacatctatgagcatattcccttctgtaagcgtagggagctcttccaaatgggcaaaccatagcagtcaagaggctgtcgcgttgctcacagcaggggataggagagttgaaaatgagctagttttggttgggaagcttcaacacaaaaaccttgtgagactagtgggtgtttgccttgaggacgaggagaagctacttgtgtatgaatacttgcccaataggagcttggacactattctttttggtatattatttgtcttttttttaatactattaagtttttttttaacattatactccctccgttttttaatagatgacgccg

SEQ ID NO: 63994 - DNA, 9835 bp, Oryza sativa
cggcgtcatttattaaaaaacggaggtagtactattaagttcggtatatattcatcactcacaatgacgcgaaatctcctttatatttattggtggcagatcaagataaaagcaaggaattggactgggagaagagattcaggatcataagtgaaattgctcgagggctacagtacctgcacgaagaatctcggttgaaaatcattcaccgggatctcaaagctaacaacattctactagattccgatttaacccctaagatttcagactttggcttggcgaagttatttggaggggaccagtcgcacattgtcacaaatcgtgtagctgggacatagtaagtgccttctcaaattcaatccattcattctgttttatcttactttctttctttgccaatcatgtctctgtcactgaactcgaggcaagataggtcagaccaattttattaaaccttgaaacgatgtactccctcggtctcataaaaaaccaatttagtgttggatatgacacatcctagcactacgagtctaaatcagattcgtagtactaaggtgctagattttttttggacgaaaggagtactctggtgacgggatgttccattacaagaggcaaaccggaatagcctccgattcctccgaagtggaacaatcttggtcagctcatctctactattgtaaaaattgaagatgtttttgtcggtattttggtatgtcatccgtgtatgagtcggtttttaaattcgtttgcttttggaaatacatatttgtatttgagtcggtttataagatcgttcacttttggtaatacaaaaggtatcatataagaaatctgtttaaaaaaactcgcatgctaacttgagacgatcaattgaactcctaactacagctcatgattttctatatatatataaaaatatatatatatatatatacacacaagcgaactcctagagtggatttcatcttaactaaaccatataacaataataaaattaaaatagacttcacccgttgcaacgcacgtgtatttttttctagtatatacatgtattcatgccggagtatcgatggaccacatgaactctttaagtattttatttacttttaagataagagaactcttcttggtgacatggcaaatggctgatgtcgcttgcccaaattaaggattgtttcatggatttatgaaaaggtcaatttagaaactgaatatataagacaatcatcttgcttttcattcaaaaaaaaatttagaaactgaaatccacgtgcgcttgtctctcgtccccgcccccatgcaggatgcacggattaagcatcaaaatatgcaaaaattatttatgtactagtgaaagtgagaaaaaagtcatactaaaagggaattgcagtaaaaaaaattgctcaggcatctatgtaggacgaacgaattaaccatcaaaatatgaaaaaaaaattatgtactagtgaaagtaagaataaaaaataaaaaaagctatatgcagaaattgtttatgtacctgtgaaaatgagaaaaaaaagtaacaaaaaagctcaggcgtccatgtagggcgcacatatataacatagtccgaatttatgattgctttacgtgtacggtcgagtacacggctaaatctccagctcacgatctctgcttcagatgtcgcgacctagaaacataaggtgcctccgaagaggcaacacgttgtgagatggaaactcttttatataggtcacaaaacatcaaatctatcgaggtgggacaaaacttgtggctaatacggtaattaactacctgcgcagccaaagagcgcgcgccgccgctgcgtttcttcctccgccgtccgctgctccaaatgatttggattggatgcgttcatagctagcatcgatctctaatcttaattccacatgttaatctccattgctaattacttattagcattacattacttttggataataatgtaaaccattagtactaattaagaaacttaattattacaactcgcggatattaataacctggtgaagagaagaactcgaattattaggacacctagcttaactgctacatcatcttgttcttgtagtggccatctggttgttcacgcgctgcgtgcgcgggcgaggccggcgcgtcgacctgaacgcgcgcgtgcgcgacgtcgccggcggcgccggcgccgtgctcctcctcctcggccctctccaccttctccttggtcatggcgccgacgtcgaaggctgccctggcgacggcgcccacggcggcggacacccacgcggcgccgcgggacgcataggggctcgaagccaccacgctcgccgcgccctgctccgccgcggtgaccgcgacgcgggcgagctccgacacctggaaccgctcgtccacgccgcgcacggcgccgcgcgccgccgccgtcccggcgctgaacttgtcgctgagcccgaaccggcggtccagcgacgccacccgcgcgctcgccgtcgacagcagctggtgccggtcgtcgaacgaccgcgcccgcttcagcgcgtccttgctcagcacgaagcccttggccagcatcgtgctcaccacctcctccgccttcttcaccgccgcctccgtcggcgtcctcggcgagcccgtgtccttgtacacacacaatccaaccccatgaattagcaataaccacatagttatttagaactcgcaatggagcttccaaaatatttctttccatagtcaatgtctcagttttattaactcgggacagcaaaaattttgaaaaatactatcgcggagatacatgagttgcaaaataccgtctctgagaatggcatgtgggacttggacccacgtgttaatgacatgtacgacggtattttccatctccgtgatttttacgatggtaccaagcaaactctgatttttgacaaactccgtgttctttttataatggtaataggcaaattggcagcattaattaattgcaatagaagaacatgagctctctcaaagtctcacctgtctgtagaagtaggcttctggaggtagcacatagtcttccactggtgtaatgttcactgaagcttcagatatgcttgctccctgaataataataataataataataataaaacaaagatcatcaaagcatttcaagattgcacatttgaaaacatttcacaagatttcaggtaaaatagaaggtcatgaagaataaatggaagaagccaatatggatgcattcagataactcacagagagtagcagcgcagtgtctgctccatggaactccttgaaggtcacataggcaacttgtgatgtctctgattcccttcaaattagtaatttgaacagaaatcaatataacatgttgattcatgaataattcggcattatggagagagcgtaccgaccttcgcatttccacgtattcgacctcaccggagaaggagaagaactccttgatgttgtcagcagtcgccgacatggagatgtttgtgaccttgattgttcttgcctgaataaaataaaaaacagaaagaaaaacatcaacacatctgtgaccctcattgttaagtaaatcaaaagcattcattcgaatcaggatgtggatatatattatatatgttgggggcaagaattaatgtgtcatgtgcgtcaaagagagatcccaactgaatcaaacgtgtggcaagatcgacagacagtgagactgaacacacatcaaagaactcaagatggtgtgatgatctgaagaaggcagagaggggggggggtgtcagttcagtgtcactcacatctgagacatcaatggtccaattgggggaggtgctgatgagttgatgaggaggagatggtggtggtgatggtgatgaagtgctgaattggggaggagtcacccctatcctcagatagcccgggtccagccggacctgcagcaggagagacatgcaaatgtatgatcaaaattgatcagggcttaatttgtttttgttttgcaaaactggaagagttttgtaaatcaataggcagaattctagatttgtacagatccatttgacatgacatctgatctagcgtttggatccacaaggaagacagacaaatcgcaatggaatctgaacaaaacaaggaagaatggcaaaaggggagctgtgtgcattctttcctacgatccttcctatatccaagaaccgaataatcaacaatgcagtagtgacagggtttgtttggtttgtgatgatgatcactcaccgccatgaacgactcctgcatccactgatccaagctacctaatgggcgtagagcttgtttgttcactcgaaaaaacctctcactctggatcggcgtcgaatcgttgatcgatcatcaatgttattactctgctcactatctcagagagagagagagagagagagagagagatcggacagagaggggcgggcaaaatggtaaatagacacggcatccggcacggatggagcagcggcaagttcgggtttcagtcgtggtgggtgcaggtgcaagtgcatagagcagcaaaaactgcgagaatcctcttgctcggtagcccgatttgaagaaaaaaatcgggctccttgctactactgcatgcatacaagataagtggagtagctagtttatttttttttgttctcatcactttaaatattttttctcctaaattacttattcgacttacgatccgatcgtaccattgaatacgttgtaattaaatccttacaataagatatctcataattatattttgataaaagaaaaatatatgttttataccgttaaaacttattgttttatatgtgatagcgatatgtttcaaagtgtaacgtttcacaaaatttatttaactatctgcacctactctctctcctctatatccatgcatggatttaaaaaccttcaaaatgattttttttctaaactacttatttaatttacgatccaataataccattgtgttcgttgtaattaaatcttcactacaagatatcgcatgattatgttctgatgaaaatttggttgccattttaatatttttttacataaaatatgaaaatatatgtgctattatgtgaggaaaaagtataaccgtgctagccgtgcaatatgcgcgggccaccatgctactttcatatatatataagagagaaataaaacttgtgctgcctgccttaggcacagtttgattctggttataagcttacctactctctcgtttttcataagcgcatgtttcctaaattgctaaatgatattgtttttcaaaaacttctttatataagactataaggggtttctttaaaatttaataaatccattttttaaatctataataattccaagtatgtttagcccaccaataagctcaagtgaaccacagcccgattaacccatcaaaattttcatcgctagataggccaacttcagggccggtcctatgattttgatgggcactaaaagttatatataaaattttatgatatatatagacgctaattttacttgtaaaacgaaaacaaatacatctatatattaaatttaacatatctggtaattatcgagaaataaaatcaaccaaaataacaatatatttataccttggaactaataccattacattgatgaagaaaagaaccccgtcatatccattgtttctaatgaaaagatacttcttcaagtatttcttaatgcaaaatcatcgataacggtattaagatcaatagtatccaagatcgggcgacgaggcgatgatgctccaactcctctcgtttcagcgtttctgctttcagataggccatagacaggtactagactattagtattaggtattggctccccactatcatgggcccccaccatcatgggcccccgacggtcgcctcggctgcatagggctagggccggccctggccaacttaaaaaaaaacgacccaactaagagcaagtataatgagctataagcttactataatcttatgtggaggggagaggtaacaaaaaaaaaattaaggggttggctctcatagaagaactagcttaacacaatccccaaaacaaatgtattaaatatataagtgagagagagatgagaaggaagttgtagtcaaccttataactaatctattatatatgttggctttaagaaaagctaatagtagaaagtgaactatactattatccttgctctaagtacagctcatctaggacactaatagagatccaatctacgcggcacgaatcacaaagctccccctcttccattcattgctcgccctaggggtgacaaaatccgagttggggaccagtccccgtcgggtcatattttcaacccaccggtctatcaggataaatctcacgttattatatttcgatggataaatcttcgcgctctatgttgaggaggaattgcgtagaaggcggggagcctagtgtacgctcggaaagatatactctctccatatactttggatagttatattttatcttagcacacagactaaggataagtaattctacttatcatctatttaaacatgctactagtcattcctcgtaaacaagcgattcattaatatttacatttttcgatgcccatgtaaccaatcttgtgtgaaagaatagagagtcacacattaaattcgagaaagtcattaagatgataggttgttggattgaaatataactattaaaaataaatttttcggatttgaaaatatacctatcaaaagtagatggagggagtatttacttgggggaggccgggagggggtatttactttcgccgtgtttagttccaaaataattcttcaaactttcaacttttccgtaacatcaaaactttcatacacacaaacttccaacttttccgtcacatcgttccaatttcaaccaaacttccaattttggtgtgatctaaacaaagcctttgttaggttcattaactatcatgtggtcacaggatcccatactctagctgccctcatatctgtttatgttagcatatgaatttttgtaaatgaataaaaaattttaagccgttataatttaacttcttataagcctacgaaagttttattacaactagctaaatgcatgtgttgtaacgggagttaaataaaagaacctcacattacattttaaagcctcaaaaattaaataaaattactcatgtcatattatttgttagggaaaattgcaaaaaccaccccaaatgtcactctgagtttgagatgcctcaccataagaagatttgttacaaatccccacctcctaattcaccttggtttgatttaggcaccttctctccacacgtgcgtgattcctgaagaatcttgtggcgaaatcagccgagtcccactcggcaggagcaagagattatgttgtttgttctgtataatacgatcatttcgttgtgttatcatggccatttcactgtgtttttcatggtaaactaactatatattccaaactgatatcatatgtactgaactacatatccgtttttttcggacgtaatgagtatatagaaacatttgaacaggaagcagtaatcatatagccagattatagctgcatggcttcatctgttgcaattagtcatatgacccaaaatagcaggttttagtacagtttaatcagcaattaaggccacacaatctaatgcaaaagggacctgttgacaaatcatcacgatgagcaggacttggctaatttcgccacgagatgctccagtaatcacgcatgtgtaaagagaaggcgcctaaatcaaaccaaggtgaattagaaggtggggatttgcaacaaatcttcttataggggggcatctcaaacttagagtgatatttggggtggtttttgcaattttccctatttgttattatttttacatcacttcaaatatttttctcgactttaggttagggaaggaacaaaattccacattgagggatctacgtgacaatggtggtggactggtgggtaatgccgtggtggtgcattagggtgtggagtatagaaaatggggggtatttaactttttgccacttttaagatgtggcaattaatcatttgtcgctcgctgtctataacatgtgggctcaaatgtgtatctaatggtaaatcttttatcacctctcgtaattaattattcaagaaaatggtagccatcgaatctgccctgcacgaatctcaatgctcccctccctcctgttcggcacagaccccgctcgacgcccgtcccctctccctctcccctttcgcgcgccccgccccgccccgccggtgcagcagcttgcttccagaagcttccagaaatggaaacccggccaccgcccaccggcgtacgaccccttccgctgcgtgggccccccttctcccgtgggccccacatcccgaactcaaaagagaaaagcagaaaccgcctcttgttgcctccctccctccctcgccgagtcgccgccggcgctccccttcccctcccctccccggaattacttgctccccacgcaatcccccacctcccacctccacctcattccccaatccaatccgcctcggcatttcgccgacacctcgcgcgcgcgcgctcctctcctctcctctcctcccctcccgctctgctgcttcggcgtcgtgacgcgctgccatggagcggccgagcaaccgggactggtcggactgcgacccgacgttctccgcggaggccaacgcggcgatccgcgcgctgcgggacacgggcgcgggcgcggacgcgcgcgcgcgccggctcgcggcgaggctcgtcgagaggtaccccggctcgccgctcgcccacaccatcctcgcggaggggcaccgcgtgcgggggcgcctggagggggcgaggtcgagcctcgagcgcgcggcggcgctcgcgccggggtgcccgcgcaccgccttcatgctcgccgccgtgctcacgcggatgggcctgttcgacgaggcgatggaggtgtgcgaccgcagcctcctcgtgccgcagcccaccgacccggcgcgccacctcccctaccggaggaaacgcatcgtccccaaggacgcggagcataggatcgcttatacccgacaagggatccgtcggctgcgtctcggggccgagaagtgcaggcgaaccgcggttccacttccaccggagtccgcgttgcccgcgccggactggccgccggaaagcgccgaggccaacctccaggtggctcgcgatctctggcgcggcatgagcgaggaggagcagcaagccttcctgaaggtgagctttcaagatatgaagtcgtactgccgctcaggaggggagctagagatgataagtttgctctcggatgccgagcacgaccagttcgtcaagttatctgcgtcgtcttcgtgttggacttgccctttgtgcgggttcaaaattatccttgatgaagagcgcttcatggtgcacatggagaactttcacattgagcatgaggagtacaaaaaattgcggtcatcattacctaaaagaatccctgacaatgagatggagcttctcaaatcatggagatgggaaccgatgccaatcgatggagatgatttggcagagaggacagagatcttgagcaagcttaagaaacttgtttctcagctcattgatatggaggccgtctctctgtgccttctgtatatcatgcacaagttcataatgaggcgggtcaggccggtgacaccattggtagtatccatgtgcgcgtgctgtgggatcagacagttgagttctgcgcacctcaaggaactgtatgaatttctccagaagcttacacctatccttgcagattat

SEQ ID NO: 63995 - DNA, 946 bp, Oryza sativa
acttgctgtatttgcagattggctctgtacaagttgaaatgctattaattgatgctgaggtagattaccagaagaaaatgcttttggaagcctgtaaagtggattatcttgcagccattttacctattgcaaaggcttgccttcgggttagtacagtacttctatcaccaactgaactcgtattcactttttccataactttttcttatgtatgatatttaatgttgacaggccaaaatgaataataaccttcgtccaccaaatggtcttgaactacaagcacctttgaatattattctccgggtaacttgtgtttgcctcgttcagttttttatatttagctattggtttacttttctctaattttctctgactatctgcagtctttgtggcacataaggcgattccatgatactctccagaagataccatctaaatgcactgatgttaaagatggaaactctcaaattgggaagacattgtgtaaaatctttgattcttgggataatgagaaagcgggcaaaccatgtgacccgtgtgattcaacaagatttgcagattttacaaattctctggtttataaaaaggtctgttgcgttcactatttgtcccacctatctaattgcaaatctgtggcctccagcaaacagtaacaacgttcttttgtaaccaaattgtaaccgtctccatgttgtctacactctactcttagatcttagttatatcagataagttgttaatataaataaagtggatgagcttctattccttatgcttgttctgactccattgtccccttgagcaactcttttggccattttgtgcacctcaatctgcagttctttggagtagattagattaaaatcctgtttttctggatagaatatgacagattaaattctgctgatgatcctgtcactaatttgatccatgaatcacctttatg

SEQ ID NO: 63996 - DNA, 4391 bp, Oryza sativa
tgaagtataacggcttggaagcctcattgcccactgaaccatggaaattttggcccattcaaaagatgagcttctttgatgattgaagatcctccttcgaagtcgacagcggtcgggccttccctctatcatccttcttagagacattggagagctggagggtgtatcgacatcacgtgcagcgttctttggtgaatcctcagcttctgtagataccatggacgaagtctgttcagttgtagtcgtgcaaactgagacatccttttgaatatcactggagaaactactgctgcgcctaatcaaaccttttgcaccgaaggaacgctttgatcccccagaacttctacctgaatggccagtccttggcaatcggcagtacagttcaccatctccttcagcagacagactggcagaatcatcgtgtttccgactcgcagttgaacggctagaatcaccgctactcctgcctgaatgatcatttcttgggggcaaaatacagtacagctccccattcccttcagtcggtggctcggtcgaatcattggattgccgactggacgtgcttgcagctgaatggccattcctctctggtaacacacagtacaaaacactagcaccctcacccggaagctcagaaatctcatctttctggtcggcagtcgactcttcacccttgtcagatggatcaacatcaccctgaacctgatccggagacaactcagcaggatccacaccggaaggctgctgttcaccggagacggcattcaccggctcggtctcctttgtgccaacatcgtgctcttcttcttcctcgcccgcactaccaccaccatctctgggtggttcatgtaaaggtaaaggttcctctttacactgacgggctaggaacggcacctcgcaatacaactcattatcaccacatccaggaatctccgcggagaccttgcctgagtggacattggattctctcctgaacacgatcttgccgctgtccacggcgagcaccgcgcacttggccggcagcttcttggagcagtatttggcgacggagtgcagggacctgacgaatcccccccaaaaaaaacgaaagttggccatcaatcatatcatcattgggtgaaaaataaaagttgatgagatttgatagcggatgcggatcgaatgtcacttacgaaatcccgcgcttcttcttggcgatgccgacgataaccttggatgccccaaacaggttggcctcacgaactagcgccttgcggaccgaggagtccttgcaaatcttgagctttagattgatctgcacaacacaagaccccaaagttagcttgctgaagcagtcaattactgcgaaaatactgcgatttgcagaggggaacgagcgggaagtatgtgaattgcagaaggaaagccataaataaaggtaaaaaaatcgcattactgcaaaagttagcggaaaccactctctgaatatttgttgcaactgggataatttatgcaggatgggtgaaaaattgtaaggatatgggctaaaaatctaatccttcaaaaacagccaaaaataaaggagagattgaaatcaaccaaacaattgagaagaaaaaagatgaagcagaagagaaggatggacatggttggtagaaagtggcgagcaaactggcaagtcgagggcgagagaagggaggggagagggagctagacctgcttgagattgcagaagccctcgtagacggcgagcatggtgtcgaagtcgacggcggtggtggcggcggccacgggcgcggaggcgagcacgacgtggacggcgacgatgcggtcgccgggggcggcgacattgatgaacgtccacgtgagcagcgtccggctcgcggcgtccgcccgcacgcccaccaccagcgtcctcccctcccgctccccctcgccgccgccgccgccaacagcgacgtcggcgactccctccctctcctccccggagcacccttcctccgccactcctccgccagcgccgtccatggcgccctcctccatcgtcgtcgtccctcctccttgctgatgatgcttcttggatactaccttcatctctcaacggcagcaaacacagcgcgtcacgactcccaaggcaagcccaccatggccgcgtcgtttcttgcctcgagcgccgttggctgcctcctcctggcaaccgtcgcgtcctctctctctcttcttggggcggtggtggtttctttctctctctagtttgtctctcccaccattatagtagccgcggctgctgtggctggcgatggcaaccgctcttctctttctttcaccgtacttccgttgagcaattcgcctgcctccttttccatttctttttttttctctctctcttttctttacaggttattctccgaatattagttcatcttttttttctctctttttttgggaggcagttgtggtagtagtaatgtgtcactgacagatgcacgtgggaagaaaaggcgcgtgggatttgcgaggagtgagggggaagattccaaggaaaaaaagcctctctttactctgctgctactgttaatctttgatttagtctagtcatctgtgactgctgctgcatttagtcactgtgacgacgatactgtgatctctgatgcaatctgacccttttttctccgattttttatttactaaacgtactatgaattggactttttttaaacgagagtaattttttaaaagattacatactacctccgtctcaaaataaatgcagccatagatatccatgtctagtgttttgaccgtcttgtcttatttaaaaattttataaaaaaaattaaaaatattagtcacacataaagtactattcatgtattatcatctaataacaataaaaatactaatcataattgtttttcaaataagacgaacgattaaacgttgagcataaacaatgttaaaactgcacttattttgggacggagggagtatattattgtggaattcatttattaaaatttcgatttattgtgtttatcatgtaaataatctgcctcaatatcacgtaaaaatctgttttaaacgtggcctaaactttgttgattatagtatgattagttattcattttccaaacttcacatgcctgagagactagtacagtacatgatttttccagtaatgcagttgcattttcttctgtgctctttctattttggaagaagtaacatgaatgaaactactccatgcaagaatcaagatatatgactgcaattaggaaccaattattcaatctgttgggaggtcagatgaccaaacctttttccatccattaattaggtcagatctgacagctacttatccaagtcccaaactaatggggagaattaagagtcgctgcaggtctatgctgggtcttccaattagtagttctggctttgtttaatggatgattgtctgttgaactgagcatcaaggtcacttgctgcatcgctggtctcctagctgttaaggtagcatgcacattcactgtttcaattaatcttgttgcatttttcagctaccacgaaactgtcagaaacgtattgaccatactttcctgtcccaaatcctaattgtcttgttctgcaggcgtactcattaggtgacatttgattcaaccttctggaacaaataatactttcatgcattagttaaagaatcatgaggtgatgacaagccttaacttgcaagtcatgatttgataacccaatgaccaacactgcaaagagccaaaactggtcaaaaggattgtccagtggtgattatccattgcatatttatactggattaatcaagatacttgtttcagccattgtcttagcaacaaagacatatttttttatcaagcgaaacaattacataaaacaaaacaaacaaattaatttttttaaaaaaacatattccttctagagatgatgacttttaggacccggcctgaccttaaacgtacgaatcagacgacagtcgtatatgtgaagttgtgaacctatattgaaatatgaacaaaaggtcaaattaaagaccagatgaagacaagcagaaaattgttggcctgtggatttagctacataattaatggtaacacacacaaacacacggcatgttttactcgcccgaaaggaaataaaatgtgttgtctgcgagtgggtaatgcacagttaattagctaatagggtgcacttaacatgcgtattaattagctaatggacagtagcagtagttctcaatcagtgaggtttcgagcttggaaggaagattgtttaattgttgcgtacaagcttagcgttaattgcgcacacgcacatccgtcacattaatcaagcatcgagtatttatggagcaaattgcttacaacggtcgtcctaggctccta

SEQ ID NO: 63997 - DNA, 1191 bp, Oryza sativa
tcaattcttcccttgtaactagatttcaaaccctacacctaataaaggtccttaattatcaaagaattatagaaaacaaaatgcattgaaaattttggtgtgtaggttggttccgtccgtggactacactgaccaaaccaccaaattccccatgcattttgtattttgtgatggtttgataacccttaactagctagcttaataaactatttctagctagctaccctacctagctagaaacactattgccaatctatcaatccatcctttttcagctaaatgtaaacatgatccacaaaattcaataggtctagcaaaagggaacaaaacaacatatatagcagtacacactccatgaatggttatatgtccaaatggcacttaaatccacatccaagttgcaaactagctacacattcaagttttaactaacagttgcaaccataggcagcagcatgggcaaacatagacagcaaggggcaagtgtagataataaaacagcccacaataatttatgtggcagcaacagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtgacggcatacttggagaagcggcgtacttggagacggcggcgcaggccgtagtcgtcctggatcctggtggcggcggcggagaggacgaccggcggtggtcggggatcccggcgtcggggaggtcagggtcggggaggtcggggaagtcgatggacggacggcggagaggacgaccggcggcgagggcggcggtggaggcggcggcggagagggcggagatggcggcagagagggcagcggagatggcggcggagagggaggaggagaggttgaggcggcgacggtggagatggcggtggagacgacggcggagatggcggca

SEQ ID NO: 63998 - DNA, 1237 bp, Oryza sativa
acggcggcgaggagggcggtggagaggtcgaggcggcggcgaggagggtctggatcgagagagagagaggcgaggcggcggtcgagagagtgagtgagtgagagtgggtgccggatctggatcgatctagaagatgtccaaccctaggtcaaccctagtcaaactcacctgtgacgggcgccaactatgtggccgtcacaggtgaggtcacctgtgacgggcgccaaccgtggagccgtcacaggtaagaccacctgtgacgggcccaacactctgggccgtcacaggtgaggtcacctgtgacggccctacagatagagcccgtcacatgtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttatacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctgg

SEQ ID NO: 63999 - DNA, 1861 bp, Oryza sativa
tggttgaacatggtccattgatattttacaggaaaaaaatatgcatcaactattgataagctctagtgtggcatgcatgcccgaaggcactggataacccagctgaaaaattaagaactttgcaaatgtgcccccttgttcctcgaaaataagataaccaaaaatagattatgaccggacatccaaagagtttattctcttgaatctatagaagcaatcggtttggaatggggcatgagatggaaaattatattatttcctaaaggttactggtccaatgcaaaggcgagtcactcagaaaaatagacaacaaatcagggctgacctgataagtgtataatttgacataaatgaggggcacccgttgattcattctgctgtactgtctcgcaattcggtttactgtctctggaacatactcaaggacaagattgaggtaaagttcatccctttcagtggttgagaagaagtaatgcttaagaccaacaatattaggatgatccagcatatgcataatttgcaattccctgttcttgtaacgtttatcttgaagaacctttttaatggcaacaatttctcctgtttctcgacatttggcctaagagttgacacgaacaggttatttgcctttcacagtcacatagagaaatttttacaatgaaaaagccacaggcttacctgatatacaaccccaaaagaaccagttccgaccacatgctcagcaatataagtgacagactgttccattaccataaccactttatcagcattgtttcatggccaaacatcacaaattgcaaggatgaaagcgaaactatttttacctgtttaggtagaccatttcggccacggatcgtagtagctattatgtgaccagcttcagcgctagagccgtcgactacatctcgttcagtgttctgcaaatgaattgttggaaaccaaagtgcagtcttggttcatatttccgtaggctttctgtgaatattcatgagccgtagaagtatgaagcagtgtcataaaaccatgcttttctagggtggacaacatgtcaaatttgcagagtagcaaattacagacaaattttttgaagttatgcagtgattatttactactttctcagaaaggcacagtggctcattgctacaggaggtgaacaaaataacaggaaccacagaaacaagagtttgattctggtgacaggtgactcttcatcctacatcaacactagttcactcagtgacaaacaaacacgaacagaaacctaccttttcatcaccaacatctgtttggaatccctcaattgcatttccagcatctcccttcctagacatcaaccgaactagccgggcccttgaatccatgtcccggccgagaggagctcccaacgccgccatgccttagtccagaataggccatcccccactacccgagattccccaggtcaggacaagaaaaacagaccagtattcactccattgcttgcagaagatcagcccgccattgcaatgccgtttcctccagcatcacttcagcaacagctgcatacacattccataaaaatgtgtcaagatcgagatgaaccttctatggcatagtaggaaatttttcttgtaaaagttgcttcatcaatttataactgatgaagaacatccaaaaaatcttcaggaagtaagtacactgcactcaagtacgaaacacataattcgtctgttagtacactactccaaaaggcatcccgatttccagccacacagcgatcaagaagggccactaaataatcatcaagaaaaaccgcaaaacttgcactaaatcccgaacagatcaatctcaaaaatggcccaaagatcctccgaaaataaac

SEQ ID NO: 64000 - DNA, 1339 bp, Oryza sativa
aactttcaattttttttctttaaactttcaattttagtcaaacttttaattttagcgtagaactaaacacaccctaaccgcaaatccaactcatggagtcatgttcatctccccataccagaaaagaaatcgacaaaagcctgcatgtgccacagaactttcggtagaacgatacaacatgcatggttcgcctcaggagaccaacttgtcagcagctgcattaacaatgcgggaaaaaacaaacttcatgtagccctgcgtgtgttatcaagttcatcgttcatcagaactatggagtgtacaggatcatgcaggttttttctttaagaaaaacttctgtacataaccgtggttctcatgtactagttgtaaacgacaatcgggtcacagaaaataactcaaaattatccaatgtaaaattcctgcttatccatatgtttcttgtagtatctactgtatgttgtaatgtagtcatatactgttatccacagatctgcctgcctacctgcaaccagagagacttgatgtaatacaggaaaacaagagaaacatataacagaggcagtcacatggctatgcccgaatgaatagaaacaagaaacaagtggtagtaacaaacaggagaacccgaaaggtccaccgagatagctgttctgttcatgctcatcatgctaagagaccagggtcccgtcattcgttgaccaggtcatgggcctcacaggcggctatcacttcagtttgcatatgctactgtaaagtgctcatgtgtgctgtgagatgtggctacatcactattcaaagggggtcatctgttagctgtacctctgcatgtggggaggatgaacttagcttttaatcttcatagattaatattgatctctgtcaaaagctccacacagtagtattcttgcaaaacaaagtcatttgttccagtttcagtagccaaaatttgttccagtttccagattcttcagaatgaaacggttatgtgaaaggaagtagatactgacctgcacgtctgcatgtcaaattccaacagcatcaagaagctctgaatgttgtgacacggagactagcgtgtttgcgacaattgcaccacttgcagcgacggccggtacaccgatgcctggaaaagtcgagtcaccacagcagaatagctggggtataggtgttgcctgcccagggaaagtggcctccccagcttttatggctggaccataggttcctctatttcttcggaggaacctcttgtgtgttaatggtgatccaaccagcttcacatcgcatttttctctgctaaatcttggaccaagggcaagctccacggctttccacatca

SEQ ID NO: 64001 - DNA, 9821 bp, Oryza sativa
  unsure (1)..(9821): unsure at all n locations
ttgcatgatggaagtcaatacaagggaataggttactatctagtgacctagaataacatgtggcacaatcatgcctctcaaaaatagattgcataagacaacagggcgagaaaagatatgccatcttggcctacatgatttctatggtctgccactactgcaaatgggtggaccaaggcctaaagcccctaaactaaatgtgatatgcagtactgaagatggtactttttggagggagggaaaatatatagtgattatcgtggattgtacactaaagactttgatgcatccatgaggctcaaggtaatgtaagtatcatatttgatgaaatcattaccaatagtaataatatggatctgcattgctatcattggttttgtgttcataacttgtatcacacaaatcctttcctactaggtaacagtttgttttttgtttggtaataacatatccttagaagatgcttacttgtccactttgtagcttgacaccaactgctcgaccattctcaattaaaatcttttcaacatgcgaacgaagagcaagcctgccaccaaatttttttattcctcgcacaagagcatctattattgctccgcttccctcaagaggatactcaagcgagcatcctggtttataccattctgcaaacatataaacctgtggttgtagttagaccaaatgatgaaacagaaaacatcataatcatcacttttaaagtatttgtgtgaatttgaatagacacaacagatgggagctaagtatcatagaggtaaatatatggaaaactctgcactgtaacttattcagaatcgcattgttttttgatgcaatgaatcgcattgctcagtgccaaatatttcgacatccagttgctgtggagcactccaacaagataaaagtgctaagattcaggtataagtcactgccatccaccaatgggaatgcatgccatcaacctatacaatttagatccactataaatacaatcactaccatgtagactgcattgactggtttagggtcacatgagagtgactacggaatagtatagattctgaaatagtatctgctaaataaactagatgtagaatatgctacattgaggttgttccaagttcagatgacatgagaacgtgtaacaccagcacagctattttatggaaagaagaggaacattgcaccgatgtaatactaatcccatgatgtcctcaccattagggtcaatgcacccacaaatatattgatagaagttgtgcaacaaaattattctcttattcatctatatattgccataatggtattggtcggtttcaacagtgaactaaatgttgtttctggaaaccagttggaaatggtaattcactaaattatggcaaagcaaaaggtactgaaattaaaggaaaacacaaatggaaggataatgaattcaatgttaggcaaagcaacagctactgcaaatggaagtaaacctgatggaaattagtttaccatttctgcagaaagagcaccatcagatttgactccagcaagtagaaaacacaagagatcgatccaattacgaacaaaggggtttttcaggcccaatgaatcaacgatctctgagaaaggtcttagaagttttgtagcaccaagagccccttgaggtcccatttgcaggattgatttcaacagagaaggagcatatctaccagcagatgtggagagaacacctaaatcacctcgaatggaaagtggaggcaaagccattgcagctgcagagataggaataactgcatcctgagattgttttagtatggtattagctcatgctctagtggaacataaaatgtcccaaagataaaaaaaataagaaatgatcctggaaaagaaactagtatcatatcatattcaagtacggtgcttttacattttttacaaaatatgcctataaaaggatagcacaggaaaggaaagcattaataatttatggattgctcatgtgttgcttagtactccagttcagtgagtagtgagttcatctacacgactatggctgcaaaagtattttccaaagagtcacaatgcagacaaaagaaactcacaagaagctttttccactcctggactgcatcagcaccaacaaattcatcaaggtcctgaaagaattgcgagtcagaatcgtgttcagagcatccaacataaataaattgttagcatcaaaactgcataaatgggagagaacatctctaagttcaataaccagccataccatttgagaagaaataacatatctgagtgagaactgataatgtcacaggtaaagttaagtgaatggttccaacgattacatatctaatggcaaaagactgctcaccttgaggaaatcagttggacctatccgcgaaaggaactggccttcaggtacataaaccatccaggaatcatatgaggcacatggaactgattcgcctagcgcatcaaggacctgaccaattgaatgaccacatcagcttccaagctctcaccacaattaacttgctctaaacccacaatgccataatgggaagaacaatttgctgcaatcaagtatcacctgggcgaggggattggcctgggggcctctggactggaagccggagaacagggaagggcccgagtcgaagttgaagcccttgatgtcaaacgagtgcgcggcgcctccggggcggtcatggctctcgagcacgagcacgtcctggttatacctcgccaggagccccgcgcagcacagcccgccgatcccgctcccgatgacgacgacgtccgcctccggcctctccgcctccctgaccccgattcagaacgcaaaaccggctatgcctatgagcatcgatcaatcgccggagagtagtggtgcggtgcgaaacgtacccggagagcgcgccgtcctcgccctcggggatggaggggtccgcggggcgctcgtcggcggccaccgccctgcagcgcgcgggacgagcggcggccgcgcatccgcgtcgtggccgtggggcggtggtcggtggagcgcgcgggcggcgagcgcagtggcggggcggaggcggcagcgcgcgggaggccaaggcggcggaagccatgtcggaggcggagaatagcgcgcgtctcgccggctacgccacatagcttcgggatcaggccgcggttggagtgaggcggccgtcgtggacacgtggcacttcgccggcctttctccttccgcggcagccgacccgatctctcccgtgagacatggagaagatgggaagcgaggcccatacggcccaacccaatggcccattatgggcttactgggaagcccattttaaagcgttcttcttcctctcctcggcccgcgcgcgcttctcttcctctctgctacctcttccggccgaaagctaagaaaccaaaaacgtacgcggcgagcttccaagaaaggcaagaacacaagaatctgcgaaatatatggatcaattaagtgaaaagaaggtgcctgaaaatctccaaacttaatttcgatcgattttcatggccattaggaaagtgaggaaaaaaaaacacggcctaataggtacggtactcagtcggtttcagaataagtaaacattatttttggaacctttttttttttgcggggaagagctgggaattactattgctcaaccgacaagtccttacaaactagctgagaaataagattacatgtgtcgcctacccaaaggaaagaaagcctatcagtgcgagctatgtctgctaaagcatggctaatctggttttgagatctgtggaccttcctgatgatgaaatccctctctccatcaatcaacactttaatatgtctaacaatgaaagcaagggaagagcggtccggttccttggtctgcatcaactgggccgccgtcaaacaatccgtctccacttcaataggaagctcatcgtccattgcatcgccaggctgattccttccacacatgctagaagctccgattctaacgcatcggagcacccttatttatatgtctctcgcctctcccttgacttgaggcggaggatcgaggattactggcatcgtcgtcttccttcgttccctccacacaagagaagaccaggcaagtcctcttaatttaccttcttcataccctaacatacatatctcagtttcttctaccggctctcggtgacctcctttggtctgtgtcctccctcctgttcgttcggctgccaatccacatggattaagttagtctgaataagctcgtttcttagctcaactatgcatggactgctaccctcaaactgtttcaccctcacctatccaagtttattttgtagtacacagctagcctgtttattacttatgttttctccaaccgtatgtacgtatgtacgttagggtcaagcaagcaccatcaaccttgacataaagccactaacgtctcttctgtagtactccctatgcattttattttaatgtatgacgtcgttgatttttcaaccaacgcttgaccattcattttattcaaattttttgtgcaaatatgaaaatatttatgtcatgcttaaagaatatttgatgacaaatcaagtcacaataaaatcaatgataattacataatttttttgaatgagacgaataatcaaatgttagacaaaaagtcaacgacgtcatacattaaaatattaaaatatagaggtagtagtaatatataacctcttatgaattggatttacaatgttacttttgattctgcttcagttaacgaaaagacgcggaaaattaagaggacgtctgctacgtactcatctcacaagaagctacaatactaaatattttgcttcagtcatggaatacagcaacatagctaagaagagggagggtgttattgttaagatcgtgacatgatacaaagccccaggagtagagacaagtaataagtcattgacctcaacttcatttgttatcctcttttctgccatatcttcttgtacatgctactatatttgatgactaacacccgtgttctatggcgttttaacttatgtctgggctctaatcaagataatctcaaccaaccacgaaatttgtctaagagcgttgtctcacttgctttgtatgatggtgagtatgctgctatagttacccaatttataatttaacaacaattaatatattacccccagttataaattaatgctttaacttgctgtcttgtgtaacaattaatatatgctttgtaatggaatctgtttttaaggttcttactggtggtgtgagagattagctttttatatttgacattctagttttgagttaacttatcatatttagtattaattgtatttcattgccgaccactccttgtgcagcaccaggacaaaggtgtgggaatgactatctaaccgaaaagaattatcccaagccaccactaaacatattatatggtgagttatttgatgatattctaccagtaaacacctttttacagttctgttttatcactaactattctaccatgcaccttctaccagatggatgattttggctaattctttgaagagacttttggccatctatatggtcaaggttcctggtgtgaattcacatcagaaagctttcctaacaacattcgtcgtagtgttgttgcacttacttcatggagtggtgattttacactaattaatgttttattgattgtactatttcatttttgtatattttgcaatcactaataagatataataatcaacagtatgcatggtatgcaggagggaggaggcttttgcctgcacgggtttttttattgaatggacgaacggatacagaattattctcacatcagcgagcttggttagagagtctgatgatggatggtagattgctaaaaacttggctgtaggtgctagagctcatcataatttttattctcctatacttcctccgtcccataatataaaggattttgactttttacttgcactgtttgatcactcgtcttattcataaaaaaaatgtgcaaatataaaaaacgaaaagttgtgcttaaaatactttagataataaagtaagtcacaaataaaataaataataattctaatttttttaatanagacgaaatggtaaataaaacaaataaaaagaaaatcttatattatagaacggatggagtatatcgctagcttctctttcattctcacacactttatcattactttgcagatacaggtgttgcttccaaacagtacatgcgatgtagggtatttacaacattatagcttacactacaatgttgctctagtcagtacccatcacagttggaatgctcctccagtatgtactcggcttgaccagcacaattgtactccctccgtctcaaaaaaagtcaaaccttgggtttccgtgtccaactttaactatccgtcttatatgaattttttttataattcgtatttttattattgttagatgataaaacatgattaatattttatacatgacttgtctttttaatttttttcgtaattttttcaaataagatgaatggtcaaatattggacacgaaaaccagggtttgtcttttttttttggaacggagggagtagttgggtagcagctataggatatttcttcgattcaggcaaattaatgtttgaaagtggacatttggttccctggaccggcacacttgattgccgcttccttttacgttcgtgttgcagaatcactaaggtacatatatactgctggctagctctgtcaatttttaatttctcacctatttgatttacatggtggaaatgaatatattagttgcatgtaacttatcccatctgtttgtgatgacaaatgacaacttaattacttgcccatgtcatgttggcagggtgggattggagggcctcttgttgatttggacgggaatgttttgggcatgaacttctatgataagaagataggaaccccttacttgcgatggcatgtgattagtaagattctgggacacttaataacagaagcaagtagattcatttctctttttttttggttattcaagtgctgctcatctgaagtcttcatgtttttttttaaaaaaaaatacttggttgtatgatttgctgtaaattaaatatattcaatggtgtgtttggcagcagctctgctgaagttgacttcggtagttaccctagaggggccactcccatgctacgcaggttagtttaatgatacatcacaaaactagtaaattacgacgcctcacaaaaaatttcttatcacgttgcatatattgaactacaggagtatatctacctggctggaatggaggtgacaatgccaacctaaacagggtttttgatcagactgcatgtacttcaaaatattgtttcgtgcttccccaatctccacctgttgcgcctgactggacaatcgaaacaggtaacagtgtcacgctaaacaggttagttttatgatacaattaatactagtgagtattacaaaatgtctcccaaaattaattttgtaatcacattgcatatacattgaactgtaggtggcccgtgcccctgccatattggcgtcaacctgacgatatggaggaggaagaacccccacgtggctttgaggacatgtacacatacgtggacggagtcagattgtgtaacttttagaatcatcatgtccttgttctgctctgttgaatttcttcctccttccgatgtgttcgctggtgtgacttgtgccatgtcattgaagttaattatacaactatgcccgctgttagtcctgtaatattattacatatgctgtgtgcacttgtgttttagaccattcagctatagtggtgttggaacttggaaggtatatgagtatataagtagcttttgttaactttggagtacataaatagcgtgcctatcttggatgtgttaaaaaaaaaccctaaagtattttgcagtacggaaagtgctgaattttcaagttggacatgtttgagtttgaatttgctgtatatgttgggtgattttttttcttaaaaatcacatgattttttaaccttgatagttttgccttagattttattttggggtaattgcatatttgccactgccggaacggtgaatttaccattataaaaactataattgcacatttaccataaaaacagtcagaacttagcatacctaccattagactcacagtttgaaccaacacggttagcaatgtgtattttaactaaaataggacaatagtaccccttccaacgaaatcgcagaagtcaatcaaaaatacgcgatcaaaactggtcgcgagactgtgtggcacttcgccggccattctccttccgcggcagccgctctctcccgtgagccatggagaagacgggaaacgaggcccataaggcccaacccaatggcttattatgggcttactgggaagcccattttaaagcgttcttcttcttctccccgcgcgcgcttcccttcgtctccacccgaaagccaagaaaccaagaacgcaagaaatcaagaacctgcgacatggatcaagaattccatttcgaccctttcaccggcggcgacttcgactaccccgacggcgagtctttctccggcggtgccgcaagcggcgggtttgactaccccggatcctgcggccgctcttcttccgccggcgaggaacttcacggccatccataccgcgacggctattctttctccggcggcgccgcaagcgacgaatgccacttcttgggcaggagcggcttcccttcttcaggcggtgagcgacttctcgttcaccggcatccagaccgctaccgctgcggcgagcctttctccggcggttacgcaagaggccacggcgacttgttgggatggagcagctgccattcttcctgcagccaacttctgcaagaccctgcaaccatcgtcatcgtcatcaatgacggtgctcatgcccatggcggcggattagcacaggctgggcaagcctcctccatgagcgttccattggtacggctacttctcctgcttctgatcaacgttctgtgctgcttctgatctcgttcatggcggattgccgcattttttttcccgatcatgatgttctacatttgcataacatttttgtgcacgataactctcttcttctaatcaatattactccatttggtctaattaaatatgcctaatcatgctgttcgatttacttaattaaggagctgataagaaaactcggtctttgtctgttgaaataagagtaaactggcatacgttgtgttgcgtgtatgggtacaaatgtttaaaaagacatcgtagttatcagtgttaactgggaaacatacatacatatacatattagtattttaacaagtttcaaatatgaatcattttgtgatatgggtagcattgtggttaattatgaatcatgctgaatatataatgttattcttattttgtaaatgttacttaatctaaattatgataatgggacaggtaaaatcaaaacaaggaacatcactggtgccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64002 - DNA, 12231 bp, Oryza sativa
cgatgggtagtatcagtatatataataccaaactcgtgattaaacttgatgtagttattctaattcaatgaaagtttctattattattatttttaaaatcaatagacatggtcgtcactgggcgtacattcgtgagatggatcattcgaaaatattaatccaatgtagctagatatatagctgcttgatttagaagtgatcgatggtcactaattaagatttagtaatcgacaagaagccaaaattattaacccagcatcagcatgcaggtgtagtgtgttagttggagagcggttgcaggatgtaacgtgtagctagagagctcgatctgcagagagtgacacatataatgcagtaaaattaaagaaaaacaaccagacagatatataggcacagaaaataattaatcatttggccggtcgatcgatcggtagtcgtcaacaattcaacatcatgcatgcatatatctcactcggtcgatcgatcgattgatttacaccaactaattcgatcgtgacgatgggtatgtgtatggcgatctattgagttgttaagtggttaaccaactaacttgattacaacatctagtacgctacccctctctctctctctcacacacacacattgttaagtggaataattaacatgtatccatctatatatgctaacaaacacatattgtttgcaaaatagtatagaacataacagaataaagtgtatcgagctactaaactaggtggaatataatgtcggaatgtgtggttttgtcgttttggcaaatactgtatgaagctaaagatgagtgtactattatatgatgtgcacctgctctggtctctggcctgcctacatatacgcacactagtatatatagtatccaggacaatacacgtatatatgtacgcatctacggttcgattgtgcaggctggtaggtactccctctgtcaaaaaaaagataaactctggtttccgtgcctaatatttgaccgtccgtcttatttaaaaaaattatgaaaaaaattaaaaagacaagtcacgcataaaatattgatcatgttttatcatctaacaataataaaaatacgaattataaaaaaaatttatataagacggacagtcaaagttggacacgtaaacccagggtttgcctttttctgggacggagggagtaggtagtataagacagacaggagaaagacaggccagcgtatgtgtatacgtacgtacatacgtgcgctaattcgatcgcttctcgctggacatcacgtgcaggtctataccttttcgcgtgtgcgtgctttttgcctttttcgagcgagcatatacatatacaaatattggatatgaatctagccaaaattattacggagtatatttttaaacaaaaaggagtacatgggaagacgaagctaccctataatgcattttaatccttgccaatattgatcaatgaaattaatattctatcataaggtagcacgtcaatgccacaagagaggcagtttgtaggttccaagcgttgaaaaaaaacatgcatgagggagcagtagctagccggtcgatctttttgatgtgcggttgtgttggtcctcctatagtcgacatgagcaacgccctgatttgtcatcacacggcgataatgcaatctaaaatactcgctccgtcttataatataacaataaagtagaatatccccgtaaaaataaatctagtagaatataagatatatcttaatacgatgaatctgaacatgagctatatctaaattcgtggtagtagcataagttcagattcatgcgtcggaaaggctaatccgcgcgcgcgttgctggcgcgcacgccggcccacgaggcccatgcacgcgcatgcttttgcgcttctctcttttttttcttttttttacgccgctgtttcttttttttcgccgtatattgttcctgtcgtacggataaaagaaaaaaatataattagtttagattagcttcatatttttactagtggttggtttactagtaatttttaaattttaactttaaaattttcaaatttagacatgaaaattttcaaatctcaagttgaaagtttcaaaattttcaaatctggacttgaaagttttcgaatcgagttgaaagttttgaaatctcgagttgaaagttttcaaatctcaagttgaaagtttcaaaagtttcaaatctggacttgaaagttttcgaatcgagttaaaagttttcaaatctcgagttgaaacttttcaaaactttcaaatctgtacttgaaagttttcgaatctgagttgaaagtttttaaatctgagttaaatatcttcaaaatttgactttaaaatttaaatcttaaatcgaaagtttcttaatctaacttgaaaaattttcaatctgttagtaaaaatatctcaaaaaaatctctaaaatctttcctaattactgttattagtgttaagtagtgttaactaatactaatataatactaatataggtggttaggtggggaagcgcgtatgcgcgagctaggcgcccccctacaatacactgaaaatattggtcgactccgcatcgtaccgctctctccctcttgtcgttttaggcccacgagcagtaggaaagcccaccgattagaactcggtccatctcgcactaacgggacgggagcccatgaaaggccgggaaggactgaaggagagcccactaagatatctcttgcttactccactgggccgcatcatagcaaacactgccgaattttttttatttataattttttttattaaaagttttacaaaaataattttccattttgaaaattaacggaaatagtcgcctaccgccctttgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggcatggaatttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctatagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaataataaaattgtattttaccagtcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcggccccccgcacagtgcaaaatcgccctagcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattcaaacactgcccacctgcaattgagtagagaagggcagaaactcagcccatatctctgctcatgtggaataagttaatctgaggtcccttaactttacaccgaattcgattttcgtccctcgatcggaaaaccagacacaacgggtccctcaactattaaaaccggtgcagattaggtccctcggcggttttgagagcggttttggctgacgtggcgcctacgtggctaatttgactcggtctttgtccgacgtggcgcttacgtagcaattcgacccatgggacccacatgtcagtctcacatagaaaataataaaaaaatagtgggacccacgtgggtcccacatgtcagtccaactcaccccctcttcttcctcctctctccccacctccctctcttcatctccctatctctgctctctccaggcgccacagaagacaacggcgcgcggcgacgcgcggccggcggcaagagaggagggagcaacgcgcaaagaccggcgaggcgggcagggagggaggacgcagggaggccggcgatggccgagagccatgggcggggacttgatggcgacggacggagggagaggtgcgcagctgacggcggccagcgggagagggagtggcgaccgccctccgccgcggacgacgtcgacgtcgacctcggcatcctcggcgactccctgttatcgccgatccccttttatcgcccgggtcgatctgttccggccaccgccaccgccaccgccacggccccctccctccgcggcgttcaggtcatcgcctcgcgggcggaggagcgtgcccagcgccatcgcctcgcgggccgcagccgcgcagggcctcgtcccttccgccgctgacgccaatggacgcggcggccgccgccgccccacgcagcgtcaccgggcggcgcccgagctcctccgccttcggcggcccgtgaggcgatggcgcgccatggaacggtggggagaaggtcggcgcacctctccattcccaccgccacgcggagtcggccgacgctcagccgagcacagcggcgccggcgtcgcccgcggtagcctctcctcgtggcgcccttccccaccacgccggtccatcctctccatccccaccttcgctggccatcctctccatccccacagccgtcggcctcctcttctccacaccaccatgccggccttcccaatccaccgccgccccgtgaagctccccttccctccctcctctgcccggcgccgccccgattcctccccctacgccacctcctggccgcgcactgccgagccgccgcgcccggccgctgctgttgacgccgcgccgacctccctgttccaccccgcgctgatctcaccaccatccccgccgccgccagcccttccccaaacccaccgccgcccatggagctcccttcgccttcttcccctcattgccggtgccgcgccatcgcgccaaaccgcctccgcacgccgcgcctggctgcgccgcttcctcctctcccgccggcagccggccaccgcgtgccgctgcctctccgtccccgagagagaggagaggagaggagagatagatgaagaggggagatggggagagaggaggaagaagaggagggtgagttggactgacatatggggcccacgtgggtcccactattttttttattattttatttgtgatactgacatgtggggccacgtgggccccgaggattttattatttttccggctcgaattgccacgtaagcgccacgtcatataaagaccgagtcaaattagccacgtaggcgccacgtcagccaaaaccgccctcaaaaccgccgagggacctaatctgcactggttttgatagttgagggactcgttgtgtctggttttccggttgagggacgaaaatcggattcgttgacaagttaagggacctcaaatgaacttattccctgctcatgttaagcattcggcccattgaatacttgggccgtttcgagtagttcagtatcacgttttactgtgccgattatattccgcttccggaagcaaaagttcgacatctttccccaccagtgaccacaataacacacgttagtaacatttatctctctcctttttaggagtatttcagaaaagaaaaacattaaaccagctcaaaattactcaaccaaaaagcagtaggtgttcaatgtactatgtcccctccggccatggaaacgtctggatgatctttcgtgggggtggcccatgacgacaaacgttttcacaccccaacctaccaaacaaaatggcgtattgccttcattcgaccagtgtatattgcaacctactcatatggctgtagaaaacaagtgcgttctttctcaggataaaattacgctttcttaccgaaaaagtagaacgacttgcgtcctatcacaaaggttgtatcatactattatgctataataaaataaacgtagcttaacagcttaagttttatattattcataagactttatatatgtgcttatatttataaatatattatatatttttttaagcagcagacgacggagatggtcatagacaagtcgagtactcgagtgtgcgtctagtagagattgggtgggtgtgttgctaccacctaccaggtctttcttcctgagcaggacacccaaccgtccaggaaccagtgcaaaaaatcacgcggcaaacaatgggataaaaattcacagaattttttttacatatgattcgtgagaaatggttcgatttttctgtggacctttatcatgttgaaagccatcaacaacaacaaaaaaaaaaaagaaaaaaaaaagttgtttgtgccatcagcccatcaccaacggaagccgcgaaaaataggcaaaaaaatccccaaatccaacaacctgtagcccgcttcagtccgacgaccatggccactcctttgctcgccgcgctcctcgccgccgcgctgctcgcctcgccggcggcgccggcggcgtcggccagcggcggcaccatcgtcttcaccaccctcggccgcagccgctacgagttcgacatcttctccctccccctcgcgccctccccccataaccccgccgccgccgccgagctccgcctcaccgatggcgtctccgtcaactacaacggcaacttcgcccccgcctccgattccatcctcttcgtctccgagcgcaacggctccctcaacctctacctctccccggttccctcctcccgccgcgaggcgctcgagtcggcgtcgtcgtcgtcgtcttcggcggcggcgacgatctcgccgctcctcccatgggagccaatcgcgctcaaggaccggccgtcgctcacccccgacggctcccgcctcgtctacgtctccaccgccgtccccgccgcggagccgcgcagcagctgggccgccgtgtactccaccgagctgtccaccggccgcacgcgccgcctcacgccgcttggcgttgcggacttcagccccgccgtgtcgccctcgggcgagtggacggccgccgcgtcgcccggcgccgccggttggagcggcgaggtcgaggacctgcgcactgacatctacgtcttccgcaccgccgacgggtcgcgccggtcgctcgccatccgtgacggcggctggccgagctgggccgacgagaccaccgtcttcttccaccgccgggacagcgacggttggtacggcgtctaccgcgccgagatctccgtcaccggcgacggggtcgaagcggcgtccgtggagcgaatcaccccgccggggttccacgccttcacgccggccgcgtcgcccggcgcgccggggctcgtggcggtggcgacacggcgggcgggctccgactaccgccacatcgaggtgatcgacgtgagcagcgacggcaagaacgcctacttcgaggtgaccaggcccgtggcaccgcgcgtgcaccacttcaacccattcatctcgccggacggcgcgcgcgtcgggtaccaccggtgccgggggagagggaacggcgactcgccgctgctgctggagaacatcaagagcccagggtcaccggacacgttctcgctcttcaggatcgacggctcgttcccctccttctcgcacgacggcaagaagatcgcgttcgtcgggctgccggggatgtacgtggtgaactccgacggctccggtggtcgccgcaagatcttctccgggaacgccttctcgacgtcgtgggactggaagaggaaaggcgtggtatacaccagcatcgggccggatttcgccagcgagaccacggaggtggacgtggtggccatctccctcggcgacgacgacgacgagtcaaccatctcgatgaagaagctgaccgtgggaggcgagaacaacgcgttcccgtcgccgtcgccggacgggaagtgggtggtgttccggtcggggagatccgggaacaagaacctgtacatcatcgacgccgaggacggcgaggccggcggcatccggcggctgacggaggggccatggtcggacacgatgtgcaactggtcacccgacggcgagtggatcgccttcgcctccgaccgccatgccccggggagcggcagcttcgccatctacatggtgcaccccaatggcaccgggctgcggcgggtggtgcacagcggcggcagcggccggaccaaccacccatggttcagcccggactccaagagcctcgtcttcacctccgactacgccgccgtctccgccgagccggtctccaaccctcaccattaccagccatacggcgagatcttcaccgtcgacatcgacgggtccaacatccggcggctcacgcacaactcgttcgaggacggcacgccgtcgtggacgccatacttcctggagccccgagacgtcggcgagacgctgcaagcctcgggcaggtgcgcgttccaggattgccactggctcaacatccaagatgctgcccaacctgaagagctcaactatggcaagagctgctgagtgaagccatggcactggctgatcacgctgaattaagccaataaaccatggatattggagtgcatgaatgtagatataatactgttatgtagtagcatgaatctaccaggaataagatcatgtacactgatgccatcttcagggcaaacgatatcagaattgctacatatctagtttttttttattggccagttttatgcttacattgttgcatagtaaatagattgaactattgaagtgaaaaaaatgtagtaaatacattgaagtgaaaaagaaaagataaaaagcaatatagtaaatagattgaactaatgaagtgaacagaaaaatgtagtaaatacattgaagtgaaaaagaaaagataaaaagcaatatagtaaatagattgaactaatgaagtgaacagaaaaatgtagtaaatgcattgaagtggaaaaaatgagtaaaattatgatggaaaaatgtagtaaatgcattgaagtggaaaaaataaatagattgaactaatgaagtgaacagaaaaatgtagtaaatgcattgaagattgaagtggaaaaaatgagtaaaattatgatggcgtcgcccgggttcgaaccggagaccttcagtgtgttagactgacgtgataaccaactacaccacgacacctttttgttgtcattgtgcgagttaaacatttcgtgttgaagatgatgagcatattaattagcaaatatcatgaaaattctaaaaaagaattaggcatttactcctaatcacaaacaccgtgcacggaggaggttgggatagcacagcgggaggttagggtggcgagcagctaccggcgctggtggtgaaagacgagcagaaggggatcgaagaggagctcggatttgccgatgtagggtcggggcgacgtgagcagatcaatatgacgacgacgtgagggggcagccgagccagcgccattgatagaatagaatattgaaagagcagacagaaaaaaaaatgacagatatatcaaatgatgatggagcaatatatacattactactctgcaagtaatctacgaaactaggattcaagcaacaaatattgagatccctgtgttgctaagcactagaattatggttctaagtttcaactaaactagaaataagcagcaaaccaaaaaaaaaaaaatacagttcttcagcctttggaactgtactgctttcatcgccatctggagaatcctgtcagcaaaattattttcgatgcagaatatggccttccagagcccaaaggtcatagcaccagaatataaattttcaagaggcccatgatattgatagaatcatgaggtcgtcagtaatgttcgcatggtaa

SEQ ID NO: 64003 - DNA, 1209 bp, Oryza sativa
ctcaaaaatatgggctggtattttctatagaacaatctcacctctcgagcgatgcattatggcatcatgaacttgcattggatgttttttctcctcagctttaaatttttgtcgcacctgattacggctcttatcagggaagagatgctgtatcattgcaaaatcgctaccaaattgttgaagaccctgaacagaacaaatatgaaaatacaaatttatgtaacaccaataaatacgcaggaataaaaatatctttttaaaattggtataaaataaaaaatgaaaaatagcaatcaaaatggttgatttatcaaatacctcgtaaaacttgtccgtttcagatttggaccatttggctcgtgtttgtctgttcatgtatgaatggtaattaagtttggttgtattttcgaccacatgattctcagtcctgtcgttgtcccagttgtcttgttcgttatactcatcatccatatctccaaattgggaggtgctgtggtaagacaaaccaagatcatgatagggtcagataagttgaatcgcctaaatcattttcagctaaaagctgtagttcgtgtggacgattaacttccccatgaacatatattcgagacattattaaacaagagtgctccaatggcttgcgctttacaaagaaaacaatgtctaaataaaagacactgagaatttttgttagaagacaaatgagactgttgaaactttaagaggttcaatagtcaaataaattgaattgaatgaaacaattattagaagtgccacaaaaaagattgcggtcaatctaaaataagaattgcatcaggtatgtacatatcactgaaagatagcaagtgaagctgtatagcagaccatcaaattgcagcaaacaatttagatgatgaagctaacaatagcaaacaatttagatgatgaagctaacaatagcagcatcaatttgatattggaaataacttgtctgaaacaggaaagactctccacaagaaaagtttacatgaccaaaagaaaaggaaaacgtccaaataccccactgaacctgagagtcctgtctaacaccttaagcgattacccctgaacgttcccgtttgatccaaacaacccccaagtggttttgcctgcatggcgtgctgactgtagtatttgtcatgttatagcacacgtgaaaccactacacaaacaaggaaacataaaataaca

SEQ ID NO: 64004 - DNA, 1311 bp, Oryza sativa
atcagcaccggacctgcagcccacaagatgaacttaatataagataaatataagttcaagcaaaggtaaatagttcgtagagcctacttacaaggtaccattatctcgcgtctcagcacggaattgccgaagcagcctcagtatggctttgttctcctcggcacttttttcacacgagccattgtgaagatccatctgaagtagcagacggaacagctcgtctttcttctcctgcactagcgtctcaagacttgcaggatctatgttgttatgaaccttggcatctgcggcaggatttgggcaaggcaaacgatgctgaaaatacaaagaacaccgtgaattgcattatgaaaaggaaaccaaatagtaacacaaaacgcatgaggaaacaagtacagtggtaaaactggttggttggataagaagaagctttaaagtttgaacagtgtcaatgtcacttttacatcaagctttaggcagaatttggaaaacaatattgcgtgaaagtacatccaaatatgaacccataataattggaccaattgctggtaaaaatctatggccttcaacttttttcaagataatacatgctctatattatgagggagatttgacacaaatgtgaggtaaaagaaaaccgaattttcaactacatggtctaagggtctcatcggttaccaaagacttattataagccacaacggcttttattagtgataaaaaagtaattttttgtctaaaacatttacaatgtgttcttagcaacttaaaagccaatgctgaaaaagaaactatgttgaaaatatcttaaaatcaacttcaaattgagtttgaaaaattaaaaaaaaaagactttggttgaattctttttaggcctaccaatgggctaaaattgtcgataaagcataacaggttatggtcttgtggttacattgaattattggactggtcttgcccaacggactgtggagacctgtctaagagggacatcaatctattggagcaattttggttgtgtaactattgtagaagtgcctttgtaggctttactgaagccatgcagaaaacaaaatggaaaaatttacattgccgctacactaaatttacatacataaaaaaaaaaaagtggagcctacaggaaaaggggttaacttatagacattagccgaataaagatgcaaagaaaagttttgatacaaaaataattacatcggtgcatttaattaaggaaacctgagtatctcactataaaaaacaatataataaaagaaatgaatttaagtacatgtgctatgcattggaaaactgtaa

SEQ ID NO: 64005 - DNA, 5109 bp, Oryza sativa
agatcggtattggaaataatcggaaacgggatcggtaggaagaatcggaaacggtttagggcacagttttaccttttctttatatacgaatccaatcgctctacaggcacctccccacctccgccttggcctttgtgtgttcccagcggaggcccttttatttatttagttttttttagtggctaacaccattcctgtccatggcggcggccgaaggtggacacagcacccccacggagaggagaggaaagggattatctcatctcagatgagagaggaggttcctatggagtactaaaagaaaagaggagcagcagctcgtgggcccagtaaagaccaaaatgttggcggaatcagcaacccgggaaagaaatacaagtccactatgactccctcggaatattggctgaatctcatcttttaccacaaaaccaaaaccatctcgctcggttgttttcgagaatggtttgttttttttttttgactgacgtgatgcccaaaaactttccgtaaaaacatcacatcaaatctttggacacatgtatgaagcactaaatatagataaaaaaactaattgcacagtaattagtctatgattagtcccgagacgaatcttttgagcctaattagtctatgattagccataagtgctacagtaactcacatgtgctaatgatggcttaattaggctcaaaagattcgtctcgcggtttccaggcgagttatgaaattagttttttcattcgtgtccaaaaacctcttccgacatccggtcaaacgtccgatgtgacaccaaaaaattttcatttcaccaacaaaacaggcccattaatatgggaacctacttctcctctgccaccttcccctctccgctttctgctcttccttctctctcctctccacaacggcctctgcttggggatgacactgtagggggcggagctttgtggcgcggtggagaagatgggacaatgggggatatcgtgatggcgctcttggcgaggcttagggcctgtttggagaacttaagattctgagaagcagctggttggtaaccatcttctgataatctaggggcctgttcactttgttgcaaaaaaaaaccttactaaattttggcattgccaaaattttggcatagttactaaaattttggcaacttgccaaaattttggcatgatttcttatatagttagcaaaatttggcagcaaactaaatgtagccacttttttaacaactttaccaaaatttggtaaggttgaaaatagcatcaaagtgaacaggccctagaaaagttgggtttcccagcttctggcttgcttattttctggattctacaagtacagtttctcagaatctggaccaaaagctggactgtttaggggagcttctgatactgtgagaagttgcagcggctagaaactcctccaaacaggcccttaggctgtgttcgctactcctaggaacatatctccagcacacagaaaacggagcggtccattaacgtatgattaattaagtatttccttttttttcaaaaatagatcaatatgatttttaacaactttcgtatagatttttttaaaaaaaacgcatcgtttaatagtttgaaaagcgtgtacgtggaacacaagtgagatgggttgggaaacccatcctgccgaactaagcctaaggccgaggtactcatccttgaagaacatgccaaaggcgcttcatcgaggagagcgccaccctaagagcaagtataatagtgtgctataagtatactactttctccatttcaggttataatactttctagcattgcccatattcatataaatgttaatgaatctaggcacatgctaaaagtcttataacctgaaacggaggtagtacaaatttacgtggaggagagaggtaacaaaaaaaatcaagagtattggctctcatgcaagaactagcttaacacaagctctaaaacaaatacatgttgtttatgatagagaggaaaaaaaattgtagccaatctgatagctaatttattatatatgttggctttaagatgagctaatagtaggaagtgggctctactattatccttgctataaggctgagttcgtttctcaggttcctaaccctccatctcatttttcgcgcgcacgctttttaaactgctaaacatttttttaaaaaagtttctatacgaaggttgtttaaaaaatcatattgatctatttatgaaaaaaaaaaaggaaatgcttaattaatcacgcgctaatggactactccgtttttcccgtgtgcagggcatgggttccaaccgtgggaaacgaacacggcctaagtagggtaatggagaagaaatgagggtggaacaccgagagtgcaggaattaaatttaaaaaatatacctttatttttcataatttgtgtttatatatatgcatggagcggaattgcgaaaatatacctaacccacggtgcggcgatgcgggagcgacgcgtaaccgcagatcgaaggcgcgggaccagtggtcgtatcggtcacgcaggttggatgtgagggaccgacgtggtcccgcatattgcgcatgcggcatcggcgcacttccgctgggtagttcagcggcaccgcggtggtttgcgggaccgagcgacaccggctcggtcccgcggaatagatgtacgggacgggctgccacatattggaaacgcgggagcgctctccttcccggtaaaaccaaatccaatcactcctaaacttttgcaaacagttaaaactaatcaaccactcctatactttatgtccaatcactcctaaattttacacacagttaaagcaaataaacacagattcatgtgagttgggtgggaccccaccggtgcacgcgcgtggttgcgcagactggccaagcgggatcgacgcgctcccgcgcattgggactgtgggaccagtgcctactccctccgtcccaaaaaaaactcaattcttgtgtttttgtgttcaatgtttgactgtccgtcttatatgaaatatttttatgattagtattttcattgttgttagatgataaaacatgaataatactttatgcgtaacttatccttttaaaatttttttatttttttttaaataagacggatgatcaaacgttggacgcggaaacctacgaattgagttattttgggacggaggaagtatacatgaaaagagtgtgatcatgatctagagcagttaaaagaggtgcctatacatacgtggtagtgctttactgctgctgagataagatggttctaaattaatcaccgcaacagtccgtacaggactattattcaggtttattacagaggcacgagccatctgtcaacccaatgtgaagtgtcaattgtgcaactctttacaatgattaatagccctggacacaaattggcatatacgtgcaaccgaagcatcacagaataactgaattgttcagaagtataccgaagcatcggcttggtgccgcagattgaggctgcgggacgtctcggtcccgcgcctccgttctgcgcgatcggcggatcggcctggctgcccatagcacggaaccacctcggtgctgccgattggggctgcgggaccgtttcggtcccgcccgcatagccgcgccgtgggaccgactcggttccacacacccaattcgtgtgaccgagccgatcccacgcccccgctccacgcgaccgcgttcccgcgccaccaacctgcattaccaaatcgctctcgcgtttccagcgtgcggagaaggtatatttgtgccaaactttactgtccaggtatataaatgtaaattattgaaaaaaaaagtatattttcaaatttaattcaagagtgcagagcctcgatgacggtagaccatgcggagctaaccatcacgcgtggaggagataaggacatgggaatccacgggttctggttgatcaactaggggttctgggtgtggtcggtgtgcctaggagtgctcgggagccaagggcacgagtcaagtggtgattgtccgaggttgaagttggatgcaatattgagaggctgacatgtggtgcccacattgctttccacacgaacaagacatgttggctcttcacataggcaaaactgaaaatagttaaaaaaatatctatcttcagtggcaattttgtaaggtcccatttgaatgtgatggaatgatgaagattaagtgcgcacgcaaatgaataagttatttatacataattaattaagatttcattattaaaaacataaaaatggatttatttgatttttttatagttaagttttcgtgtaaaacatatcatttaacagtttgaaaaggaagccaagaaaaaaaattgtatcttgctggagtttagaatctaaaaagtacacgcggataattaccaaatgtagcagtggcaaatactagttaaattcctcgtgttaggtacgcaggcaggctagctaggtcggcctagcccactagggttagtgttgggccctaagagaaaaaagttttttggaaaagattttgctaacgattttgctaaacatcacgcgacagattacctgcagccgagaagcgacgactcgcgacgagcgaacactcgcgaaccagacacacccatcatcttattccacattaagcccagctataattgggctgggcataagcagatgtccaccatgttcgatagcagtgttcagattttacagttcgagcagttgcagaaaactctaagatttttttagtacaaagcacaacttcctgcctggctttagcttctttttgggactgaagtttgctgagctagcgctgcttccttcttaatctctttgttaattacttatttcatgagaaagtgtagtgtagggcatcacatagtctaggaattggatttcaactctgcgtagtgggagtgccacaatgcaatgcaacctcaaactttgcttcattattatactatccatgcattttgaaactctgcacatcgtggaatttagtgcgcaagtctctgaaggccttctctgcatcttcatgcttcatcatgaaccactatatatatgccttggtggagtatattttaactagttagttaacatctggaactaa

SEQ ID NO: 64006 - DNA, 10590 bp, Oryza sativa
  unsure (1)..(10590): unsure at all n locations
atctatttaaattcattaacatcactatgaatatagaaatgctagaatgacttacactgtgaaacggaggaagtacgagcctgcatatgcaatctagtacctcccgcaaaaactttattcctagctatgaatgaatttagacaaatatttaaccaattgtaaaatcagaaatgaatctttttgaaacagatgtagcaaatactaggagctagtatttatccagttgtatagtcgatcggaaatgatttcagacttcatcgtttcgcttattgacggaataagcgaaacggcatatttacaaataaaaaataatttataaataaaacttttatatatgtattcttagcaatctaaaaacaaagactaaaaaataaactacgatgaaaaacctcaaaattaactctaaatttaaatttaaaatttaaaattttaatttataagcataagtataaatcaaaagatgaggctagaagtattttgggggacagatcgagtagcagatatatataggtgcgaatgtactggccatttgcactgtactggtgatgcagtggattattttctcaaagatagatatcatgaaatcagggacaatcacttcgaaagctgcctcactatggtcttgtttagatctaaaaaattttcgccaaaaacatcacatcaaatatttgaacacatgtacgagacattaaatatggggaaaaaaccaattacacagtttgcatgtaaattgcgagaagaatcttttgagcctaattacgtcataattaacaatgtgatgctacagtaaatatttgctaatgacgaattaattagacttaataaatttatctcgtagtttataggcggaatatataatttgttttgttattaatctacatttaatacttcaaatgtgtatccgtatcctttaaaaactttacactcaaaaaactaaaaaactaaagacaccctatacccatatactgcaccagtactgcaagcgcacacacgcagcatattactccctaacaaccctgcaccatcattaggtttttgttactttgtttagctctctgtttgtttgtgagtttgttgcgagactgttagtacacatgatatgatggcaaaacgcactagattaatctctgcttaattagtttgcatcatatatagctgtgaccccatgcatatatatctagatcccgggttgaaatttacagaacatgatcgagctagatgagctagcagcatgatccactatctttcttcttcatctacatgctgttgtgtttggatgtacatgtatgcatgcatgcatgtaggacgtttttagataatgatgcatgtaggggccagattgatttccattatctctcaaaaatctactagtacatgctgaaatgaattaaagttgtgtgtgaaacatggggggatgctgaggtcaagtcatggagaggacccatagtaaagaacagatgacgaatggaagaagaaagtagctgcagagacacatacgtacattgcatttgatagctaggcactggtgcagaagacatttgttgtgtgtgcttgtgtgtcattgatatgatacagtacactacttctagtcactactaggtggtatctagggcaggtagtggtggtttggcttttactccaaagttgcattgtgcattccactattctatagctgctgtttgtagtggtttacttgagcgcattatctcgtaaaaaaaatctcaaggttttactgcagagagagaacctgtagcagctaccacaattaattttaaacatgctagctgcttagtatgcttagtgaaatatactaaggctgttggtaattaagctacttctgggtcgttgacatgaaaaacgaggcatataggaattgggacaacagaaaaacgtctaagaatctttctgctagattcaaaggtggtggcttagtttgtttgaatttgaagtctcaccattttaattatttgatattagattcattcgtaatatttacgttttttttaattgtgacagcacacagcagacaacgcatagcgcaggactgtgaaaagtgaaccaggcaagacgtggcagtactatgcatactgtacaccaagtactccagctagcgtgcagtacagtggccgtgctgaccgtgcatgcatgcacaggctaaggctagtacagggatcagctggagtctggacgagcatgcaaaagagtgagacaacaagacaagatgatgcatctgtttgcagctgtagcaacagttgcaaccagtactgaggtattactccctcagtcccataatataaaggatattaagtttttgtttgaattatttaaccacctatcttatttaaaaaatttgtgcaaatataaaaaataaaaagttgtgcttaaagtgctttggataataaagtaagtcacaggaaaaaaaataattccaaaaaattttgaataagacaagtggtcaaacagtgcaagtaaaaactcaaaatttcttgcattatcgaacggagggagtagtagctgtgtggcagcgagtagctcacaaaatttaacaatttgacccttttacaaaaactatttttataaataaatcattaccaaaacttatttaaaaaatgactcttttattcagcaccaaatcatctggcgttgaacttagacacctcagcgccacgtcaactggcgctgaatgctgtgccaccgcggatgggaggctaagtcagtgtgccaacgcacattcatcgccatgctatttagcgctgatatgtctaagttcagcatcatacgatttggcgctgaaaaaaaaagatcatttttgaaataagttttggtagcggttcatttataaaaatagattttttttgcaaaggttccaattgtcaaaatttgtggcgagtagctagctgctttggttgcacgcatcgcattgcatggggagcagcgagtttggctgtgcgttggcacgtgaaatctatcggaccgtcaatggcaacaagaccacacatgcacaagacaccattgaattcaaagctgactaggaatacatcattttcggtccttgccattcatttgcatgcgtgcatatgcctcatccgttcatcgctattcacggcatataccctgttcgtttcaaaataaatattttctctattttaaaataaatatccctattaggtttatctattttaaaacgaacattgtatactgtagctatagcaccgacaatcttgtgacgacccgcgttgaatttttagtacatatatctgatattgagaatgaccatgtactagtatatatacaaatgtgtgtagtgtactgttccctctataaagaaaagttaggtgtatcacttttatcattaaaacaaaggagaaattaattcatcttgtgtataataaaaatcaagtagtctttgtatatatgaaactaatgggtatttatatgctttttgggttccaattaaatatttaatttatcttttcattatactaaatctcagatacatgaaactataaactagctaacggataaaccaaaatataaaataagtttaatatttttggaacgtacgtagctgctccatgttgtccaaaacatgagtcaatcaatcaacacatgctgtacatacgcaacgtagggagggggaggcccttcccttgtcggatccacacacgcatatgcaaatgcatgcacttgtccattttgcagctttgactacttgtgtgtgtgtgtgtaatttgtttgaccgggtgttcagcagctggctgcatgcatggtatgcaggccggagatgtaccaacacgacgccatatattccgggttctcaggatctgcatccatctccagcaaataaagcaacatatagccaaaaggcacgtgctgtcgctgctcatatatgacgattattacttaattaaactgcctcttgcttactcctaagtattcacatacactggtggagaaaccatctttggtcggtcgcccgaaatccacaatagtctcggttcactaaaaaccgggactaaagatgatttttagtcccggttggtggctacagcgggcatatttgatctttagtctcggttggtgttaccaaccgggactaaaaatgatctttagtcccggttctaaatctgtcaggccttatcaggccccccgatatctttagtcccggttgataacaccaaccgggactaaagataggatatttagtcccggttggtgttaccaaccgggactaaagatcccagggatctttactcccggctgataatatcaaccgggaataaagcgtacgcaccagcccacgcacaagcgcatgcgtatatatatatatatatattatatgcggnttgccgcttattttttctcatcacatcctccaataaccatgtaattgctccctccgttttatattataaatcgttttggacctttttttatcttaatcgaacttttttatatttaaataaatctatagaaaaatttagcaacgaccaaatcaatttaaatataatataaaatatattttaataatataattgttttgtgtcgaaaatattatatttttctataaactaagtcaaactttttaagtttgactggaaaaaaaatccatgataccagcgaaaatgacagtactctgtctcggagtcatcatgtgccatatctattgatatatttaagaccatgcatatatggccgattgatccaggtcaggtccaattcggtatgatacgatcgatcatctcttgatgatctgattaactcaatcaggggcaatatcgatcgatcgagcaagtggaacatgcagatgcagtgcaccaataatatcgacagcaacagcacctgactatttcttgtcctgtcgagatctgtaatccctcaattccttcgtctctgcatccggttaccctgtccgctagcttccggccggccggacctctctgtctatgtgggcccttgcacttggaaaaagaaaccacacaccgtcacaagtgttcagaaaaaggaaaggtccagcgccatggagcggcgaggctagaaattggtgctcaatttagcaaattaacctttgcatcgctttcgcacgctgtgtgtgttcgtttcagtgtcctgtctcctgtgcccggtcgtcgtctaagctagtactccctccatcccataatataaggaattttgagtttttacttacaacgtttgaccattcgtcttgttcaaaaaaaattttgaaattattatttattttatttgtgacttactttattatctaagtattttaagcacaacttttcgttttttatatttgaaaaaaaaattgaataagacgagtggtcaaacgttgcaatcaaaaactcaaaatcccttatactccctccgtttcgaaatgtttgacaccgttaactttttatcacatgtttgaccgatcgtcttattaaaaaatttaagtaattattaattcttttcctatcatttgattcattgttaaatatatttttatgtaggcatataattttacatatttcacaaaagtttttgaataagacgaatggtcaaacatatgctaaaaagtcaacggtgtcaaatattttgaaacggagggagtattatggaacggagggagtagctagttagctacaagagcttaatttgtactcccttcttccctaaatgtttgacaccgttgactttttaaacatattgaccgttcgttttattcaaaaacttttgtgatatgtgtaaaactagatgtatacataaaagtatatttaacaataaatcaaatgatagaaaagaattaacaattacttaaattttttaataagacgaacggtcaaacattttttaaaaaaatcaacggcgtcaaacattttgagatgaaggtagtacaagctagccacagatcacgcgtcctaatcacgatcttgctggttaatttgacagnnnnggggggacatgctgatctactttatattcaatcatggaggttcatcgaattgaatcgcaacaacaattttgtggtgaaaaagaaaacgtactttaagtttagtttatagatggattaattacatcgctgtacgatgcctatctacgctggaagtcaaaagatcagatttactctctaacattatttgataattggccattgaataatacacgttgagattcatgctgaccgttagagacaagcgccgagattcgtaccatgctgggaaacaaaaatcatgtgtgtgttcatatatctactgagctccgcgggtttatatagttgcttataacttatgctattataattatatactacgtactagttatattgtaattatacttgatatttttaggatttttatgtcaatgttagttaggctatcccaagaaaaaaaatgataatattaagcatgactttatgttcgctcaatcgtgaatgcgtcaggcatcatggtgttcgacacaaactaatcaccgtccaattttagtggtgtgatttttcaaaacaaaagttgctttcccttttgatcccaatcaagccgttaacctgattggcactgcctgctcttttttttgccctttctgttagctggtaggcctctgatatggccgcatgcgcaaaaaggttcagatatactccctccatttcaaaatgtttgacaccgtttcactttttagtacgtgtttgaccatttgttttattgaaaaaattcaagtaattatttattcttttcatatcatttgattcattgttaaatatactttcatgtacacatatagttttacatatttcataaattttttttaataagacgaacggtcaaatatgtgctaaaaagtcaatggtgtcaaacattttgaaatggagggagtatttttcttagcatttttaaggctgtaaattaaaacaagctcggcccatccaatgtgtgatcatcagagtgagcatgcatttctgtcctcctcgattggccaccgtaccagcagcagtccatcatatacgtgcaacatatatatatatatatatatatatatatatatatatatatatatatatatattcccctcccttcccaaatataagtgccatctttgctaaaacataaacctttttaattaaattatttagtataaatattaaagttgaaaataaaaaaaagactttgacgacccatcccattaaacgaggatggttaagacaaaaaggtgattgatttacgaaatttaaatggaaactgattagtggaaaaagtggtattctgaacaatgctagacgtgaaaaactgcttatattttgatataaatatcaaatgctagacgggtacattgtattttttaaaaaaataaagggagtatttccaggttgcttagtactccattcgccctattttaagtgcaaccatgagattctatgtccaactttaaataattagtatttttaatgttataggatgatgaaacataaaacgtactttacgcgtgacttatgttttcaaatttttttcaaaaaatttaaataagacggacaatcaaaattaagcacgaaaaatcatggctgcacttaaaatgagacggagaaagtagagattacaatgaggagaaaagactatggtgtcgatcagtcgtccgtcattgattccgacattccgtgtgtttcattcgtcgagttgtcgtacagggtctagctagctgcatgtagaataagggctcactcggcttctacatgggaaaaaaaagaaagaggcgtgagctaagtgtttaggggatgtttagatcaaggggtgtaaagttttggcgtgtgtcacatcggctattatataggatattcgggaagtaataaaactaattgcataatccgacagtagacaacgagacgaatttattaattaagcctaattaatccatcattagcaaatattttctgtagcaccacattatcaaatcatggagcaattaggcttaaaagattcgtctcgcaaaggagtatttaatattttatgcagatattcaaacgttcgatgtgacatggtgtaaaatttttatgtgggaactaaacatggctttagtctgatacgaaattggtgtatataggaactcaatccaccagtccataggatttgatgttccaaatgccaatggtatgtatagaattacaatcctctatttttcctagggtgcaaattaaaggaggcctaaacgtacgtacgcaagcacggagggtggatatagtgatgtagacctgtaacgacgagtgcaacagatacgcatggttcgcacgcacgtacgcagccgatgatgaattcagggagggagagacaggagaagcacatacgcacgcatgaacatatcggccggtaaccaagacgtcgacatacacagagcacgtgcattacagataggcattaccgtcctaaaatataacaacttttaattagacgagacatataatctattttagcaggatatgttctgtccatcaaaaagttgctatatgagcactgcagtctgcaaaactaaaatggagctgaatttgtttgaaaactacaccctctactatattttctttagctcattttatttatcctaaataagttttttaagtaaccaatgtatttaagtttataaaagtgtaaaataattatattaggagtaaataaagtaagaaataattatagtgagatttgataaagtagagatatttttttttgtgttgtattgatatctgtaagataatgaaaaataaacttatttgaaacggagagagatggataaagtggtggggaggtgaaagaaatatagtgggaaaaataagaaagattcgcggagtgaaagcaaagcgaggcaaggcaagagggcggcgacaagacaagcaggggaattgaagaggagggaaggggagggacaggcggcggaccggcggtgaaaggcgaaagcgaaggtggtgggattctgtcctccccaaagggggaagaatatcatcatccatcgcaaaaaagccactttcccacaaaaataaaaaagcccactcacactcacgtccatcgtcgtccctaccctagctatgacatctctcatctcatcccatctcatctctctcatccccaggcccccacactatccatcatctactcgatcgtgtactcgtaacagcattgtattgtatgccaggttctcctaaattcgatccatcgctttctactctacgctcctaccatagtgctagtaggcaataaaatggcagtttcatgcaatatcatactccatgatcatcattcaggcaggcctagctagctcctgatcatctagcagtacacgttgcatgttccatcgccatcgatctcaacttgtcaacactcacacaaacacgcacatgtacacacaaaacaaacccacctcaccagtgcttgtagctatatatagcttgttgatcctgatattgctagcccacttaatctaattcagcccctgtcattttccaaccacgcacgcacgcagcttcagccactgacgccccaacttgcagcgcgtagcgtatgatcagcagcatatagctaggccaattcggtccgtacgatcaacgatcgatcgatgcatgtgtccgcgccatgcgtcgccgtgtacccaaaaccaaagcgtacgtgcacgatcgtaaacgacgtcgtcctacacgacgtcgacggcgacatcgtgaccatcgggcggcggcagcggcgcgatgaggcgcttgcactcgtcgtcgtcgccttcggcggcggcggcgatcatctcgaggccggtgagcttcttggcgcggagggcctcgaggtgccagtcggtgcgccacacgacggcgaggaggaccagcgcgacgcaggcggcctgcgcggagaggaggccgtaccagaggccgccgaagccgacgcgggcgccgaacgccagggtgacggcgacgggggtgccgacgaggtagaaggagagcaggttgatgcgcgcgccgacggccggcctcgccgtgccgcgcagcacgccgcagcccgtggtctgcgggcagttgcccagctcgcacagccccaggatgggcatcgccgccgccgccagcctcaccaccgccgcctcccgcgtgaacagctccacccactcccggctgaacgccgccgtccacgccacgtgcaccaccccgatcaccaccgcgcaccccagcgccaccatcgccgccatcctcgccctcctcggcttccctccccccagttcattccccacctgcatcatcaccaatcaaacaaaattgaaagtttaattgaaattagaacgataaaagttgaaagtttatgcgtgtaggaaagtttcgatgtgataaaaaagttgaaagtttgaagaaaaagttgggaagtaaaccagatcaacattgcaactcctgattcaattctgcactgtacaacgcatgacaaattgacaattcacaaacagtggatgaacagcgacatcgcggtgtgcaaattctgtcttttctccgaacacctacagtgcagctgtgagcttcactggcacccagaggaagcactgttcgtgtgcactgtgctgacatgcacgagcaatgacaagaccaaccaccaatggccagaggaagaa

SEQ ID NO: 64007 - DNA, 8764 bp, Oryza sativa
ttaacaaagcataagagttcgaacagaatgctgggattaccagctatacaggccaagcgcttacagtctagaaagacagaaaaaaggactaacgctgctggcacagcacagggaacagcaagcatacaagtccaaaaaggagaagcaatgtcagaaaggggattgatcagaacggcgacattaaggccctttgatttggaggaaaaacatagaaattttagaggatttcaattctataggaaaattttctatgaaactctttgaaataaagaattgaatcatatataatcctttgaaattactataaaatggacaatcctaaagggattttggaggaaatttagccagagtttcatcctcttgctaactttcctttgagtctatatctctcatccaattcctgtgtttttcctatgtttcaatcaaacggtcattcctgtgtttttctgcgttttgcaatcctctgttttacacttacattcttatcaaaatcctacgtttttcctattcctacgttttctcaatcatgcgattaaagaggcctaacttgaaccttctgtcgcgcggatactggcaaacaacaatccctgtgctctctctatctcgccccttaactcaattggtgacaagcttttccactttcacaaacgataaagctttataaggcaaagatacaatatttttcacaagtcaattgaacacccagtcgtttctcacaagccaaatcgcctaagcccctgcagcaaaataataccacaaggttttgttttcaactcccctctggttctgaattaaattcagaagatcaaacatctttgactcccccaaaaacaatttctctgtaaggagactttgtggtaaattgtcctgactgagtcagcttccaaaccatactatctttttctgttgtcaactggattggagcaagcctctcttgcagctccatccattcaaccaattcattttgacccagagttcttctcagattgatctcccattccccctctatcaacatttgttttacaatactgttagggtcagaacagatgctataaatataaggaaattgagtttttaatggcatctcccctatccagacatcatcctagaatctgatagcttctcctagtttcattcaccttttaacacacacacacacacacacacacaaaacaaggactattacttccagatttcaacttatagatccactagtaatatgctcgtgctaaacgctacggtgatattttgtaataaaaatcaaataaccaaaaaaaatatatttttaatggttaattggatacatgccattacaacttttatggttttgatatataccattactattcaactatttaaaaccatgacattataatttcaccgctttcaatatgtgccactacttaccccttcagggtattttctcaaatattttgaccgaagtgcccttgtcttcttcctctctcccgttcatcttctccccacccttatcctcctagaagcagcaactcaggtcatagcagcaagcaatgtggtcaggccaccggcgacggcatggggcatggcagcgaacaatgaagttctggcggatctggagaccacgaccacctgaacaacgccgcacatatcctcccggccaactccgtcgtccaggacgcgaggatgggggcggtaggaggagcagccacctcctgtggcgaggatgggggcgggacgggcaggggtagggaccttgaggcgaggtagtgacgaatgggatgggatcgacagcattgggctggtgccatccatcgttgtcgccatccataagctcaacttcctctgtcgtccacaagctcaccggcgacaatagtccctgccttgctgacaacctcaacaggggggaaggctggatcttgaggaaactctcccgtgcggcgctcctcaccaagatttaacccgacaaatcaaagaactcaaccaggagaaaaaaaaaatcaaagagcaacccctaaaaaccaggagcaaaaatcatcacaaagatttgaccaaattaatcaaacaagaactagagcaggagcaaaaatcgtaaggaaagaattcaaagaaaaaacaaaaaaaataaacaggaaaaaaaatcgtggggaaattctttgctctctgagccgtgtcctcctcatggatgcaacgaggttagaatgttggatacttgatgccacctgctcggcgccctgccaccgccgctgcttttgcttagagctgcagctccatggagaacatgaacgtgggtgggagagtatgggatgaatggagaagataggggtaatatggtccaaaagatttagaaaaagcaatgaaaaggtaagtagtggtatattaagagggttaattggatccatgccattacaaatttgttggttttaaaaaatatcattactgttcacatatttgaagcaatgccattacaattttataactattggagatataccactacttatctattggatgtgtttatatttttttttaccaaattatcctatcttcttcctttccatctctttttccatgggaacacccaacacaacagtgatgaactcgttcaagttttcaaaaaaaaaagaaaaaaaatcgtgcaaccatcgaaccttcggttctcgtcgagtaggtagctgaggacgatgcaggcgagcaacagcggcacaaataggtgcgaatcaatcaatccatcaccccgagctccctcttgctcatgccaagctaacacgagaaaggggacaaatccaagaaaatcacccgggattgctgttgctcgagaaagtggggggaatggattggaaatctggtattcgatgtgaacaaaatccaaactttttatccctctcgtgcccctctcccctacccttatagaccaaaaatgttcctgtaaattcatagggacaaaacagaagaaaaatccttgataacagtttcctaggcgtgtctgcctctattgctgcttcgagcacaagaaagttctcgcgtcatagctaggtggcggatgccttccgtgctgtcgcgctccaagagcttcaccctgctccatccatcgttccgccgccagtgagacagaggatagaggttgagaggggagggaaagagggatgaagaaagaagacgagggtaatttggtccaaagaaaattataaacacatctaatgggtaagtagtggtatatcttcaaaagttatgaaattgtaatggcatggctccaaatatataaatagtagtgatattttttaacaccaacaaatttatgatggtatggatccaattaacctatatttaaaatagctgtgaagttatagtggcatggttccgaatagatgaatagtaatgatatgtttcaaaactgtaaaaattataatgacatgactgtaattaaccctttttttaacaataggacgagatacgatggttatgaacaatgttgcacataattcttaataatctttttaactgaagaaacaagaggatttgtgaatacaagaaataagattaatgaaaaaacaagagcattgtcaacatataatcaacaaataaaattgttgacataatatttttcatcctctaacagaagaaacaagatgatttctcaacggaagataaaggatggaacaagaacatttctcagcatatgacaaataaattgaaggagcaggaagacccgctcaataaccctgctcgttttttaccatacaaagcatgcatccattcagacagaaataatttagtttagatgaataatagtttcactcacaagcaactaataactgacaaagacaccgcttaacttgatcttacataatacttaaaagcatttccattatcattgaacaatagttatatggaacttaaggcacccaaaccactggtcaaaatctgcaattaaaaatgcactctgtcgattaaatgggcataattcaccaaaccggtttgagcttccaggattattgtgcatttgtatgttgatagtccttcacagaactacagaacagaagagacccagcgagaatcaggctcgcgagtacaacatcataaatccactggaggtcttgatgctagagtccatcgcccatggcgtgctggtcgtggcgtggccgcacttctccgaccagttcctgaacgagcggctcgtcgtcgacgtgctcggcgtcggcgtgacgacgcccgtgctgctgctcggcgacgaggccatggcggtcacctgtcacccggggtgacgtcgcgcgggcggtgatggcgctgatggacggcggcgagcacgccggcagaggaggaaggcgaaggagtacggggagaaagctcgcagagccatggagaaaggaggctcctcgtatgaaagcctgacgcagctgatacacagcttcaccttgcaaggagccaaaaaagctctataacagtagaacagtggaggtgcaaacaaaagcacatttgaatccaaaagttgcactgtttgctgaatatttttccattttgttggcatcagatttgcactgatttactccttcaattcacctttttcttattctgaagaagttaatggataatgtaattctagtagtgaacagactttcttcatgatgtggactgagaatcccagaaacgcggaggcggctgcggcggcggcgggcgcggctgggcgacgtggcggagctggagagcgtgctggaggtggtcaagacggagtcctcgagcgcacgcgtggagctggagctcgaccgcgcaaggaggtgggcgacgacgatgccgccaacgccgcctcgcgccccaccgtgcccgtggcgcgcgtggagcaggagctcgaccgcgcgtggagttggagctgctcccggtggtgtgcgagggcgacggcgtccgccgcccgccggacgtcgcccacctctccatcacgctcgccgcgcccccgccacgcccatcgccggccaccaactcgccgctccacatctgtgacatagagattgagaggaagaggggaagagagagagagagagagagattgggaggaagaggggaggagagagaggtcggagagtatgacaggtggccccaccattttttaaaaagaaatgctaactagattgccacttgcataccacgtaggacaatactgctttggattggatcgaagggggttattcatctagtatagatagttcagggtataaaatgtctggttttgtggtttaagggtataattcatactatcgtaatagtctggggggttaattcgtactttttctttaatcaaatggttgaggtttatttctactaccaccataattaacagtagtagaaacgtggaggggtagtattatctaagaaaaaagtatgcacggggtataatcgtaatttatcgctcatgaaccctagcaaccacttttgtcgatggattttgccgccgcccaaaacgaaccgcttccaactcacttccgtcgcctgtccccctcccttcccgcctaagccgcctcccctaacctcggcgattccaccgcctatgttgctagtttcttagaacaagtataataggaggctgtatgtcggctaaatgcttaggtggaggagagaagataggagagagaggagtagcgggctgtaaacttacaactgacttggacgcaagaaccaagaatttctgtgagagagataagtggtcatatattaattgtaaatagctaactattatatgtgtgggctaagagaaggctgaaaaaaaccttaggccattcccaaccccaagacactagacatggtttccataaacttcacatcatcaaaaaactagtactagacactacccttccaatacaaacaccactattccatacttaaatttaatactacttatctcacatgatgtattggatgttgtgtagaaaccatgtctcatacaagacatggtttccttctctttcctcatttattcacttgccacatcatttttcatcctaggtgataatttatttaatgctatggatactatcctagtcattgtgttaggaatggccttatagccaacaagtcggttgtattattagccttgctcttaaatggaatcgatatgtcagctgtagagtgcagagctcatgtttcttaaatgaaaccatcttttctggtggttatactgatacagtaagcagtacacaaattttgacaagaggaacgaacaggatcgcagccatcttattacgtagtattgatagatctgtcaaccgctgtcagtttgagcatgtagcagccttgccgttattaacctgtgttctaaagaatgggcgtgtaaatatgagaactccacgtacagttaaaaatatgcatattccgggaggttccaccattttcaggtgcaggacaatcacagtcaaacacagtccacagggcatgttcagcactatctcattttgcaagccgaaacgtggaaatgaacaagcatctcgcttacaattacagatcataccatttaggacatgtttagttccctaaaaacttttcgtaaaaaacatcacaccgaatctttggacacatgtatagagcattaaatatagataaaaaactaattgcacagtttgcatgtaaatcacgagacaaatcttttgagcctaattagtccataattagctataaatgctatagtaacccacatgtgctaataacggtttaattaggctcaaaagattcatctcgcggtttccaggcgagttatgaaattagttttttcattcgtgtccgaaaaccccttccaacatctggttaaacgtctgatgtgacatccaaaaatttttatttcaccaactaaacaagcccttaccttgcataatactccatccatcccaaaaaacactcctttccttggttgagtttttttttttggacggagggagtaaatagatcacaaacagagtactaactgataataatctatacacgagcatctctgaatattctcaccagcttcacacataggactgttgttttccatcaaccactagcttcagacattcgccatataggactttttttttccagaaccactacgatctgtgaatcttggtgctcttggagaagcattcgccggcggctgctcccagtcccagcttcactgcctggagcgtccgcccccagatactgttagcaaagtaacatcatttatggcttgaggatacatcacaactgaagctcaatacttgagatgactgaaattgcatccttcacaaagtgtcccctgtctaaatctttatcatatatagtttcttaaataaggttaataaaagaatcaaggtataatatcccagtgtacatcacaattgatcatatataggtcttttcagagctatctaagcatagaaactgaatcagttcgtgcataagaagaaaacaaatgtctgctcattaccaaggatttatgctcacactacattgctattcgaacatgaacttgggttgaaaataagaatttgtgaaaaaaaaatggaacgttaattggtgaaaaatttaaccaaatattttcaatacacactgtgatcagactgccaaaactaatatactataaaactaccatcgctacatgctgcaaccaaagtttgggattaattgttctcaaatgaaacacagatttccttcacctaaaaatgcagagctaatcccaagcaactcactgttggccttgcaattatcttagcaggtaaacaatgttaaacgaatataaggcaaatcaataaaaaaccggacagcaaacctgaggatgtgatggcaagggttgttcttcgcagtactcgtcgtgcgcacgagacttgcacaggaatggaacgaatcggcctccgaggttggcgccgccgcaggtctcggccgcacgcggacggggatcgtgaaggcggcgccggaattcgtcagagcggcctccgaagtgggcgctgccgacgcaaatcgggcgcacgcggaaggcactgcgcgcgcatccaacgccagcggccggagtcgcgctctccacagcagtcgctcctgcacgtacgcacacacggcggagaagtgggttgacgccgattaatggaggaggcgaagaggaacggaaggagagggggcgccggagagtttcgccgtcggcggaagggaacgcgatatactcctacaagcgcaaccgttggccggagtcgcggatgaggaagcggcgactctgctttttggattcgggttttgataaggccgtgggccgaccggcaagggacggaaataagtctatattaggtccctcgggccttcagaagcatttacaattattgaatgtgtttatttctaagcaaacctaaaagaaaggattttctttctttttccaattaaataattattaaatgatgtttgtattattaaaattagcaattaagctctgaaaattctaataaaatttcaaagagcgtaactaatcattgagaatttaataaaattaaatttaacaatgtcattttatttctcacacttgctttacttgtaaatttatttaattatacacatacctacttaaaaataccaaatatttcagtgaatttgtattttaattaattgtatatttttttgatatatgcgcttcccggtgcaacgtacgggcacttttgctagcctatccttaaataaaaataaagggttcagattagttctaccggtagtattatactatgcaccgaagtgtcgcccatatcaggtaagcgtgtaagctttgtgtcatttgttcagtttgggtagaataatcaaatctcac

SEQ ID NO: 64008 - DNA, 5959 bp, Oryza sativa
  unsure (1)..(5959): unsure at all n locations
cacgcaatctgtttagttagtttttttttatatttaataccctatttatgtgtcataacatttgatgtgataaggcgaaaaattttgccagggtctaaataggacctaagcttattttggaaagcatatgccctgctttgtgacttcttgtttcatattataatattctgctaatgcattcctttacgaattgcttaccagtaagagataattcatttcaaagggacttccgtaagatatcaacacattgaaataacctcatacattctttgacttgtttctccaattcgcagggtgcaagtgttacttttgatctgctgttccttctggtgattggctcctatgtaaggctctcatcttttggcccaatcaacatataccaatgtcaaaatttaattttttaaacttaattttaaatttatatttgatttttttatcatagttttcttttacaatattatgatttaagtcgttacaaacataaatgtaaaaattttaatcacaaattattttattttgctaatatgccaaattttctgcatatagccattcgatgaggcccttattctcttcaatttcgtagtaaccgctgcacgggtatgtatcatttcatgagtcttcgagtatggacaggaagctttgtttttcctgcagttgagaacttttttttttcctgaacagggtcctgaagatctcattaacatattctggcgacctccgtcaagcaaaatcaaggggcatagggtagattgtgctctgtgtatttatacctcgtttagttggagaaaattttcgtgtttaattgtcatatcgaatatacggatacatatttaaaatattaaacgtagtttaataacaaaaataaattacatattctgccagtaaactatgagacgagtttattaagcctaattaattcgtcattagcatatatttattgtagcatcacattgtcaaatcatggcgcaattagacttaaaagattcgtctcgcaatttacacgcaatatgtataattgatttttttcctatattaaatacttcatgtatgtatcaaatattcgatgtgtcagcgtgaagttttttttttggaattaaacatggcctcttatccagaaacgcgatgccagtagagctagacaccaggatggcaggcgagacgaccccgctctccgcagcagattgacttgcaatttcaaaattttcttgggctgtgtttagtttcacattaaaattaaaaaagtttggttgaaattggaacgacgtgacgaaaaaattgaaagtttatatgtgtagaaaagttttgatgtgatggaaaagttgaaagattgaaaaattattttggaactaaacacggccttgttctctagccaatgttaggccttcagatactgctgtattttgactggaaaagttgggttttattttgggtgaatagctagattagtcctcaattttcactggaggcacaattnggttctctatattttattttgtccacatatattccctaagtatttatnttggcttaaaatcatcttggcccaacataatattctatatgactatttctagtcaatatttatattagaaaatgtcccttttgcccttaatttgtatacaagtatacactagaaaaagagaaaatcaagatgaataaacaacattgcatatgtaattcccattatttcaatatgtgcacataaaacttaaacaatagctatcatatacacttgcaagtacataatttatttttgctttacataaattactatgtattatctataaaaaaacccattgcatgtaattttttctcttatatatgtaaatgggggatataagtgtcatttatcaagagagttgttggttatgtttagccatatggcttctaagtgggtctaaggataagtttgaactaaaatgaaaacctgaagaactaatatggatagattaaaacatcaaggattaaactgagtctcggataaaacttggaggaccactttaactactcacactattttctcttttattttactgccttttaatttgctggtgctcgccattttggctactgtggaatcaaaggcataattatcctgttagtatatcactgcacgtctaatatgtgcaagatgtttgatttgtactagcaacttttccatgtattgttggcgttcctcagaacgtgggatggtaaatatggcgtttgtttcactgtttgctcaatatttgcagaacaggcatcgacaatcttaactggtaaagcgaaatgaaatgatgcaactgaacgctgaatcaacactatactatactgaacttaaaggaaaaaaaagaaaaaaaatacttctgtatgtagatgatgcttgagcaaaaggtataaaccatacaaatcgacgatcgttttattttaggaaggaataagttcacttcgactctcttaacttgtggccaaatctaattcatattcctaaaccacaataccgaatatgttgacgcctcaattgttaaaatcggtgcaatataactctctcggtagttttggaggatggtttcgctgacgtggtgcctatgtgatggtgttgacctggtcattgttctacgtggcattgatgtagcgattatatgacattagaactaaaatatatatgtgtgacacatttatcattcacactacaaaatattgtgggacacactaacatgtggggcccacatataatcctctctccttcctttcttcctcttccctcctctctcctcatttttctatcccctttctcttccccttcagacctactccctcgtcctaaaaaaaacacaacctaggatgggatgggacataatctagtataacgtatctatgtccagatacgttgtactagaatatgaatatgtcccatcccatcctaggttgtgttttttgggatggagggagtacgtgggggagcggggaccagatcaatggcagcagaaggaatagcggagcggcggcggttggaggcgagcttccactaggacacagcagaaccaagggtcgcggtcgtgcggctaggacgacagagccaaggaggacggtggtggctcagcctcatggaggctcacggcagcaggaggacgagggtagtagcagcggtggatggtggcgagctctcaccgggctgcagtcgaacaaggggcggcgatcagcgtctaggacggtggccactcagcctcacgaaggacgggcggatgagtttctccgcagcggccgcgaagtaaaggccaacgacttcgttgaggctgtcgtcaagagttgaggtgatagtggcagcgtctcgactgtcgcacatggcgacgtccatgaaccgcgagatgagatcatccttgtcgcaacggatgacctaaagaggtagtcacaaccgtagtcgtcgtcctcctccttatcggcttggtggtggtcgtaacccgccgccgccgccgtcgatccggtccctgctcatacctggttaaggtcgttagcttagcataaaatttccctattgaagcacaagagagggagaaggaagagagagggatgaggaagaagggaatgagagaagatgacaaatgggtcccacacatatatttttaattttaatgacacataagcgccacatcaacgccacgtgtaactaagacaaggtcaacaccgccacctaggcgccacataagcaaaatcactctctaagaccgtcgagggagtcaagttacacccttttaatagttgtggttcaaggttatgaatcagattttgtcactagttaagggagtcaaagtgaacttattccttttaggaaacgaggggaatttgctgggaaaagcggcccagtcgaagacagaagatacagacggcccagtctggcccgtgaagttggcacccatatatatacggacgggatatctcttttttcctcgttgctctcctccccctcgagcctaaaccctagccgccgccacgagcgcgcgccttcgagcaaccgcagcaaggccatggcgcgccatggccttgctgcccaaggagatgcttcgtttggccttggccaggcgttgcaccggggtcttcatggcgaggcgtaccatcctcttcaccgcagccgatggaggggcgtcgatgatgctgcagagggcgaggagctctcacgccattcgtcaggctcatgtcagccgcgacttcgtcaaaactactatatatataatacccatatggggcaccatggtgcccgggcaccatggtatcaaaacaactcaaactcaaattcatttgtatgaattcgattcatacaaatacctaacaacaaaacaactcaaactcaactttatttcacaattcattattatatacctaacgaattatatgtttggatgttatatacctagaaccaaaatctaacaaaaaaaaagttcaaactcagttcaaacttgttagtaaagaagttaatgttcatatctaaacatttaaaaaaatttcatactcattcaaattgggtatatactcaatttgaatcttggagcccatactccatgtagcaccagttatatatatatatatatatatatatatatatatatatatatatatatatatatatatatatatatatatatatatattacatatatatatataggacactcatatggggcaatacacaaattcgcccaattttttcaaaattttcaaattgagagtatatatctagttatatgtattcgatacatatatatatatatatatggggggggagcggcagcatgcccctatctacatatacgaagatgcacaccaattgcacaggaaagctatgggccagttgtaatcatatctagaggcccataagctccaagccaggcccaataatactgtgcgcggttggaatggatagagcgggggggaggggagtagaggcacaccccccncagtaagaggtgtgctagggtacggtatcccgtccaaacaagatactttatattgatgatgtcagctccgcctcagctttatccactcatgagtccacgatttagcaccgccctacacgctcacgccacagccggtgaaagagcacgcgtgaggcgctagaacaaggacacgacactaatagtggattaggtgacaaagttggtccctgcaatagcatgatgacccttgtatcaacaccacattgagaagaaaaaggatggtgatagtgaaaggaatggaaggagaagacgagacaaaacgctggtggtagatggctcaccacccagccaagaggcaacaacgtacgttctctcccgataccttgatacctcgtacttagtacctatgggttatcggttagcacctataggtatcagctggtacccgagacatcaaccatgataccataggtaccaggtctgaaacctgtaggtatcaaccatgataccacaggtaccagatctgaaacctgtaggtatcaaccatgataccattggcaccaggtctagtacctgtaggtatcaaccatgataccacaggtaccagccctgtgtaggtatcaaccatgataccacattaccacaggtaccgtgcctggtacttgtaggtaccagctaagccatggtgatatgccgcacacacgacatacctgcgcacaatgtcaacaagcagccaatgtctgcagcaccacgtcgattgtcaatcgaaacttcagatctagcaccttcatttgtttcccctccatcaccactaacagtagcgtgggaggaggattcgcatcgatcggcatcctccccaacggcatgacaccgaggtggaggccacgggggctagtgcgatccatcacctcatcactgacatggctcaagcggatccaatgatggaaaggccctaggtatctccagatctgatattggcagcgccctccttgactctttgatggtgaggggggacagagcaggagggtaggtgagcaagagaaaggagc

SEQ ID NO: 64009 - DNA, 10840 bp, Oryza sativa
gttcatcccttttcctcttcttctctacccataaccaccctaggtttaggcctgctctcttggtttcttcatcgattttgcttcttgtagccgtgctccgttcctagcttgcagttatctactaaactggcaattttagtggattatcgctctcttgtctggtgattcagtctgctcgaggaggattattagggtttaagtccgccatcgatctttggcatgcaactgatgcaatggggattttgatctgtactttagtatggaactaccaacatttccattcgcacaagttctcacctctcaactatgtatcaactatggtgatgttcatttgggtaataggacgagggacagggagggactggttgaggggatagacaagttccctaatccctattcttcttggatttccttcacaattcacaaactttgtattactggtgcctgagtaaaccatcatccctcaaaataaatagtaaaccatttactctatgaaatctaaacttgcagtattgctaagcttcatttcgagtttggctgcaaaaatagtaaaccatttggaatacaaactttgtacttttgcagccaaatttataaacttgccttttcttttccacatcaaatcctcaccttttggatttttcagcaagtaataaattatttgcgaaaatagtgtgccgagtctgttcatttggctgcaaaacaaatcttgatgcaccatgaagcccatcagtgctacataccaagtagggccaaaggccagtagggttagatctaccacaattcctaagctactacatctgccttctgccatctgaatgtgcatatcatcctccaatccactttctttccattcaccattccaaccaatcgacacaacaacagcagtagcaaaggtatgagaattgagagactctatacacagctcccattcacatggctcaaaatcagaacaaatcacaaatggtggttaagaaaaaagtagcaggaggttagtcgaagctcgatgaccggctccagtacccgtcagctgaagtgtccatggtctgttcagtgctgcagtgcgagagggtgtcatcctccacgcccagcaacgcgaggttcaggtgtgactgcatgtttgagtcaggagccgccacagcctcctcgtctgatccgtcgaagctcgcggtgacgtgggaccttgcccagtggtcagtggatcgtttcgtcatctccttcaagcagtttcaaaatctgtgttgccagaacatagcaagttgaggtcaatcatcaagacattttttaagtattttgcacatgtaatttgttcaggttcttacctgtgacatttccggtcgggaatgagaagatgtccttgtgcatagcaaggctgcaagagtcagtcatcagctaaagaatggaggcctaatccaacatcatcctctccatttcgtcacagtcataatcatttcccaagaatggatcaaccaattgtttaatttccccacttgatagtaatggctttgcctgaaaccgtcaacatagaattagcaaaaagaaaaaataattaataacttgctcgtgcaagagtgcttgtgtggtcaacagagcaaaaaatgcagcaaaaaattccaacagtgcgtgaacgtgcaactaccattttgttcttggctcagggcatgttactgctcagagcaagccagctaggcatatatggggttaaggatcactcacccatccaaccaggctttcctgaccctttgcacatcctgttctaatatgtcttcttcctgaaataatctccagaaccagaattacaactccaaatgcatagacatcaattttctcattgaccttcccgtgcgaaaaatactcgggagccaagtatctgtcactggagtagtttgcttaggcatttcacacttgacaaaagtagcaatagcaggtaaaaatagcatagagatggtacttacccaaaagttcccgtgatgtcagtacatgttaggcggggagttgaagctgacacttgctttgccaacccaaaatcacaaagctggaaatttcaaaagagatgatgtcataagcagaatcaaaattaactagtaaggctaccaaatactcaatgcaattcgtcactgctaacgcattaagacacttgctttgatctgaaaataaatatttactgtactgagattgcttcaggtatttcagtatttgcaaatctcttgtgattatttacctgtgcctgaaaatcctctgagaggaggatattcgaagacttaacatctccatgaatcacagattgggtgatacttccattatgtagatattcaagtgcctttgctatgccaattgctattttgaagacctcacctgccactggtgctgcctatccaggcatctaggcttatcgtttgtgattttatttgttaccaacaatgtgttggctgacttatcttcagatcagtttttctttatgttgattttttttcgcgaacacgcaaaaagattgcacgtcaatatattagaggaatagagtttttgttacacactgcaattggccagaccggcttatgccaaggaaggggaaaaaacgcaaagtcaaaaaacaacgaagagaaaaaagaaaaagaaaaacttgaacgctactctaaacaacgggagggggcagagtcatgctacactcccaacaagtccctaaaggaagcaacgcccgctaacgaccacaaccggccctccgacaggatggactctaggaccactgagaccgaagagagcgcagagtcaaacaccccggagttatgttccttccatagctgccacaagaccaggaggaccagggagtcgaagctggcacggaggtgatcaggtaaaccagccttggaagatggccaccagtcctggagccagctgccacggggggcgagagggcattccagccaggaggcgacagcacccgtaaccagacctgacgagcgaaaacgtagtcgaggaggatgtggttcgctgtctcgagctcttgagcgcaaaaggggcaggtcgagtggctatcgatgctacgcttttggaggagatcagccatccaacagcgctgctggaatgcaaaccagaggaagaatttgcatttagcagggcctttcgcgttcaagagaagatcgacacaagcaaaggagtgctggccaaggaagacgcctggtacgccgaatgcgccgagtagcgctggtcactcgtccaacgccagacaagacgatcctgttaacgaccaaatttgctaatccagggatcagagatgaggaagaaatcgagaaggaatcaagattgaaatcattccggaaacagagtaaggatcagctagaatctgaatcggctacgactgaaatcggcagagttcggtcagatgggttagccgattgagccaaatctgacagcatgacatggcatacgttgtcggtttaggttgatgcacttcgtgatgattgccgcacatggatagagtcctaagaaggcaattgtatctattaattaggatattttatgtaatttccttagagataagtgtgggcaaaagtttgccgcaaatacttatggtatcttagagtttgttagagataagagtcgtgtttgatatggacatgttttgtaattctcgggtataaatagaccccgagccccatgtaatcaaattaacacacgttcaatacaatctcggcgcatcgccaccctttttactttcgtcttgtttcgacgagttcttgctttcgggttgagctgcatcggtttcgatcttcaacaagaggtaaaacttgttatggtggcttgcgttctcgggattagtgcttccatctttatgatactctaatcttgtttatgtaatttgtcgagttatcatatatcttacataatctccggcaatatcgctatctaacctataatcggctaacatctgtcggaagagggcagccgattaggttagatatcgatgttgacttagattatataggatatccaccactctatgaaacttccaatggcttgattgtctagatattgtcattcttttcatacttatagctgcatcagttgagtttgatcttataagtcgtgattagaatctcaatctctagcctgcttcttggttgccgattagggtagtatcggggtttcagccgatcttacctgatttaactatatttactctatatgcttcgctgatatgttaaatctgccatttatattaagatcttgttgcatttaagtatattaggcctttgtttaatatatcctatttgctttgatatcctagtatagagttgtatcggaatattagccgatacatgctagatctatctgatcggctatgctatgaacgtatatagtcttgttgttaatatatattttgatctaagtgatttatattgtctcggcatggcgaccaatctatcccaatcacttgatttatgtatatatcgacacggggattatatattgttaatatctacagccgatcgagtagatttagttcttccttacttatttatgactgccgatcgatgcatatgtgacatcggctcaaagataaatgatatgtcatcggcacctagccgatcggctatcgtttatggatttaaccgcggtttctttgtctttgtttcttgttgattgcaggatcaaatcaactggcacgctagcatacccgaaggcgagttttggacctgcactggagttaagtagatcccccaggcctcgtatttttacgtcaacagatccccgacacccggtgaaagttggaagtgaagcaccgcgtcctagacaagaagaaactgggagatgcccgggacagtgagggccccgcggatgtcagaaatccaagcgttgttcgccaggccagaagaaaccgtgcgcgaaccacgcagacgcgggggcacaacgaagaggagatctggagccaaggaggcaacagagcggccaccgatccattggtcagaccagaagagaatcgactcaccatcacccggcacgaagaaggtggacgcctgaaacatgtcagtgacggctcgctcggctggggctttcaggccgtcccagtaaggattccctgagtgttggagccaaagccaacgaactcacagggcaaaccctgccaacttcaggtcaggaattcctaacccaccgaaagctttgggacgacagacattcgtccaagacacccggcactaccctccatgagccgagtctgtacccgtccacaagaaggcgcggcgcttcttgttaatggccttgatcatccaggcgggaagaccgatcaccatagacacatggaccggaatggaggagagaacagactggaccagcacagagcggctaaccagagtggtgagttgtcccttccagggcggaagacgatgggaaactttgtccacaagaggttgcagggccgccttcggcaatttgcgaatggacaacggaatgccgagataggattagggaaaatctgagattgagcggggaaagcaggactgcaccaggtccaggtcctccgccgaacagcggatcagagtaaccgaacacttggcaaagttagtgcgaagcccggatgctgcaccaaagatagagaggataccctggatgaattcgagatcctgacgaaccggggagaggaagagaaccaagtcatcagcgtagagggaggcatggtcgttgagcggaaggaacccgcctgactcggaggctttgcggagcatcgtattgagcacatccatgaccagaatgaagagcatgggagagagaggatctccctgccgaagaccgggaaacaaggccccggcaccccattgatcagcacccgggaagaggaggcaccaagaatgaggaaaatccaatcacgccagcgctgactgaaccccaggtgggcgagcatctcaagtagaaactgccagctgaccgtgtcaaaagccttggcgatgtccaccttaagaaggaggcgggggatatgcttggcgtggagagccctggccgcgagctgaacatagcggaagttgtcatgaaagggatcggcctttgacgaggcactctgattgggcgccacaagctcgccaaggtgaggagagagacgggaagccgggatcttggagaacaacttcccaaagctgtggatggggctaatcggtcggaaatccttgacgtcaacagcctcgtccttctttggcagaagggagatgagggtatcattgagggaggagaacccccgaccgttagcgagaaagagggagttgagagccgccatgacctctggcttgatcaccgaccagcaagtcttgtagaaccggcccgtgaacccatccggaccgggcgccttgtcagaaggtaaggccttgaccaccgcccaaacctcctcctccgagaaagggttgtccagccccccaagatgcgcagggcagagaccaagggagtggaggtcaagggcgaaatcgcgctcaacagacgtccccaagatagcgccaaagtgagaagaggcaagctcctgaagctcatcgtgggagacggcaagttggtccccatcttgaagacgtgtgatgaagttcttccgccttcgggctctagcgtgcaggtggaaaaacatggtgtttctgtcaccctccttgagccagatcagacgcgaacgctagcgggctcgagcgaggcaagctagcccaaggcacttcagtttcaaatcccgctgcaaccaagtctccagggggagagagaccggttctcttgcgcgacgtcaaaccggaagacgttctccttcgccatctgcagttggagacggacgctgccgatgtgacggtcactccaactcttcaggcgcttagccgtgttagcaaaacaccatgccagtgcggggagagggggaaggtaggaaaatctgtgttgaaacagattgccatgctaccatgttgtgctgaggattatctatgttctactgattcatcagcgtcaccaaagcaatgactaatatgatctatttagtgctgcaatttaaaagttcaattattgtcacagtacactacacactcatttaactctggcaattacgcagtgtagagtttgtaattaaatgcataatgctccaattgtctctttccaacctcctttcgaaaccgaaatgaaggaaatgatgcctcagtgctcagtgcttactttagtactctctattctatgaatttagacacgtaaagcacatatatacatcaaaacagccgaaattctgacaaatcgacctttaataaaatttattttgaaaatagacccaaaatattccttacttccctaaatgtttgacgctgttgactttttaaagtatgtttaaccatttgtcttattcaaaaacttttgtgaaatatgtaaaactatatgtatatataaaagtatatttaacaataaatcaaatgataggaaaagaattaattattatttaaatttttttaaataagacgaacagtcaaatatttttaaaaaagtcaacggcgtcaaacattttgggataaagggagtatgaatatttacacaatcttgtcgccatagagcaccgtgaaggctatgtcgtcctcgtcctttgaattggctgaccgtccccgccgcggccgcgtgaacggcagcaccagcgatgccgtgaaccgcgcagacatggaccgccggtgagacgacgacgaaggcgacggcgtcgtcgtcgaagcgagaatgttcgcccccgtgtcgcagccgccatgggacgccgcggctgcaggaggaggcgcgaggagcctcggcgggagcagcagcgtcgatgctgccgccggcgccggcgccggagaagaagatgcactgctacttccgacggcggcgccgccgccgccgtggtgtggttgctgcttcgggacgcctggctggagctcccacttgaacgggatggtgcccggcctcttgaacgactcgtccaacgccattggcgtcaccaaccagagcttgatcactcgacgtttaattcttgcgtttttatgtgcagcgaaagccattatttgcacatggcacctcgctttcttggaaattttttacaggcaagcgacgtgcacatgcaagttaattaccagcgagaaaattaattgcagtggctgttgacagcatcagtacagtcgatgagagtgattagcagtactggtaatcactaatcgctcttgaataaataaaacgatcgtgtttacagctagctgcttacagatcggaccatgcaattagcaaccatgcatgtataaaagtagtcaagtagaaggttcactgtagtggtgctgcgtgattttggcagtcagaattgagaatgtcacacaatcacaattaatgtgcggatcggtcgatgcatacgcagatttgaacatatacgatcgggattaaaacggtgacggaaattcccaaccaaccgtccgagcatcgtttcagtaaaacatggtattgtttctaactctcatcctatataaaatttagtttagcattgtatatattataatcagccctaaatattacctctgttttaaaatataagagattttctcatataattacgtgcacagcatctcttatattatattttaggacgaagtaacaattaaaatgggtaaatatggttcattcccgatcaaccgataataactgttctgtagagttgcaatttagtctccaaacgggctgtttgatggaaagttcctctctcttttttgtgaggacttagctgcaaaatgacgagcatgatgcagaggaggacaaataggaagctatcagttgatcaatccagcgaggaacaagctgtttgatggtgccattcagtatatttatgtagtagtaatgaatatatttcaagctgccttgcttgttgtcttgtgctccaaatgtcatcgctccgataactcagatcaagttcgctggagcatacttattatcttagatagtaggaatactaggcaccaactcttaataataaataaatggatacatcatacatgatactaacaggtaatagcatattatttgctgcttctcctagagatcactccggaacatatctatctggaatcatatgaactagtgtttttgtcttcctgaggactttgtttttggaggtcttgttgagaggacatgggccggttactaggttgggccagatcagttgcagttgatgatgggcaaatagctaggcccaattgttatccaaccgcccagtgaactgaggcccaaatgatcttgtaacactcttctcagtttgatgatgtccattttcacagcactcctactagaaatatctgacccccacgatctatactattgcaccacgtttcaacaaatcctctctatactattagttcccccgaattttaaaatcatctacttgtttaataaaaagaaatcatagtattacttataagtgcttattaattgatttaataagttagaaactcaatttgttttccgttgcaacgtacgggccacaggctagtcatatctgaatgatgcaaaatttgcaagtgttaggtttaccccagtagcatcctttgtattggaggtgtcctgaaacttcagagtttgacagagagacaaggctcacatgtgttgatgcgaagagagctccggtagggagcatgcggtgtcagtcctgtattcatgagactctggttttgtctgaactggcccagccattcctgtactgagaacagtacatcaagaacggcgtttcgtcatgccatgttacatttacacctggaactgcaaaccagatctttgctgtacagtagctgacaagatcagttacatcatatgtctcagtgagagagaaacctactactaatggtgtggctggccaattcacacatacagtatgtgtagtatgttcttcatcaaatggtggtgttagatgagcatctgagacagcagcctgtcatggcatggcatctgagaggaaaagcaaaacaaaagcaacttggaaaagaatcaaatcttgatgcaccatgaagcccatcagtgatacatactcctaccaagtagggccaaaggccagcagggttagatctaccacaattcctaagctactacatctgccatccgaatgtgcatatcatccacttcctttcaatttgcattcaccattccaaccaatcgacacaacagcagcagcaaagttatgagaattgagagactctatacacacagctccccattcacatggctcaaaatcagaacaaatggtggttaagaaaaaagcaggaggttagtcgaagctcgatgaccggctccagtacccgtcagctgaagtgtccatggtctgttcagtgctgcagtgcgagagggtgtcatcctccacgcccagcaacgcgaggttcaggtgtgactgcatgtttgagtcaggagccgccacagcctcctcgtccgatccgtcgaagctcgcggtgacctgggttcttgcccagtggatcgtctcgtcgtctccttcaagcagtttcaacatctgtgttgccagaacatagcaagttgaggtcaatcatcaagactttttaagtatttgtacatgtaatttgttcaggttcttacctgtgacatttcgggtcgggaatgagaagatgtccttgtgcacagcgaagctgcgagagtcatcctctccatttcatcacagtcataatcatttcccaagaatggatcaaccaattgtttaatttccccacttgatagtaatggctttgcctgaatccgtcaacaaagaattagcaaaaagaaaaaataattaataactcgctcgtgcaggagtgattgtgtggtcaacagagcaaaaaaaatgcagcaatggtcctagacagcttta

SEQ ID NO: 64010 - DNA, 3873 bp, Oryza sativa
tctttgcccctgcttctgctgcccaatgtgttccttgttaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgttgtttatgtgaatctccccctgctgttgctgcccctgtggcatatatacccctactgctgttatatggccctgctactgctcttattgctgctattatatggccatgctgttgctactgctctaatttcctgtacttgctcttttctttatggataagaacatatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccaaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccaaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggatgaattggaagtcaaagctcttcaccgagtttgtcaacccgccggcaatcatacgccgttcgatcaataccctcaaataaccgaagcggtgtgggaggaattctgctctctcaagaccacccaagagtttagggaatcaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgtcgaagaggcgcgaagatgacatcctcacaaaggcgctcggaaccaaagaacatcctggccgaactcggagaattagtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccatccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccattcctatcatcgcctgcctatataactataggttttgatgacctcttcgaccttttcaggatccggaagttagacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggtttcttgatccatccatggtgaatgaggttaatttacgacagagcttcactgaggtggttgactatgtcaaccggtgtttatgggcccatcaagacaaggagtacatcatgtgcgcacataaccaagagtaagaggacaatacccttcgtgtatattgtttttgaagttaaggttctt

SEQ ID NO: 64011 - DNA, 911 bp, Oryza sativa
aatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttatcatttattttttttctggaatcaactcatcagtgacggttcggaagaaacatccgtcacaggtaacctcacctgtgacggactcgcaaacgtcggaccgtcacaggtgacccacctgtgacgggcctttactttcgggcccgtcacaggtgggtcaccctgtgacggctactatataccggagatcatcacctctgacgggcctttatttaggtgctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgataggagaacttctggaggtacccgacgcggcggccatcggcgccgatcacggccttcttgccgcctccgacttccacacgctctcgccgccgaccgcgcgctgccgcctcccggaggccttgcgcttgctggtgtagcgcggggagcagaagaagtaccagacgctgccgctcccatgggttcccggcgccggtctgtgctcgccgacgagctccgtcggatcggcggagtag

SEQ ID NO: 64012 - DNA, 8179 bp, Oryza sativa
catttctaaaccataaaatttataatggcatagatccaattaaacctaaaaaagaacaccatataccacgactacatttttttaacgactcgcataagacagtacggagtttatattgatagcagaaaaaaaaaacaatatcacaaccctggaaagattgtaactaggagaaacaaaaacaaacataccgacaccacgagttggcaactcctcacacaataccctggagaagacactattaccaagccgaccaccgctaagcgtgaccaattgccactaggccaacaaggggtttacaaacgcctcgccaaaacacctgcttaactccgaaagacaactgcttttactgtaaaagaacaccatgccacaactgtttttaatggatcaatattttctatgatcaataatagttctcgtgtcatggtgaaatcctgcttgatcagcagctgcgtcctcctccgttctccaagctgttcatcttctccaaatctctcatgaactcatcaaatgcaatctcagaagacccacctccgttgatggcatccagcgccatgtctctcgtctccaccaccctctccctgagcttcctcccttcctcggtctccatcaccagcctcaccttcgcctccacctcctccgccgccaccgccaccaacgcgccacccacctcgccgccgtcgagcgccacggcgaccttcatctcctccaccatgagcaccctgttcatcgcctgctccgcgtaaagcggccagcaaatcatcggcagcgccgacatgatcgcctccagcgtcgagttccacccgcagtgcgtcacgaacgcgccggccgcctcgtgccgcaccacctccgcctgtggcgcccagttcttgaccaccatgccgcgatgcttcgtcctctccaagaaccccgccggcagcagccgctccaggtcaggctccggcgatgtgctctgctcctccggcgggctcctcactgcccacaggaaacggtggccggagttctccagcccacgagctatgtccttcagctgcgccgccgggaacgcgcccttgctgccgaagcagaggaacacgacactctggcgcggctgcgcgtccagccacgcgaggcacgggtgtctctcgccgttcttgccggcggcggcgtcgaccagtggcccgatgcagtagaccctcggcgtgggcttgtcgggaacgcagacgccggcggcgagcgcgttcagggccttgggctccagccgatcgaagctgttcacgagcacgcccttcgcctccgccatccgcttgaactggtacagccggaccttggtcgcgtcgctctccttgtcctgcaccgtcgccaccatgtcgacggcgcggagcggcggcatgccggggaggcggacgagcgccatgcccatctccctgaacgacggcacgtcggggtagtaatacgggaggtggagcaaggcggcgagggcgctggcaccggaggggaagaagaagtaggcggggatggcgagctcggccgcgacgtcgagcgcgtcgacgcagaacgcgtcgagcaggagggcgtcggcggcgtcgggcagcgagcggaggaactcccggagcacggggttggccaggcggagcgcgtcgagggcgcgcctggccgggtgcgcggcggcgtccgggctgggcggcgccggcaggaggcggaacgtgatggacgggttggccgcggcgaggcgcgccgtcgcgtcggccgaggtggcgtcgttgtcgggcgggtcgatcaccgcgacgacgacggcgaggccgcggcggcgcaggtgcttggccatctccaccatggggttgaggtggccgacgccaagagacgggaacaacacaaacgtctttgtcctcatggctccgatcgatcaaaagggatgcgaaaatacgggaacaaatgctcataaatatagtgagagtgagagcggcgttgaatggtaagtaaccccatttcttggcaaaaaagccatgggaagaaagtttgacacgccataaggttatataaatattgctgtaccagaaaatttttccacatgagcttttatttaagttttggaggaattaattcaaaggatttttttctcagaagtctaatctaccatcacttgagtgagtcagcagttgagtgggctggtagacgaggaaggaaggtatatcaggtagtatcaggtagctcgcgtgtcacgttacggccgttctcgtcagcaatgactagaacactttgcgagtttttatttttttttaaaaaaaaggacgcgaatagtcgggcttttttttttaaaacattgtccgagcatatacagatcgcacgcaggatgccgaatagtcggtctttttttaatggcttctactgtatccgtcctataaggctataagtgaacttttaacctctaaagttctccacggagattaaggagagagcccattttctagtagtaacatttcaatcttaagagacatcaccattcaccaatgctgcagctgaacaagcacctgtaactgtaaggcagcctgcctgtgccttcatcggttcatcacttcatctccttgcagccctctatcaacacatttagatttcacccatttttattcagaacttacaacatccccgatcgattttcaaaaatggcagtcaagttctagccattcgatgctcactgctgcctagttagcacaggaatcaggaaacatgtgcagcaatccagctgttagaggcacagcctgcgttacagcgaccgaactcaaaataacaaagacgaactggcaaagtggccatggcaactaagatatcgaagagagtattcaagttatatttttttacagcagcaaaaatgataacctccacttcacttgcgagtactccttcaaatgcaatgatgaaaaaggatgccacctgttgatctcacttcctaaaccagaaccttttctgacataagctaaagactatgcgattttcttagaagtactctcccatggagaaaccaacaatgatcaactgatgatcagaaactgtaatgatcatctgatgacaagaaactgtttcacttcttgtttttgttgtccacattcagctgctggagcccaagcaagaggtccttggaatccaggtacaccttgttgtttgagcttgccatggtgtgagagatctccctggcagcttcaatctgtcggagagcgaggaaggcagggttgttgttaatcgcctcaccaatcagctgtgcactcttagcctcaccctgttcaagcaggcctcacagtcagactcaacccacaccaacaaaaatgaaatatatgaaacaatgaagaaataaacagtgccattgatatgtcttaacaattgtcactaaaactacaggtagtaaacttatcaaggaatatggtgaaagccatctaaaccagaaataatccattgcatctttgcttacctgtgctctgatgatcgcactcctcttgtcttgttcagccttctcaacaatgaactttgcacgctcagcttcttgtgcagcaacctgcttggcttcaattgcatgagtgaactcttttccaaagctgagacttgtgatggacacatcatccagagcaatgttgaagttgctagccctctctgtcaggatcttcctaatctccctgctcacagcctgtgttggataaaggaataattattaccatatatcctactatattagctcttaaactaaatatcatactactatattagctcttaaactagcatagcataccatggaaacatattagatatttaaacacagatagatatgataagacagtacctctctctgtgtgattagttgactggcattgtactgtgcaaccaccgctttgagtgtttcatgaatgattgaaggcaaaactctctcattgaaattctcccccagggacctgtagatggttggtagcttctctggtaacggtcttgtaaggacacgaagaccaattctcacctgtccaagttatcaaattgtatcaaactaaaaatgtgttggtactgacctctaccaatgttactttgaagcaaaggtctaaaacaagaaatttgcacacaggtaccgatgagcaaaccaatttgtatggtcaataagagttctaagttgtgaagaatcggaatttaaatgcatgtcaacaaaaaaaaaagtgtactgcctccattgcaggcaaagcataacacgcattgcaatgctagtcacacacgtaaatgttggttctaaaccaatgtaccaaaccactcacattctcaaaatgctaagcacatgatgaaaatgctaagcagttcagatatacccaacaaagaagcatctcacatacaagagtcacttagcgacaagtcctagtatagggacccaaattaagtgattaagcaagcacagcaagaacattccacacaactttgctaacattcgcaaatcacaaccaacaaatcaccttctacatgctacaaatcatcatctcaacgacatgacctagtcagaaaccccaagtgcaaggacagaattttaccatctggagatcacggcttccagaagtgctctcgacgaggttggggcgggctcggacatcgtagatgatcggcctctcgaaccacgggatcatgaagtgagtcccctcagggtacacctgcaccgagcacacaaccaaccacaacaattcattcaaacgcaacccaccaaatcacaagcacacgcatagcttctctgaaacccatcggcatcacatcacaagttcactagtaggcttcgatcgatgggttaccttgtccttgatgccctcgaggcggttgaagacgatggcgcggtggcctccctcgacgttgtagaggctgttgaaggcggcgtagatggcggcgccgcccagcagccccaccttcaccagccgccccgcggcagccgccggcggcgggctcggcatcttcgcgcccttgaagttcatctcgccggaggggggacgcgctcgcggcggcggaagcgtagggttttagctagggttttgcgtgatccggcgaggaggcggcggcggcggcggcgaggagaagaggtggcggaggagaggaaatgagaaaggagaaggggtgggggtgttaaagaggacgaacaggaggaatcacagccgttggatcttgatccgacggcgaggagggggcgacggggttgggtttctttcccccactgcaagaaaggagacggtgtgctttactttctctgcaagatgaggcgcactcccgaaatcggacggtcgtgatcgtcttttcttgcgtatgtacgaagttggtggttatttccgctggagattttgaattttatttttcaatttctttccttcttttttcttcagggagatggaaagactctgatttcatatgatttcatgtagtacagccagtttaaaagcggattaaaagctcccttcaatcttctgaagataagattaaaagtggacatgcaaaacaagaaaaccattaatatgtgattaattgagttttaattactataaacttgaaaaatagatatatttaatattttaaaacaactttcatataaaattttttcgcaaaaaacatgtcaatttatagtttgaaaagcgtgctaacggaaactgaggtaaaatcattatctttatgagaaaagaacggggcacactttattgagagatcattctattgagaatcttctgaagatttataagaaaactgagatcctttgtgcacactttctgaatggtgaagcatgtaacataaacaaaactctgaagttgaacatatctgcacctgcatcgacagtattgaatggtgaagcactgaacataaacaaaactttctgaatgattttctttatcatcaccagaccactctgaactgaagttgaaccaagcactgttactgcacacaatcttcaaaccaaagtccaaagagaactggaggagttacacagcctggaaccctgaagcatagattccaacctcaaaccaactgcacaagcacaccaaagcacaagcctcttcttctccaacctcactcacatcacatcctgccatgaacaacaacacaacaactctagccaaagaccttatccacactgagatgggcacatagaagccactacacctttacagagcttccctcaggaagaaaaactgcgaaaaaagaagagctagagaactaggtgcgcagcgccatgaacaaactctgccttctcgcatgctcgggaaccagacgttcgatggcttctggagggatgccatttagctctgccaatgttgcaaatgttgtatcagtttagctgaggataaattcaaagcagcaggattcattttgacattgaggcgaacaaacaattaacggaacaattctgccatttcgggaagtggaagatcgagcattggcttcagtttgttcacctaaatgctaggtaccattttgaacataattcatgaaataattctctcagctcacataaatactgtctacatgaggtgttagacgaggcagagagatttaggaatgtttaggttgatgagaatcaaatcagcaaatgctaaggttcatatgctgttatcgctgtttcattcagctatgataccttgtgttctgaagttgaagagaggaggaagaggacgcccattaggtagacgagtgtttggatctctcaactcatcaaagaaagggtgcatgcaggcttccatctggagaataattaaataggttagatgagagagaaatctaacagtataccacatcaggctgctcaggccatcataacaaccaaaatctcatgtggccttacagcggtgcaccgaagatttggtgagtattgcagaaacctgcttacaaggtccactgcttcaggtggaagccttttttggaaaacctgggtaaaaaacaaaacttttgagttacaaaaagaacagtgagaaagtattgtttaattttccaattgaacacacacataatatggacattgtcacacacgcaggacccaactaataggaatgtcgaagcgcaaatggtaacacagaaattggatttcttttccatttggtttttaatcctttttgtcttcaacaaatatttcaaaatttaacagcatagtaatttgcgtaaaagatctccctgtcccaaaagtatgtaccaaatcggacatcgatattgcattagttttgtcaaggatgggcagaataccttgtgccatggatgagccttaatttgagggaatttgaactccgtgtagttcggattcatgcacttgatctcttcccttgttggagtacccaaaacctgcaaggcgctatgactaaacatgttattgtcaagatcaatggtcacaggagagaacagtttggacatcatagaaaaatgttaccttgataatctcgaccagctgatcaactccctttcccagggaacagaggctgcatggatgaatgttattagaataagaaattgaacaaaagcaaaatattgtatgcatgaatgaaacctgtccaagcagaagctctgccatgacacagcctgtagaccacaaatcaatggcagtagtatattcagttgcaccaaatatgagctctggtgccctgtaatatcttgagcatatgtaggagatatttggctctcctttgacctgcacattcggcggggaaaaagctgcaatttaagactatcatgtgtaggctacctgcctaagttcacatttccttgcaagaaaacccagtgtgtccattcagaaaacagaaatgcttgtgaatttaaatttctgccaaattcagaacttaccaaaacttttgcactgccaaaatcacatattttgagctggtgtgtatgtgggttaacctacagtgcgaaggaagaccttattagtaccatcaaaacttagtgaatttcagtctgtaagtacatgcatgatcacggttttaaaataaataattgaagtactaacagtttgtctgcataaatgttcctttatatgtgcagtttataccgttttaataatcttatatatgagacttaatcttaaatcctgctgttctatatgtcaaataatttggcatcatagtcctagtagtggacctagtggtagttgatgcaatccaaatatgtggagccatggatattttctcttcaataaagaacaaaaatgactatgtataaccaaagtgct

SEQ ID NO: 64013 - DNA, 1614 bp, Oryza sativa
tgtagctccgaccgaaaacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttccttcatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatctgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttactgggcctcccctctttgacttacttccttcaccttcactctttgctcgtttgtatcttgatgtcccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcacctct

SEQ ID NO: 64014 - DNA, 7915 bp, Oryza sativa
  unsure (1)..(7915): unsure at all n locations
cgatccatctgaaatcaacaacatacgaagaaaaataaatgatgatcgatatattgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcgggcggatggctcaccggtgacgttatctcgactgacccgtcagaggtaatggtcactagtgaccaaatcgtttgcccgtcacaggtatcccgacagaggtgtgaggatctggcgtagtgtatggcgtctacgagtcgtcgtcgtcgtcggggtcggcacgcagcttcacgaggcttgggtggtgcatgaccgagtacggcctcgacgacgacgccactgacggagcagacaagcaggtgctctgcaaggtctaccgctcgccgcgcgcggtctgcgcggaggcgcgcacggcggcggcaaagtgctccggctccaagaggaaggcggacgacggcgtggatcacccggaggcgccgccgcccagcgcgcggccgcggcaagaggaggccgggagcgagcacgacgagcagtcatcggagctcctgccggagttggacctggacgcgctgctgtcggcgccgatggacgagaacctggagagcacgttcagcacggccgccacggaacaatacatgaggtatctgttgaacgacgagcctttgccgtgggctccgacgacggagcttgtcgacggcggcggcggcggcggagacgagttcatccagacggcgaacggaccttgcatggatggcgaggtcttcacgcgcctggctgccggagaaacgctcgacgacattcttggctcgacgagttcttgattgatctctattgtcagcggctgttcctctagcactagtagtgtagttctttcgatcgaatccgatcgaagtaggtttagttagagagattcatggattaggtatttgtttgatccgtgaatagacactgagctgcatgaagatatgcattgctcgatcgatcgatctgtaatttgatgagaagagttgaattgattctttctgtaaagcgtgatgatgtagtgcccttttgtgaagtgaactaatgaaattcatcttcatcagaggttcggagtgttttttttttctttttgatcgaattgaagcagaggttatgcatatgcgttgcttgtttcctcgatcgatctgtaattaatgaagagagttgaatcgatacttttctgtaaagtctgatgtaattctctttttttgctgctgtaagaaattataatacgaatgtttttcttcgcttcagatgtcctacatgctcacatgcatgcacgctggctttctcggtgttcatcatgatgagcccaccttatattgggccgtgtcggcccacctagatccgtatcggccctattttcggtgatccgggttcatgatgggccaattccgtaacgtgtagtgggctcatctcacagaaagccctgtgacggtgtgtacctatctcgctcgtcgccgtcgttggggtcgcgagaccgcggcggcggcgggcggcgaggggccgccggcgccgaggcatccgcgaccgcgaggcgggggatggcgcgcggcgacgacggcgagcggctgcctgtcgctgttggcgtgcttccatggcagcagcagcagcaacaacaacctacggtttctgtttctcccccaaattccaaggcatatcctctcccttatatttgagttcgccatcgtaggaatttcttcagtagttcagttccaaccgaagtgcttgtcttttttttttaatctctaattgtctcatgtgcaattgcatggaagagtagggagagtcttgctatggaattggatggtattttccagcgctctagatggataggcaacatgaatttccctaggatttggtttactgtgacctccgtacggatatccttaaaaccaactgtccttttagttttagaccttttgtatgcttatgtagtgatgtggttccattgatcaacgccttcttttgcaagttagtatgttcataaatccacacagcatgtacacactagacagctttgatactgcattgaccagagttggatttggtagtcgttgtcacaattgggcattagattcaaacagatcttctacctgctcacacagagactaactcttgtctcatactgcaacagaagtcaaacataactttagttgtacatgatgatgtgtttcgttctggtggactacaatatgttcaaccaaaaagaaaggaaatttgtctccaccacaagtcttacatgtcgtcaagagagtggcgaagagtcttaaaagcatcccaagatcatctgcaaattcccccatggctagcttggttgacccggcaaggttgcagaaattgttttcttttccttcttttaatgaatgggagaacttctgctctggtcgatattggttatccacatttccattcctctcagaggatgtatactatataatattgggtaccttcttgtttcccatcttatgggttcaacaaaagaaactataatagctagcatgcagctggttttgctatcgatcatagcatccactgtcatgttggtggcatctggagcacctcctcccactgctgctagtcttgctccctgccccaaaacatgtggagaagtgaacatctggtatccttatggtatcgggcctggttgctttcggcagggctttgagcttacttgcgacaccaccagcaaacctttgaagctcttcttgggaaacactatgactcaggtgattagcctctatccttcaggaactgtccttgcctctatcatgtacactatccccatgattcatggagttgacacctacaacttgtcatgggactctcctgggaggaatctcaacgttgagacctacaattacttggcgttcctcggttgtgggatcggggtttacctgttccatccagatactggtaaccttgtgggtcattgcacgatcaagtgtgcctccatggaggaaatgcacatggcaaccgaaggagggatttgcaatggcatgggttgctgcactgtcacattcccggtgttatttcgaggttttagagtgaccattgttaagagtaacgagacaataccgcagcccttcaacaatatcaccatcaaggctttcttaaccttccgtccttacatttttagcattgcggatctcctgtccaataagataaatgcaagcaccattggtgcttccatggcatacctctcgactgtcatcgcagatgaaccaaattgtccaacagctcggttggataataagacacaatttgcctgtggcagtaacaattgcatagatgtggcaaatggaggttattcttgtgcttgcccaggaaattctgatgatggcaatccctaccttcttgatgattgcaaacaaggtacctacgcaactctagctcctctctgaacagatgttcctttctttattgattgttaattcactacatattttttgtggtcatatatgtttcttaactggaacagagtttaaccctaccccgaaaaagaattgttctagatcatgtggtagcacaaatattcctttcccgtttgggcttgagccaggctgttttgctaagaggagatttcaactgagttgtgcatcaaatcgcactcttattggaagaccacctgcaaaatatgaagtgacaaatatatcattagatgaaggactcctttatgttaacaagctttcagaatttgaagatgccaacacaaagtatttatcagtatactatggtggttctggatattttggccaacaattaatttatggtttggaaaagtctgatttatctgaagagtatggtgtttggaagtggtctgtgaccaatttgacgtgtgaagatgcaaaaagcaaaagtgcatatgcatgtgttagcacaaacagcgagtgtcttgatgttacacatgggaagctatatattggttatcgttgcaagtgctctcttggatttgaaggaaatccttatgtccaaaatggatgtacaggtacacattcctaatgtatctagtgcattcgattttcttgtatgtggcaggagcatggagatatggaatatctgaagagacgtntntgttatccaatgattttcatagtgtggaagttgtagttaatgtgcatttaattgaaaacaaaagcatataggagccatcaagagtttgatatattaaagttcacatttttagttttctgtttgcagatattgatgaatgctctataccaaactattgtaatgggacatgttataactttaaaggaagctatagttgttgtcctcatggtatgtcttatgatcgagtaagaaggcagtgcacttccataagaggcaaaatattgttttgggtatgtcaggtttttatttattgttgctgtatgcatgcactccaattgttgaaaatgttatcaaacccctcaaagaataacttttcaattgctgcaattactcctgtaggacttgccattgggattagcagtggttttggagttctagctcttacattaattgcagctatattattcaaaaggtggaagagaagcactcggaagaaaattcgaagggcatacttccgaaaaaacaaaggcttctcttggagcagctgatctcatccagtaacaatgttactcctaacacaagaatattttctttggaagatttagagaaagcaaccaacaactttgacccaacacgtatccttggatatggaggccatggtactgtttacaaggggattttatccgatcaacgagtggttgccataaagaggtccaaaattgtggagcagagtgagattgaccaatttgttaatgaggttgccatcctttccagattattcatcgtaatgtggtgaaactttttggttgttccttgaatctgaggtgcctcttctagtgtatgaattcatttctaatggcacacttcatggtcttcttcatggtgatctgagcaccaattgtttgttgacatgggatgatcgaatgaggattgctctagaggctgcaggggcacttgcttatctccattcctctgctgcaatgccaatcttccatagagatgtgaaatcaactaatatactcttggatggtaccttcactactaaggtttcagatttcggtcttctaggtccatttccattgatcaaactcgcgtagttacaatagtacaggggacatttgggtacttagatccagaatatttctatacaagccaattaaccgagaagagtgatgtttatagtttcggtgtgatacttgttgaactcctaacaaggaagaagccaatttttctcaactgtcttggtgaacagaaaaatttgtgccactgttttcttcaaagcctaagagataaaacaacaatggatatactggattctcaagttgtagaggaagctagccatagagagattgatgaaatggcctcagttgcagagatgtgcttaaagactaaaggagcaaagagacctaaaatgaaagaagtggagataagactgcaactcctaagagctgcaagatcaagggcatacaaggaagacttacaaaggagcagcgaaataaagccgttattaactccgaagtacaaatgtacttccctgaacagcaccaagaatgttgaaatgggccttgttgctaatccagaatctcaggttgtctctaggtgctataccatggagagagagatgatgtactcttcacagtttcctcgctgattgtatttgtttcgacccttgtaatgatttatttatttttcgcttatttttgtagactgtacaaaatgaatggcacagaccaatcgatttctctgtatgcagcagctctatctatttttgtggagtggttagttgcaacagctctatcaacgttttctctgtatgcatttgtgtgtgttgacccagcaagaaaaaatctaagtaaaatttgaaaccacagcagcaacagcacgataggtcgatatgtccgagtggttaaggagacagactcgaaatctgttgggctttgcctgcgcaggttcgaatcctgctgtcgacgcttttttttttttgtgctttcttttgttgtacattttttattttcccttccagccgtgtctatttttccccttatttgttcattcacttttttttttcagctgcgtctctttcttgatcgtgcaatctatagacattttgttaagacctttaataacatttttataatctaatgttagtgcacatagttagttagtggtacagtgcctctcagcctacaacaaaatgctgccatttgttagtcattgctaaagtgcttatgagcaccgtttatattactcaatccatgcaggtagacgtcatctgaacccattaaacatatacttccttagttttttttaaatagatatcgccgttgacttctaaacacatatttgaccattcatctcattcaaatttcatgcttaaaataatttaagtgataaaacaactaacaaccaaataaattataatacgtgatttttttaataagacgaatagccaaacgtgtgacaacatgttacaacaagttaatggcatcatctattaaaaaaacagaggttatactgtacaataaatgtgcatttgtaaccagaaaaataattcactggtaggactaaaataaatacggagtatgtggccaagggtggaggtagagtatctcagggggggtgcccaggaacccagtcaagaaattttttagctataccttactcattttaaccatgtgtgcaccccctaaatacaaacttaggcacccatgtcagcttaaattcgatttaaagtagagtatattaaacaagtggtacccctctacatttcgttttagatccgcgcccatgtggctatatttaggccctgtttgggggagcttctctcagctacagcttttcccaaaagctgcttctgctagaagctgccccaaacagtccacagcttctgagaatctgtagttacagattctgaaaaatgaactaagaagccagaagctggagaaactgggtttcagagcttttccagattctcagaagctggctaccaaacagctgcttctcagaatctaaagctcctcaaatagacccttatatttacttgtgaaatagtaaactggaactattgtggaatccaatggcaatcaaatctaagtttcatgcctatgttcattgaagcaaaaaggaatttttcccaagtctttttcattgaggttgttgcgatagtattgtggaacatctggagaagaagaaatgattatattttcaacaacataacacccactttcaattcctagaaatctcttttccgtaaagattttaccctacttttgcatagggttagagctcaggacagaccaccctggaaatcatggctagataatctgtaatttgttcttttaagttctattttcttttcttttctccctcttagaactttttgggattgtaaatatcttttattgacaatgcatttcaataggagcatctcctgctggtttttcgtaaaaaaaaaaaaaacggggggggggggggggggggc

SEQ ID NO: 64015 - DNA, 2078 bp, Oryza sativa
gggggggcgcagaagtaaggccggcccggcctactctctcggtcggcccatctcattccaaccaaagcgctgcggcgaggcgaggggaggcgaccaacccttctccgcttcttcccccaccttcctctcctcctccgccgttcgcgtctcctctccttcctcccccacctccgtctcgcgaaaccctcctcccctccccccatggcggagtcgcccgagaacgccgccccggccgcggctccggccccagcgcccgcgcccaccccggccccgccgccgccgccgtcatctccgcccaccaagtcggggatcccgccgcggtacgacctggacgccaagtgggacgcctgcctcgacatctccatccgccgcgtcgcctactccaccctgggtggcaccttcgcgggcctcctcctcttccgtaaggagtttcccccctcccaaactcgcccttgccttcccattgcgtgcgatttcgtgagatctggttgcggcgcgctcgttgttccggcattggcctagggttggcgccgttgctctcgttttaccgttccgatcggcctactctgatgagggattggctaattagggttacatccaagtataatgcacgttatgtaggaactggttgctttatattccgagtaattttttttcatgcaatatcatgtgattaggtgtcgcatttagcgtggatgagttttttgtgtgccacaatgattctgggatttgacatgtgcagatgaaaattccttggtcttagtttactgtatgacattgagagcgaaataagtacaaacaagcagaatgtgaggatgcctgaatcacgtatcgatatccttgtttcattgtgggggctatgcctggattgcttgtaaggctttggtgaacatttattacaacattgtgtttctttcgtatgggcagcttccatgtgtggtagcttgtttacgagaagtttttgttaaatggtattggttttcagcacgtcacggtttagatcccttctaattcatgtttagccattgatagtattagttctcatactgcctagaatatgtttgaaatgtgatcagtggtgaactggtggtcctccttagggggatcaatcgtagtaacttttgtgtgccaagtgctgaggttttgtatgatttgtggtctggtactaatccttaatcttggagtgttgactgtgctttatgtgatcaacacttagcattttagcttgatgtctctccagttattttttcctaatggtgatgagcacacattatagcatgcatgtttaggatcttttcctaggtgaacctcaaatgctcaatctcaaatatgaagggcttcacatgatatctattctgaagtcattattagttattaagttttcctgtatcttttttttttaattttttcttgcattcagcacggatttgacatccagatactctttaaacaatggaacacgtttgctgagatctccttttacatcttgagtactttagctatgacaatttaccatcttgacaatacaactaacaatacgttctctttgaaccttcttgaattactattcatcatattttatcctgaatttgttagaaatggcatatgtccaaaaaaaatgcaaagggagtagttctgccttaaaataccagtgaatagacattcattaaagtactaataaatttagttcttttctccaacaagagttggatgaagattaagattttcgtggcacgctttttaaactgttaaacggtgtgtttcgtgcgaaaactttctatatgaaagttgctctaaaatatcatattaatctatttttcaagtttgtaataattaaagctcaatcaatcatatgttaataccacctcgttttgcgtaaaaaacttcatctccatcttcattttcaggagaaaagaacaccaccatattttgaccagtattattttatacaggtagcccaactactcgctgggcatcagttgcgctcggagctggtgtggggataggagctgcgtacactgaatgttcatacttattcaatggtgctcctccaaagtggtcacccaaagtttcgaccg

SEQ ID NO: 64016 - DNA, 4980 bp, Oryza sativa
tctatatctgggattttttcttaattcagcatttgtcaaaatttgtatagatgatctcatggcagtcatgttttggtcagtttgggattagattgtttttgaaaacactctcaggtgtgtggaaggatagagttatcgtttgttgaagccactgattttcaacagtccatgggaaaaatgttgtgttggtgtccttttgggtgaagtgaaagtattgaaaaccctctgcagaagttataatggctgtcatgaatctagtacttacaggatgcgtgtagcaagttttgttcattgtgaaatgacattggtgattatcttttaacgtatctaattcaaaattatcattttgaatgttcattaatttccttatcttctatatttaatcagggggaagacaagtaaacgctgtttggttggatcggtccatcttgatggaggttttttggagtgttgttgaactagctatctcatcatcttgtctgatatcgccaattctggtctactctttaagtatcgcctcaaagttagcaagagcctgctgattttcctttacactatgcaaaactattccaattgtggtcggatgacccatgggccatggctgcgtacctcaaatgatggttttgtgactggcaaataatatgttcatcatgcgaacttgttgcagcgtgcacattagtatatactttgttactgtcccccttttgatgattggtttgtttccaatcctgagcaagtccaatttctgaacaaaatcgagtgtaaacttttccatgcaaaaatgattttaacgttcactttgcacgtttccccgtgagtacatttcgtgtggatctgaaatttggccggtggtctcatcgagaacgggcgttaagattatactccctccatcctccggtccttaatacaagggattttgatattttgcctgtactgtttgacaactcatcttattcaaaaactttgtgcaaatataaaaaatgaaaagttgtgtttaaagaactttggataataaagtaaatcacaaataaaataaataataattctaaatttttttaataagacgaatgatcaaatagtgtaagcaaaatgttaaaatcctttatattaagggacggagggagtacaagatgactgcaaccctttttcttttacgaaagtttcattaagctatttaggcgaataaaaacgtcttttatgaaactttcattaaactattttagacgagtctatataaacgggtgtgaactttcaaaattaggcaaaggctgtgtttagatccaaagtttggatccaaacttcagtcatttttcatcacatcaatctatcatacacacacaacttttcagtcatattatctccaatttcaataaaaatttaaactttgcgctgaactaaacacaaccaaatttaaagacgcccaaaacgggatgctgacagtgaagcaactgtctctgcgaaccgacgcgtccatggcaacgcgaaacacctgaccgttgttcggccatggcaaatccaaaaatggattaaccgtcgccaaccccacctcgtccgtttattcttcttcttgtttcggcttccgcctccgtcccgcgcgcgcgtgcccccgcccgcgccgccatctctctccttcctcctgtattgttacgcaagccatccgagccaagcaggagaagaggaagaggaagaggaagaggaagagcatgcccccctgcgcggcatggggaaaagctccgccgacttgtccgcctcctcggagtcggccgtgctcctgcacggcgacctcgacatttggataaccgaggccaagtgcctccccaacatggacatcatgtcggagcggatgcgccgcttcttcaccggctacggcgcctgcggctcctcgtgcggcggcaccggcgacaacgcgcgccgggccggcggcggcgtcaggcccaagaagatcatcaccagcgacccctacgtctccgtctgcctcgccggcgccaccgtcgcgcagacgcgggtcatccccaactccgagaaccccaggtgggaggagcgcttccgcgtcgaggtcgcccacgccgtctccaggctcgagttccacgtcaaggacaacgacgtcttcggcgcgcagctcatcggcgtcgcctccctccccgtcgacaggatcctctccggcgcccccgccgagggctggttccccatcgacggccactgcagcagcaaccccatgcggccgccgccggagctccgcctctccgtccagtacaggcccatcgacgacaaccccctctacaggggcggcgccggcgccgtccccaacgcctacttccctctccgccgaggtggcggcgtcaccctctaccaggacgcccacgtcgccgacggcggcctcccggccatccagatcgccggcggaagggcgtacgagcacggccgatgctgggaggacatctgccactccatcgtggaggcgcaccacctcgtgtacatggtcggatggtccatctaccaccccgtcaagctcgtcagggagcccacccgggcgctccccggcgagacgccatcgacgctcggcgagcttctcaagaaaagggctcgcgagggcgtccgcatcgtcatcttgctctgggacgacaagacgtcgcatgacaagttccttctcaaacggtagtatatctatctatcatcttttttatatcctttcttcttcttcttcttcagttgtactctctgatgaattgatatcgtcaaactcacaagaattcggaaatgatattgtgagaaataattcaggttgaatgcaggatggtgtcatgcatacacacgacgaggagaccaaaaagtttttcaggcattcaggtgttcactgtgtgctggttcctcgctatgccagcactaagcttagcattttcaagcagcaggtcagaaatctttgtctgatatagcgctataatttaactgcctcattagttattactagtacatgaacataagtatagtaattacttgttattgaatataatacctactagtacacactatccaattatgcctgcttttacaaatcacatacaagtaggttctcactagttcatgttctgttgcttatctgcatttgtcaggatgaatagtcctgatgttctttctgagtctgagaaagctacactaaatattcatgcagcaaactcatgccttaccatttgttcatttgcctgttaatagttcataaaaaacctttcgatgatgcttgctaatgtaatatttctcttctccaggtagtgggaactttatttacacatcatcagaaatgtgtgcttgttgatacacaagctactgggaacaaccgcaaaatcactgctttcattggtggtctagacttgtgcgacggcagatacgatacacctgaacataggcttttcaaagatcttgataccgctttcaacaaggacttccataatcctacatttcctgtaagttctccagttcataagctgttatcagatcatggagttccttcatagatgtttacacaaattcatgtgaattgctaaatatctccataaaatgtattggcagcacgttgtacaatctgacttttctataaaatatatcttctctatctgataagaatatgaacgccgaggatcctttctcctgatctacaggttaattcatatggaccaagacagccatggcatgatttacactgcaagattgagggccctgctgcctttgatatactgacaaactttgaacagcggtggagaaaagcaaccaaatggaaggtcaatcttaagaaagttgcaagttggcatcatgacacgctgataaaaataaaccggatgtcctggattgttaccccagctgcagatgaggctaatgcacatgtttgtgaagaaaaggacccagaaaattggcatgtgcaggtataagactttgttttagtcttacatgaactacagtaacatcttagatggtacttcctcatacttattttggtgctcggctaggtgttcaggtcaattgattcaggttctgtaaaggggttcccaaaaattgttcaggaggcagagtctcaggttagtgtcctttgccatgcaccacagcaccagctaaaagtgcatctttcaacaattgtttagttattttcccttttcttctgcagaatcttgtctgtgcaaagaatctaaagatcgacaaaagcatacacagtgcatatgtcaaagcaatcaggtctgcgcagcacttcatatacattgagaaccagtatttcattgggtcatcgttcttatggtcctcacataaaagcgcaggtaaatctgtcttcagttctgctttaggtgaagcttatgaaatgccatttcactacaaatttctttgcttggcaaccaacagttaacatcttgtagttgtagacttgatcagcctaacaatcacatacatgtttatgctatgacttgcgaacagcaattggattgttcagatgcacgatggcaaacgacacattagaacctgaaaatggcataagagatagtaggattagtgtttcagtacctgtcaggctgtttgttactcacatttggtaatgactacaagggcattctgcattcatattacgattggaatgctctggtgagatcaggtgctgataacttaatacctgtggagctggccttgaagattgcaagcaagatcaaggcaaatgagcagttcgcggtgtacattgtcctaccaatgtggcctgaaggcatcccaaccgcggcaccgatgcagcaaatcctcttttggcaggtctgcaggcatttattcatgcaaataactactacctccgtttcaggttataagactttctaacattgcccacattcatatagatgttaatgaatctaggcacacattaacaaatgaatctagacacattcatttgtgcctagattcattaacatctatatgaatgtggacaatactagaaagtcttataacataaaacgg

SEQ ID NO: 64017 - DNA, 12142 bp, Oryza sativa
caaattaacaatcatgcatccagcgctcggcacagaagctccggagattcatgatctatgtgcactcgaaagggatggtggtggacgacgagtacgtcatcatcggatcggccaacatcaaccagaggtccatggaaggctgcagggacaccgagatcgccatgggcgcctaccagccacatacaagtggtctgctgatcacggccaaggccctcctcgtggacaggtacagttcatccaaagagcttcattacgatcgatgacgagagagagagagatgtgtgtttgcattgcagatgtagagaaacgaggattttcttgctaactccacaaggtgttgaactagccaacctaggttcaaaagcctcaccccttttaattatttgatattaggtagggttcactctatcggttttagcccatttgatcggagttcaccgaaatcccgaaatttcggaaattttggtccgaaattttgaacaaaatttagttgaatttgaacaaatattaccaaaattcacgaaaaaaattaaaaaaatttagccgaagtaatatcgtatcggaggggaccaaaatgaccgaaatttcggttcgaaatttccaactctgatattaggttattcactaatattcacttttttttgcattgcaggtgtacgggtacaggatgtcgctgtgggcggagcaccttggggcggtggaggagtgcttcgggcggccggagacgggggagtgcgtgaggcgggtgagggagatggcggaggagaactggagggcgtacgtgtcgccggagatggaggagacgaaggggcacctgatgtgttacccgttgaaggtggacaaggacggccgcgtccgctctctccccggccacgactgcttccccgacgtcggcggcaaggtcctcggcactcaaacctcgctccccaatgccctcaccacctagtacctgtaccatatcccgcgtgaatatgaatatgaatgaatgccactgttttgtattttcatgtgcactgcaaccaagcaattttttttttccgcaaaagcgcaaaaaaattatatatcaatatattagaagaagagagcagagtttaagatagacaacacaaacggtcgtcagaaagccgttgccaaggttgaggaaagaaagaacaaggggtagagcatttttataacattgcttcaaaatatagagacacgcatgctgcacatctaaaacgcactagagcagaattcacaacaaactataatttactttaaagataaaattggttatatagtccttagagtgtgataggacgatgaagccatgggtgcatgatcatacttatgaatagcagggtttaaatccaaattcttcgaatattatgattctatttttccaagtagagatttactagtattaatctttgtgagtgtatgagtgtgatgtgcgcacatgtcggcacaagcatgcttattgtaatatgtttccaaatacgaatcgaggacatgttggtagtttccattcctttgagcgtgcgttaaaggatacatttgcaggtatatataagtgtgatgtgtgagctcgtgccatccatattataattgaaaataaatacttatccctttgataattaggataaacttacaggaattaacaaatagacccactatattttagtattttctattttcgatgctttacagcctcattgtttggcttatgcttatacttataagttaaaatttaaattttcaacattgaatttggagttaattttggaggtttttcatcgtagtttatatttcagcctttaccttttatcgctaagaacacgtatataaaagttttatttataaattattttttttctaaatatgccgagtccttggtggccccgtgcttattgcttaaacccagccacccacccaggccaaaacctcgcggtcgcggcgaggcatccgtcagctcagctcgatgctgccgcggaggagacgacgccttctccgacgatctcccctccaatccaatccaacccaaatcatccctcctcccctctcgccgccgcccgccgccaagcccagccccagccgcccgcctcctggagccgtcggcgtacggccgcctcctcctggccgcgtcgaggacccgcgcgctggcgctgggcaagctcctccactcccacatgctccgcgccgcctacaggccgggcctcttcctgcgcaacaacctccttgccctctactgccgctgcggcgacatgcgccacgcccgcctcctgttcgacggaatgccgcgcagggacgccgtctcgtggaacacgctcatcgccggctactccggcctgggctcttgccgcctggccctcgacgcgttccgggacgctcgggccagcggggatggtgtggataggttcacgttcgccgcggcgcttgcctcgtgcgcccgcgtgggggactggagggacgggcgggtggtgcacgggctggccgtggtgagcgggcttgcacggaccgcgttcctgaccaattcggtcattgacatgtatgccaaatgtgggatgattgatgaggtgaggctgctgttcgatcgagccgaggaacggggcgaggcttcttggaacctgctgttgtcagcgtacgtgaggatggggtggccagaggtggcagtgaatgtgcttgtttggatgcaccggtcgggggtgaagctggacagttttgctttgggtggcatcctcaaggcttgctctgagctaggtgattcagaggatgttcggaggatgctgcacagttgtgtggttaaggttggtttggacttggatgtgttcgtcgggagtgcaatggtggacatgtacgcgaagaatgggggattggaggaggcgatcaaggtatttgattgcatccctaatcaaaatgtggtagtttacaatgccatgatagcaggatttgctcggttgggtaatgacccgtgccctgagattagaatcgaagcagtcacgcttttttcaaacatgctcaagaagaggataaaaccgtcaaagtttacgtttaagagtgtgcttgaagtgtgcaatttgaccaatgcagtgcgatgtggtaggcagatacatgcccatgtcatactcagtgggcttcaaggtgacgagtttattgcaagtgtgctgattaacttgtactcaaaagcacggtgtgtaaatgacagtctgagatgcttcgatatgaccgttaaagaagatgtcttcatatggacatccatgattacagcatttgtgcagaacgagcactttgagaaggcactatacttgtttagggagcttctctacaccagaaaagggacagatcaattcaccatatcaagtgtgatgagtgcctgtgctgctctttctgtaccaacaacctgtaagcagatacactgtcatgcagtcaaaactggtcttgatcaatttactgtctctggcaattcccagattgctatgtacaggaatataggtgatcttaaggcttcaaaacagacatttgagcagatttcatgtctggacactttctcatggtccgctatgatcctgagctatgcggttcatggctatgaaagcaaggccctagagctctttgagaaaatgaagaatcttggtgtcatgatgaatgagagtgcttctcttgctgctcttattgcttgcagccatcaggggctgggagatgaaggtctcaggtatttcattttctgaaactgcaactttctctctttattatttttcctttattctttctcacgttcttgattgactttctcctgcctcttttactgagcaatttatacgtaatagcaagggagagatgctattctggtaatcttcagaagggcaatgatggcatagatggcagaaagcagtccttgaaaaagcatgccagctatacccagtcagtttagaccatgcattcttttttttttttttgaacgaactggcaagctgccaatttcattgaacagagaaggagtaaaactgtacatgcgccacgcgcaaagggaaaaaaaaaacagattcaaggcctttggcaggtgtttcactcccgccagaacccatgtttagaccatgcattcatttaagacaaatacaaaatttacctgtatggtagatacgttcacacttaaccttacccttaccctcaagatcataaatcaactgtgcatattgcctgcattgtggcatgcattcagtttcttgtgttaactctagctaaggatatcctgtgttatgcctttttgaactgtcaatgtcgagggattggtaaagatcatcagacttgaagtgacactgccaatgccggtcccaagcccggatgtaaaaggtggagggtttgagtttcatatactttttctacacaaaataatgttgtagccttgaagcattactgagtatagatggctggagtagaacttaagtataggatgctaactgcatcaaggtactaaacgggtacattcattggaaacattccatttctggtacctaatcacatttcttaagtcttggtcactgttaatcatgggtttttcttttgtaacccaggtactacgagaacacgataccagatgatggcttttccctggatgtgaaactcaaagcgtgcatggttgacctccttggccgtgttggcaagatagctgacgctgaagatttcataatgagttctggatcagaaaatgacccgatactttggcatgcactattgcgtgcttgcagagtccatggggacaaagaaagatgtacaaaaattggagagaaactgatggaacttgagccgttttctgctagttcatatgtcatgttgtataacttatacatggatgctggaaaaatctcattggctatgaggacgagaggcctaatgagagagcgaggcatcagtaacgaagctggaattagttggaccgactttggaggatccattcataatttcattgatggagataactcctgttcacataacacaattcacacaaccttggaggagttgttggtcagggtgaaacagaagactgagcatggtggaacaaacatttgggagttagaattccaaagcagaaagcttagtgagagctcaatcagcagacatggtgaattattggcagtggcttttgggttgacaactttgccatctgttgctcctgtaagagttatgaagaatcagaggatatcctgggaaagccacgaaactctgaagttgctatcagaaggtgaaaatagggaaataactgtcagggatccaactcattttcatcattttactcgaggctcatgctcttgtagaggctactggtaattgaagttgatgcctcatcttgagagtaggagacttacaagggtgagaacatttttaaggtgagctttctactggcagatcatggagttttggacgcaagcaaaccaagccagatgattcagttgtggtcaggataagactaaagtcaattcaactgaagttgcattgttacagcttgtggctgtgcttcatggttaatagcatcacggctcgagatttttactctgatgaaaccaagaaaggagataaagtgcttacttccctgttagttgcatcattttgactagcacacctcaaaggttcttatgcagtattttgtagtctcatgctaggttatacagaattttttcacacaatctagcagtagagtttcctcgttagggactaattgatcactactttagaagcattcacataattagttcaaattgcatcaattttgaactaattgtgataattagttcaagatatgtgataattatcacaattatgtgataattagttcaagatatcattcctctcagcacacaaattgcgatgataaagaaaataaacctagtgctatgccaagaagctcaagcctgtaaatagacacttgttgaacagatatggacaataatatagttaccgttctttgtagattaattgctttgtttgtaattttgcagggaagattaatacttaatcagggcaacatgaagtcatcatatatcatgcagtaaaaataggagaccacaatcgaatgctttattattgagaaaaatggatggtatcatgtttatctattttagctgaatctatttaaccataattaatcagtatgtgttagtagaagtctttatatcgttatgcatcaacatatcatgagattattaagtaatagctgagtacaccggcctaaccatacttaacatatcatgagactatcgggtaatggacaaactcatgtttaactatggtagagaaaaaaaagtaaattataatttgtactatatttttttaaaaaagttttcatattatgtcatcctttaccattctttacatttcaatttggagaaagaatgaacggtggtgactgtgcgtggagcggcgattagtgattgctggtgctatgaggagtttgttgtcgacacaatctctagccgagtttgttaatatttttctaatacatggaccaccactagaaatatgtgctacttaaaaaggggcttttaactatttgccacttttagatttggcaattaactatttgccacacctatctcaatgacatgtgggtccacatgtgtctatgacatgtgggtccagtggcaaatagttaattgccacatataaaagtggcatatagttcaatagtatatagttcaatagtatctcgcttaaaaaaagcgtagtggtgatcttaaatcctcgcctaggcagactcgcggagtgtgaactgttggatcgcgaaatccaacgcctcgatagcctttcttttcttttcctcgcgctctccccctcaaaccccccgatccccctatccgcctcacgccgccgcataccctctcggtcgctcccccgcctcaaccgccgccgcatcccctccaacgccgtcgctctacgccgcagcagcggcctgcgctccatcgacggcgtgactccgcgcgacggctggagaaggcgaggtcgggccgacgctccacgccgccgctgcccgcagccccgtcggcgccgtcgctccatcgccgtcccgacctcgaaggtgaaccggcttcgagtccctcgcgccgccaccgatcccaggactcctcgaccctaccagcgaacaaggtaagagtgctgctcgatcccgttcctgtacaggaggaggcatacgaggcagggtatggtagatgcataataatggctttagaaatctcctgtgctgactaaatccccattgttcattattaaccattgttcactgtacatgtatatctgtgatgcaaaactctaatccaaaatctgaagtccttagtggtttactgtacctgacaagcaaacatctcaaattgctactgttaatgtatgctactgaaaattctggagaaaaaatcgcaagtacttttactgatgctaatgtatgctactgttaagctgttatttgatgctactaaaatatgtaacatatggacatgaatgttcttgtatgtaaaatgtgtattacctgattaatatgactgcttccaaggctgacaccatcttaattagaatatttgattatgagaaaacccttacaatttattgtctattctgttcttgagagttaaaaaaatctttcaatacatttcagtagttttcctctattgttcttcaaagttacataaatctttcatatcttacctatttcagtacgtgcaccatgtttttgtcttcattttctgtagtacagtctactcatccactttgctggtagcttttgcatgtcatgatccccacagcatgatgtacggttttcagttatagacgtcggttgtgatatgaggaactaaattgcaaccaaacagtgattttccagagttgcggttaagttctgaacaagtcctcagttaaattggaaacattcctttgttttccttcatgtctaaaacctgaactgaacagagatgagaagactactgcatcccttccaaacataatttctcatgtttgttattcgatggttttttaattatggcagctaaaatcaagattatgtatcttgggtagtctgatacattaaaaaggatcgatgcaatatatttttaatgaatatctgcagagaaattggataaacctttctcactctgctttttgttttcaggctacactttgatcatctcttaattttcttcaattcaatctctcttaaggttgttcaagttcagtatcatgccatctacctctccagtataatatacttcttggtaagttctgctgactgcatatgctgccatgttttctcttcataataacaacagatatattttgtagttttgaaaaccacattctgaacattagtgcaagttcagtttttaattttatgtttcaagtttaagttcagaaatccacattcttgctatgtatcttacctatttcagtacacacaccatgtttttttcttcattttctgcagtacagtctattcatctactttgctggttgcttttgcatgccatgatccccacatcatgatgtacgattttcatttttagatgctggttttggtgtgaggaactaaatttaacattgatcagaacaatttgtatgcaaattatgcaacaaaaattagcatatatttgatacatgtctttaatgtaccgtattttatcatttaaattaagcttctatcattggatttaaaatgtagcatacagtcactcgagatgattttcatttttttaatatatcatgagtttttatgatggctggatgactgttacattgtatatttgatacatataatcattgtctgttcggagtgggatccacttaacgttatgtgtacttaaaaaaaattaggaacttattgttcatgtattcgtactattgtccagctatagaagaagatacatatatgtcatgcttgaactttcttttcaagtattttttattaagcaaattatctgcttatcacttagcttttatggcattagctcaaattttagtcacgtgggatcatgagtgattaaaacatgtgatcttaaattgatatatatttttcctgttgcaacgcacaagcacccaactagttgagataaaaggtggagtagttgtaacgccccgattttcgttcgggattaaaaatcatttaataatacactttctagaaatttaataaaagttaaatcaatttaatcaagtgaactattgagggaattaaaaatttccttttaaaaatcattggccgagaatattttgtaatattctttggccctaaatattctctaaaattttctcgtgaagtttcggagctcaagaagtaattttaaaagtcacaaagttcattaaactcatttaaataaaaagaaaaaccaaattaaaatcctctcctctcctttgggctcggcccaagcctctccttcccctcccgcggcccgcgcgccgtcgccgctcccgtcgcctccttcggcctgcttctcttccccccccccccctcatgggccgttggcccatttgcctcctctcccttgaaagtccacaaaaccccccagctcttctctctctggccgacatgtgggacccgaggccccacatgtcagctccttccccttcctccagcctgggccggcaactgccgaagccgccattgttgccccacgccgctgccaaaaccgccgcctcccacctcgcgcgcgcacgtccgaccgtagtctagtatcttccccttcccatcccttggcgtaaatgcgtaacggcttgtttggcaaccctaaaatctgccgtctcggctcctccgctccttgcgccatctcgcggctgaacaggggaggtggcgagcagagcaggggaggggagggatcctgcaggtgagcatcctctttctcagaattcatctctctcccaccgggactagttttgtctggaatttgcttgcgttcgttcggtaaccctagcttctcttctagatctggaagaagctcttctcttaatttcagagcctccttaaccttaatacaagtaacaacagtttgttgtttgttcccccaaaatcaactgaacccccatgtcccaagttcgatccacccctgcctgaaaggagttgataaacttgatgagtctagtggcgatatgtggaatagactcggatgaggtattgttgtagatgcatagcttcttctggtgttccgatgtgaattttagcgatgcgatgtgatgagggaggatttttgttagcagccatgattttcttccctcgtggtacatctttatttgtccatttgcagtaccagttaaagcatggaatctaaaatattataccaactgaagtatggttgcagtttagcattaaatttagctagtcatatagtagtatatgttagctctcatttgatcgccatttttgtctctgaccctccaccaggtcaccagtaacatgccatttgatttcaccatattgtcatatactccttcctttagaaaatattataatcaagtattcccttttccttttttttcttttttgcttttgcttgtcagatagcatgttatctattactgtgctccctaaatctgtgatttttttctccagtgacattggcacttaaaaactgtttcttggagttcataacagtggtcatatagcaatgattgatgatgaggctgactttggcaacatcactgatgccacagaagggcaggcagctgcaaagttccgtccgaaggcacgggccaagccccgtaagacatctttgccatccagatccctggcacctcatcctactgtggaatcaacagatgaaaatgtggaaacattaaataaagatagcacctcacaagaacagtctgttgataaaaaagcagcatcattaggatgccatggtagtgagacagatggtaatgcttgtgcttctggcggtatacttgacacaccttctgaagatgtggtgacagtatccctggggcttgtgaataatcctgatgtggcattggattcttcaacagttttcgcttcttctgcacataaagtttcccaaaatgaagagaataatgatgatgtatctcatgtggctacacacaaagaaaacatggtggtttcagatacccaagcaccaccgacctgttgcagtgccaggacaattgatgatttggctgactttgaaggattgtgtgatgatactcatgttgaggaagaaagagttgcaaaattccagccgaagtttcgggtgaaaaccagcaaggccgcatcgaaatctcagaggactaaccaaaaggcaggagtctccactgtagatgtgctctcccaaaacaaagaagatggtaaagatcaggcaggatgcaatgacaagcagctgcactctcctactagacatcaagaaagtgtacagatctcatattctcaagcacacctgggaactcataacagtacaatcgatgacgttgctaactctgatagtattatggaagaaccagctcaagaggaaatggctgcaaaattccaacctagactgcgaccaaaggctggtggagcttcacctggggttgctgagactattgatgctgcttgtgtagctactccagagtttggggtttcctctgtagatgtggtttcccaagatacggaagaagatagccatagagaaggcctcagtgatgattcatgccaaaaatatatagatgaagaggctattacaacttcaggcactgggccaccacaggttagtggatatttcgttgttcagaaaaaaaaaatggtactgctatttcaaataaagactatggctccatgctctgacttttgattgtttttaggatttggatgatactgttgatttagactcgcatgctgaaatggtaaatccacatcctgatggtagtccgttgatcattgaagagctctcaggtgtgcttattttacgtatagatcttctcccttttttttttttcaaacttgtgatgtttcttgtagtccaaaaaaaaattcctgtgatatttttaagcatgttgaaagaagtccttaactaaatgagcctcaagttaagcttaattggaacctatgcttgttactatgtgaatattccatgctgaactcatgtttgagctggcttcaatcatatataataacttttactagtttttctgtacttcttttaagaagctaacatatttcttttacagc

SEQ ID NO: 64018 - DNA, 5890 bp, Oryza sativa
  unsure (1)..(5890): unsure at all n locations
ctgcagccctgttcggcctgtaccttttgcacaaacaagcagtggcgcccgaaagcatatatatgatggatgtttaggttaagtcattggaacctttctattgattaatcggttgattgaggagcaagattaacgccaacttttagcatatatatatcggccagacaaatttgaaaagtaaacttttaactctgaaaaacatttcttaattatggggcgttcatttttctgccgtacaacacaaccaaaacaggcctcgattaaacaaatgtgtgccaaattttagggacagacgtgcaccaatattatcacaaagggaacgaacacaataaccaaattaatgcgccattgcgtgcgcactatgggaataattttgttacatatatatataaatagatgtggtattctaagataaaccaaaatctttttaaattttctgcagaagatgctagcttgagcttgtcaatcaatatagctagagctataaaaattaaagaaaaaaattatgtcctgccgtacacaaaatatatacttgacaatgagctaggagaatcggttttgttcctgataaaaggtgatcttagctctgtcgatcggccagaattcactttcactagaaaaaaaaaattgttcgaaaagagatgggcatgcacgtacagctgaaattctcttgtgtgatggctaagtaaagtagtaaactatgggaagtgaatcatattcccttctttgataaatagaccccttttgttttcgagaaaagaaagtaggtaggattcctcgcacagcatcacaagttattttcgttaccatatgaaaattcttatctatctatatatcaatccattgtgaaatcaattagctttatgggatatataacactaatttatcattgtggtccaagtaagatgcatggatattaggatttaaccgattaatcatgcattttatatacacaacccatatggtttttatctctctttttctacgcgtcatggtcacacgataacatgtgttgataatcgagaacccttgatgtcatgcatgcatgtatatatttcaatcgactttggtttgtcccaaaaattagagaataaatactagtttatttttcttctttttagagattgtacgatcactagctagctaggtatagctagctgacggatttttccaattaggtatatatccatgcacacacaccgatcttttcattcattcttttctttcttttcacagatatattccaggtagcttatcaagcacataatgttggaaaattaaacaaggaatccttaactaacaaatgaaacacggggagggaggaagagagggggcagagctagagagctagctagctattgctacagcacatcttcgatatcatgacctaacctaactacgaccccacgtatactcgatactaaactactatagacgaacgaacgatcgttcgttcgtttcgcatatatctataaatcctttatgatatcgatatctctatttcttagtatatctaatagcatagtagtaggttagtatatctgctatagctagctagcagtacatgcatgcatgcacacatgtacatactaccatatctctgtcttgtctccctttcacatgtcacctctgacccacaaacaaaccctttccaagctcctaacactagctttaccttcttcttcctcctcctctgtatatatacaccccctcacctccctatcttgcacccatccatccacccatagctatctctagctagcttgcacattcttcattcttcttgcaatcagagctagagaaaaagagtttgagagagatctaagagatgtcaggggtttgggtgttcaagaacggggtggtgagattggtggagaagcagcaggcgacggcggggacggcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaaattgacctatgtataggctcgcatgcatgcaaggtagacgaccatccaccttgcatgcatgcaggctatcattctctcttcgtctccgtcttcgtctttcatctttgttgtggtgtgtgtgaatttattatacttcttatgactgtgtgtgtgactgtgtgagagttcatggagagtgatgagtagtggtatacatatgtgtcgtcgctgatcgatttggtttattaccttgtgggtgggtattaattatcagcagtgtgttatatcaattgcttacttgtatgtgtatcatgtacatgagtgagtgtggctgatgcatatatatagaggtctttaataattatgtactatatatttgtgtagctagatatatgtactacctgctctgctatatgtaataatgtacgcatgtttttgcttataattaatcatatgttgatctgtatatgcttatatgcaggtgcgagttaattgccatcgatttgaattgttcttaagttgcctaaatatatgtgaacatgttgatagagcattaataaacctaaatatatgggagttcttgtcacctgtctcggctctcgagtaaccaacaaggcgatgggggattacaagtgggccggagacctctgtactgctgaaaaatgggccggaaataaactacacaccgctatacaagccgggagttgttctttgttaggcccatgatctattggcttcatcaagcaacgttgcattccttgatggaataagttttactttggatcccccatcttcacgtgcagtttaaatcgcatcatttgaaccataatatcatatatataacacatctctcaactctcaaaatcagtgcaaaagatgtcccaaaatagtttgaatggcggttttgactgacatgccatcggcgtgactagtttgactttgtcctcgtcccacatagcgctcacatggcactaggagcataattaaaaaatatatgggcccatatgttagtcaaacgaagaatataaaataaacagtgggtcccattttcctccacatcaccctctctcctctctatctcctctggtcggcggcgcctcattggctcattcccctgcccttctctccctctggactttctctcctccctccttgaaggtaagcagcgatggaggatagaaagcacgaagaccgctgcggtgcgggtgtggctggtgggggagaagctggaggggcgcgcgaaggaaggccagcgagctacgtgcccttcccttgttcccctccctctccaagcgctgttggcagtggtgaacacgacgacaatgatgacaatggcgccggtagatcctgctcgccattgtttggttcgatttttgctaaggtttgggtgcgggctttcgttgtgggtcttaccgggggctaggggatttgtgcacagcaaggaggaggaaggcgagtgcaagtacatccgattgaagcgccacgcattgccaaggtcgttcgcacacaagttctgtctgccagaggactcggacaccggcgacatctccacacattgtgagaatggcctgctcatggtcatcgtcaagaaatggatgctgcctgagaagaagaccacgtctgcagcccttctccccatcggccgccaccttggaggcctagacaaagatggggaagagagaaagagagagggggaagaagattggtttgctgacgtatgagctccatgtgggtctcacgctgactcggccatgttgagcgtagtcaactcaccatatcagctaaagctgggcacattactactattagaccttgggtaccttgatattacagataaccggatgcgatatatctaatattacagtttaaggacactatttaaactcgacgtcgagcgacggatctaaagtaaacttattccttccttgatagcagagttgatgtgaaaaacaaatttgtgtcatgtgattggaaagagtagagtgtgttgacagagtatttatgcctttatggagacatttttcattagaaaaccagtcatttttatgatactgtaaattatttacatttatattgtaattacagtataagttttaaagcttacactataaattccaatacaaatattttattcaatttaatacacggtataagagaactaggataaaaatgattgattacctacttgaaatagtagataggagtgacaaaaacatatttacatataaaagagagggggatagcaatcctataagaaaaaaatgactaaaaccgagtaaaaagtgtgatgacatatttttagcaaaaccaatgactatattatgctgggctaaattaactacatgatattctctctttttctttactttttagaaaatattgtaaactcgtagtttgttgtagtacgaaaaaaaaacttgtgaatatttctcccttacatctcctgctgaactaggagagggtttaagttgctaggaaccaataatgggtactgggtgtttaacttggtcaaacgtatctaatctgcaagacaatatgtatcagccctaatctgcaagactaacacatcgcctaaacaactaattattggcagaaatttgtgtctgcttagccttcatccatagtatacaagtataataatacatgatgtccctgttgcgaccaaccgcgtacaaaggtgacctctcactttcattttcagtttctctttttttaaaaaaaaaaaacgaattgaccgaacacgaaattaaacaacagctgatcatcaaaacagatgctatgacgatctctcaattagtcgattgatggcgacgtatgatccaatattagctcgcaaaaagatcacccaaatcttggtcctaaaaagattatcagtgtaatctgcaacaattagtaattaattttctcgtgtatatatgaagggacactgcaacgacagaaccggatacagaacaatagaacattgtttagactgacaattttcttgcgttgatgctagtgcgaccccaagtcacccaacagctagcatttgtttagacgacaagatgatattaattaattatagatgcgattaattatacaaaccagaacggtttgagtttttcaatctcgagagtgcatggtgtagggtaggccttccaaggtagtatcatgggatatcttaaggtttgtagttcagtttatggtacctattgcttagggaaatgatagattttaggtcactgagatttggggaaatcttagtcacctactagctagccgtaggagtcgtttttaacctctagctaaggaaagaagaggggaaggcagtagccatggcttacatgcaatggcgacaatgacaacaacgagcttcttgccgatcctttcatgtttttttttttatcaccgatgaaaccggctccgttagaggacctacggattagagtcagggctcaggtaggggttggaaacagcatcagaggatgaggtgagggaatgggaacattttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64019 - DNA, 1271 bp, Oryza sativa
ccaattccttattcctcatttcttgggtggaactgaaagcctaaggaatctcccatgggtcaaagttgtaaatgtcaatattggtggtgatgtgtatgaggaatgacaaccccgtgccattcctcttaggtaattaacaatcgattcctcgtctgtcggatggaactggaaccctgttgacaagctgaccaatgacatgagccacatagccatacatggtgtatggttagtacttgtgtgacttgggttcagatagaatccaccatccccgtggagtattgataaggactcatcaatttgtttgtcttctttctttctagtatctgttctttttatgtgtagtaatccatggtcttatttgtaaagtcattgcacaaaatcacttatgacaccttgttgtacattgtgttggggagactcaatggtcatgcaatgtcctctattattattttaggcagtgtgaaaaagttgaaaccctactctttaacacacataagatggaataaggaaagatgtaacgagatagagcattagagctaaccacatagtcctagctaccactgacacaatccttcgcaagtttaagtttatgtaaagaagatctaattgtctcaagaaaaaaaaagcccctagtgtagaggcactccctagaaacactatgaaatcacctaaatatttgtagtatagaacacattgtagagatggttttatagacatgtgcaaaattatgtggtagacattttttagacaatttctaatttttttctatatgtgtacagacattttctcgatacatttttgtctctctagaggcattgtttagagggtcgatttatgttgagtaagcagctaaggatatatctttgtttgcctttaaaagtttaccatgtcccttatttgtccctcattctctcgatggtatgtgggtcaacatgccatgggtaaattagggataatgtaaaacacatgaagattaaccatgatgtgaggataaaatggttaattagtccggtgaataccgagattgtgttctttatctgttcaaaagaaggtagtggttttttaggaaaaaaaagtattgagtttaagtattggtcataccaagatagacacatgattattatttatctcagtttcatcatgatcttttattacagtagtagcacaattaatctagtgttattataaaatgcttccactccttggaaactagaaaacaaagagtatttaggcattttgtctctctggttgtaccaacgatgcaagaaaag

SEQ ID NO: 64020 - DNA, 814 bp, Oryza sativa
ccaacaacggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaagcaagccggcggtgaagtcgtagacgcccaacagcggcggcataataggccagccgtgcaggcggaggcaccactcggcggcgacggaggcaggccggcggtgaagtcgtagacgcccaacagcggcggcataataggccagccgtgtaggcggaggcaccactcggcggccacggaggcaggccggcggtgaagtcgtagatgcccaacagcggcggcataataggccagccgtgtaggcggaggcaccactcggcggcggcgaaggcaggccggtcggtgaagacgtagacgcccaacaacggcggcataaaggccagccgtgcaggcggaaacaccggtcggcggcggcgaaggcaagccggttggtgaagacgtagacgcccaacagcggcggcataataggccagccgtgtagacggaggcaccaatcggcggcgacggaggcaggccggcggtgaagacgtagacgcccaacagcagcggcataataggccagccgtgtaggcggaggcaccactcggcggcgacggaggcaagccggcggtgaagtcgtagacgcccaacagcggcggcataataggccagccgtgtagacggaggcaccaatcggcggcgacggaggcaggccggcggtgaagacgtagacgcccaacagcagcg

SEQ ID NO: 64021 - DNA, 799 bp, Oryza sativa
gaagatagcatcagttggcgttataacaggccggccgggcaggcggtgacaccagtcagcggcggatgcggcggccggtcggtgaagacgtagacgcccaacaacggcagcataataggccagccgtgcaggtggaaacatcagtcggcggcggtcgaggcggccgatcggtgaagacgtagatgcccaacaacggcggcataaaggccagccgtgcaggcggaaacaccagtcggcagcggcgaaggcaagccggtcggtgaagacgtagacgcccaacaacggcggcataaaggctagccgtgcaggcggaaacaccagtcggcggcggcgaaggcaagccagtcggtgaagacgtagacgcccaacaacggcggcataaaggccagccgtgcaggcggaaacaccagtcggcggcggcgaaggcaagccggtcggtgaagacgtagatgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcggcggcgaaggcaagccagtcggtgaagacgtagatgcccaacaacggcggtcataataggccagccgtgcaggcgaggacaccagtcggcggcggcgaaggcaagccggtcggtgaagacgtagacgcccaacaacggcggcataaaggccagccgtgcaggcggaaacaccattcggcggcggcgaatgcaagccggtcggtg

SEQ ID NO: 64022 - DNA, 19420 bp, Oryza sativa
  unsure (1)..(19420): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatttgtgttttttttttctcctttttttttctttttcttttgtccgtgcgatgaagctagctcgtgatttcttcttcttcatgttttcgggagtaattaattaacgtgttcttgtgtagaaatatatgtgaaggattttctgtttgatcagggcatgtcttggaggagtttgcagttcataactttttttttttggtaaaaaaaaaagttgagttgttggtggcaagtggcaacggtggtctctctgtagaattgttgtgtaatttgtatcaatatatattgtatatagtaacaacggatatttatttgagattcattgcatcttacaggcttatgggttagttactttgtattgatttctttgaataatagtggtttatgtgacccaactgttaacgataaaatttgattttttccatcaacaccaacataaaccacttctccttctgtaccaaaatataaacaattttaaatgaatgtgacacatctactgtgaatctggataaattttatatctatatccgtagtattagaatatgtcacatttatccgaaatcttttataatttgggatggatggagtattattgaataacagttgtttgtgtgatctcctagaagtaatacacggttcatgtgttattttttaagagcggttttctcttggtgcataacggtataatgcattttgatgtgttccatagagctgctagctctacaatgatcgtttggtgaaaaaggttttgtcatttgatgaatttatagcaagttttcgttcaaaagaaaaggagaagtttcatagctaagtccgaccacagatttccacatcgttttcacgagcgagcaattgattaaattaattaatgggaaaatttgaaccatgccacataaattttgcaaaatttgattaattcgtgtagtttaacactacctccatttctaaatatttgataccattaactttttaacacatgtttgactgctcatcttatttaaatttttttataaaatatgtaaaactatatgtatgcatataagtatatttaacaataaatcaaatgataggaaaataattaataattacttaaattttttgaataagacaaacggttaaacatatttaaaaaagtcaacggcgtcaaatactccctccgtattttaatgtatgatgccattgacttttcaaccaacgtttgaccattcgttttatttaaaatttttgtgcaaatatgaaaatatttatgtcgtgcttaaagaatatttaataacgaatcaagtcacaataaaataaatgataattacataaattttttaaataagacgaacggtcaaacgttggacaaaaagtcaacggcgtcattaaaatatagaggtagtatttagaaacggcgggagtataatgtaatgacagattaagcaaattaagaatcgtccactgctccgtcgtcaatccacatgcgaaaaaccagtgtttttacagcgattccctgactaattcacagcctctgctggttacacctacctttttttttcctttactttaatagctaaatggttttgtgataattattggaggctacaaacaaattcattgactattataaagttgaaaaaattgatttaaaacagtttgtaaaggaatttgtttatagaaagtttttgcatgacaaggatgaatagcaacagctctgaaacaaacactgcagaggaacagatctccttccacactgcatgcctgttatgcaaagcatcaccattcagcatctctcctcatctctttgtttttttttcacaaatctatcacacatttacctgtgctgcatgatgagaacagagaattgcaagggagagttaacaccaagaatcatctgaaaaatgtataagctgtagcacttatggtaccagctcatgtacatggattcacaagagacatccaactacagaaaagaaatatatgtatgctctgcatctgccacttctgttatgagggggttatttacatgtacatatcccctcctgcgactttaacctatagaagctaaattatctatatgatgagaaataagaatccatgtatgtagtgaaacaagtctggatgtaaatttagtagacttcaccggtgaaatctcccaagcgctcactctggtgtaggtccacagaagaactcactgatcattattattcgctatcgtcttctaacagttattattcggtccgcggtttcttcaaaacgtatgcaatctgtggcataccttgtcaattctgttcctatgatcaaatgaagctagcagcgagaagcttttcgttgattaccgcattttgctcgtcttctcttgacgtctccaagcctcgacccatacatttgcctctgcaagcgcacgctctctatcagcgccgttcggggtaactctgccccttcccggtcgatgcgaactgctccggcaattctccttgacttcttgtaccatgtgatccgtcccggcaagcggtggcatatgaactccatgttgactgggcaaggaagtgtcttggttaatctgattatccagcactcttggtacagaagggccaggcagggtatggcgagcagcagtgttctgactttcatgtgtttgtgatgctaaatagagagagcaacagcaacctccctaatggaagggcggttcttcgctttctcctgcagacacattgctgcaatagccaaagcctggaacagaccccttttcgggaagtggccgtgtaatgaggggtccgccatctttggaaatttcctttggtctttgaacaatggacgagcctgcagacaaatagaacatttaacattaaaaacataatagtattcaagggatcaaatgatgaaaaagggacagatccaatttagtaggacacccaataagttagatgaacggtcatttaactggtactgagggggtatgttaagaaacagataagattcatttcctagaacgaggaaactcctggacacacaagattgagacatttacttcctgttccataggcattaggatgcatacagggaggttaattaataatataatttactttgttctcagaacatagctcacactatatatttgaaaaggtgtacatagcaccagtacccccacccttgcaccgttaattaaatgttactaacttcgaccaaataccatttttgatccttatccacacagcacaatgttgttaatgatagctgtagtataaaaattaatcacagaagaaaatgtattgtagcattttctataattccagtacgccattattgtttcaatgttgccctttaaacaatacatcttttatcctcattttgtttttctttgtgaaaatatgatcattgtgacctttcgtaacattctggtattgatagaaacatacccatgcaaccaagtcttgttcatcaggtggccgattgctgtcaagcgctcttcgtccagtaattagctcaagaaagaccacaccaaaactataaatgtcagatttgatcgtaagctttccagtcgagaggtactcaggagcacaataaccatgtgtccccatgacacgagttgtcacatgagtcttatcaccaacaggaccaagtttagcaagtccaaagtcagacaactttgcattatacccttcgccaagaagaatgtttgacggtttaatatcccggtaaataactgctggaatggcctcatcatgcagatactccaaaccagcagctgcatcagcagcaatcttcatccgtgttgtccaatctagtggttcttggccgggtctgagatctgtaaaaagcatcggcagcaaatttttaacagggtatccaggaataatacttaaggaaattaagtagcttactggaatgtaaagaacaatttaattctttttgaaccatgtggtctaatggtagaaacggacatgaagggtgataaacagcgacatgctgaatctatctctttattattgaatatacactgcagggtcctctcgtcaaaccaaaaaaaaaaaagtggttatggatggttatgaaaagttatgccctcgaatcctcactgaattctagacagatctgcctaaagttgaacattccatgctagctttagcttttgatcagatgcataagacaatggaaacaaaactaatctggatcctagacaggtctaccaaaatactggataataattttcaatgccaaaaacaatagcaccttcatcatacataataaaaaggtcaaatgatgttttagcaaggcatagtaatagccatttgaaggtaaaaggttgcgatgtttatcatttaaaggaattacttcaagccatcttcagatacaacagattataatagaaattcaaatttagaaaatatgatggatggaacattgaagaaaaccaattgttttctttgccaagatagaatgcagaaaacacacttcgaattcagggaaatccaaaagtacagaagttgtgaactctttctatattgaagttattatgtactatcagctactgatctttaaaatgctgaaagaggtgccaaattatcagctctttatttttttttatttcttctcacctagaagacagttcttttcaccatgttcaagtggttagatgtgctttaaatcacgatgatgtaacaatgaaaaatataaaatgttttctaacacaactacagattcttagggaactttcaggtttttctaggagctaacagaggatattatacaatttccaataaaatactaaccgtgaaggcggtcttctagtgatcccaatggcatatattcataaataagcaggcgctgatctccatccacacagtaaccaaacaacttgactaaattaggatgatgcaagagactgagcatgagaacctccacaaggaattctctgtttccctgaagcccatttagatcaagctgtttaactgcaacaacctgcgatgcagcaaatgctggaaccaaattagaaatttatacaaagggtatatagcataacaatactttctgttaacatcaatagtctaagcattcccatcaattttgaccaaaggaacagtttcttttatcaatatcacaaagtattcaaagcagtgttgttgaaaaagcttgtttcatgctcgcggcatagcttgggactcgaagtgcataaggagttgggtgcttgagtagaaaatacaaacctgtctatcattgagaaatgctttatacacactgccgaatcctcctcggcccaaaaggcactccgtgctgaagttgttggtagcatcagcaagctcgcgcaaagtgaagatcgttgcttcaccatgccccttatttcgccgaattccaaccatatctatcgacccttcagtcttcagtgggcaactctctgacgactttgaatattccactgttattgagaaatttcaagggaagaaaagaacacgtccactgttaatgaagatagactcgatacatcctgaaagagaaacagagttggaaatcgaaaacaagaatagtagaaaattagcgattttcttcgagtccacccagactgtttccttttctaccacagtgttcgtcttcttcataattttaattccgcttaaactaattcatgttctttctatcctcttctcccggtgaaattacgcactccaaagtccaaacttacaaacaaacttctaattttggatcctctcgtgtgacttcagatgaattgcacaaataattgctcccaccacaaaccaaaaggggaaatgagcaaacaattgaaaaatcctgatggttgactacaataagtctagtatctaaataaaaaattaaattaatgtacaaccccagcctgaatcatcccgaacccaacagcacaatcattaagatcaatagatcacaaataactcgattcttttttccttccactgcatgaaagaaaagcccctcttatacctgagagcatatttagctccacaagaactgctacaagtgacactaaccaatcagcaccaaacatttctactccaatttttaagcaagattgcaagaacataagaacgaattccaacaaaaagaataattaaatccacctgagctgactctctggccgcttcttggttcctcatcctcatctctcacctcttgaggacatgggaacaagcacgccaagaagcccatcgcataaatcaggctcaaaaagctccactaaagacggatcaaaaagacagaaaatctccgatttttagccgccccagcaggagatttcattccgcatagggacatcgaaggtcgcagcaaccatcaagaggagaacaaaaaatcgatttttttgttaggacagtcaagggggaggaggagaagaaagaagaagctgaaggaggatggataggaatggggtggtggattgcggccaaaccaaaaagtctccacccgcaatagaattgaaaaaagaaatcaaagagtggccaaaaggaaaagaaaaaacagtggggatcagacaaagtcaggatcgatggggatgttgggagaaaattattaggacagtacctggttaattgagaattaaattaggggtctaatttaattcaggtgagaattgcattcacatccctggataaactggctatttctaattttgactgaacctcttggaggccactcttgatcttacaaacttgactagctaacaacctgttttggttgggcctgtgcctatgtggtttatggacatgacaaaaaagtagggtgaggcagaaataaagccacatggcttaatcacttaaaaagcaatgaagcgtccacattttgaatcaattgataaagtattggtgaagctagagaaatctcgcatgctagcgataggttgtttgtcttctacaaactggtagaaaggaaagtgtttctccgatctaagatgtacgataatacatcgagacaaaaacacgccaacatctatgtatgagcggataaacgttaatatatcgaaaaatatatgtatatttcataaaatttgagaatcatctcactttacaatttcgtcattttatcccatataaactaaagacccctttcaccatcattggtctatctgaattcatttggatgtgtaccctttcgtctattttaaggatgcagatatcactgaacttactttccaggggcaaaccggaatttaagagtttctcgtgtgcaagacaataaatgtgcggtcgttcccatcagtgccgtaattaccattttctagaacgatttcacatcacgcatggtctcaaaagcttatttggtcaaagtgtatgatttgtttttctaatcagagatgaagaaaaaagagagggtgatttgtccgatagacgactacaatgacgctgacacgtcaaggtgataacaaagtaacatgatggagattaagggataatctgagactgagcaatccatctcaatatacgattgaccaaacaaagtaacaaaccatcatgagttcatgacctactttttttctaatataactaactactctctccgtcctctaatataagagattttaacattttacttactctgtttgaccattcatcttattaaaaaaatttaaaattattatttattttatttgtgacttactttattatctaaagtactttaagcacaacttttcgttttttatatttgcacaaatttttgaataagatgggtggtcaaacgttataagaaaatagtgaatgtcccttgtattaggggacggaggtagtatttaactggagactaatatcgcctaatacaatatgaacggatagttgtaattttgttacagagataatagaaaatatattataatactgtctaaaataaattaaaattcatgttgtgcaatgtgttatcaatcctcttgcacaacatgaatttgcttgttttatacgtagctatgtaattagcttgttttctaatgataaaaagttcaactaagttttaagattaacaagaggtggggtgacaaattcactaataccttctcttttaatgagtatagattgtgccggaatgtttcctttactagacaaacactggtaaaccattttgaaattagttaagctctattctactgccaaggtaaaattggaatatattggccgcccggtttgaagtatcgaagtttttgtctcggtcatacgagattgtactgtctttaacgaggtttatgttgggcgaaaaaatatgtctcaagtaagataaattcccaaattaaacgaatttaacactcccgtatatgaaaagatataaagtaatttgatatggtaaaattatccaaattacacactttggaagacaatataataaagagtaaattacacattacaccaactaaagtgtatcttatttcactttgcaccaggtttaatatatactcactttacaccagagtatattgaaataactctcactttgcactttacactaggtgttgtatcataaatcttgtaaaatatgattaaaaattattaaataaactttttaatttagactatgtttgatgaggattcattcaaaaaatttatgaaatgtcatgaaaatcctatatatttgatgatgtagttaagtgaaacctaaatcagtgaaccctggtgtaaagtaaaaatatgtgttaaacttagtgcaaagtgaaacaatgtacactttatcatgcgtaaagtgcaatttttatttactttccactttgaccaccttttaatatggaatagatataaataaactcttataaaatcttaaaatttatcgtacgaatctgatgtaaagaaagggaatcgaaatttttttttcttacaagtcacgaccgtgccaacggagccgttaatcaataagatccgtgacgatgagtcgatgaagcacgaacaacaacaacaagtcgctgtgtcccttagaacgatatcatactacctccgtttcaaaatattcgacaccgttaattttttagcacatctttaaccgtttgtctttcaaaaaaaatttgtgaaatatgtaaaactatacgtgcacatgaaaatatatttaacaataaatcaaattttatgaaaagaataaataattacttaaatttttttaataagacgaatgatcagccaaacattttgaaatggagggagtacttcataccactgatgatcatcacgtctcgattcaccgaggcacgacgatagccaacgatatccatttgctctcgacgagagtgagcagctagctcgctagcagccggcaaaatcaacggcggcggcggcggcggcggagctagcagacgacgagcagaagcagctgcggctgcggctgcggaagagggtggcatatggagtggcttctgctctctccaccgtcgccaatgcaaaccaccaacatgaggaggaggatgaacagaaggggggattttataagggttttgattgatggcgggagtctcagatcgaaccaatcattcatcgaaatctatctcgatccccaacaaactcgcgaataatcctaccgacctccgcgaaattaaccccttttaatttgcgcgcggccgcggcgtcttaaacttagcccattacaaactccaatttatctaatagccaatttatacaatagttgcttactatactattaatatatggtcccacatgtcatatacacactgcgttttagagtccgtgctgcaactggctacagatctgtagcccgctgctcttctctttcatcttttatcttattaaaatatatttatagctggctaatagcctgctattgtacctgctcttatcccttgcatggatgatggacgagcagtcaatcacccttcatgcgaaaaagctaatcgttccccctcactccgggggtgtctccccggtcatctccggaagggagggggcggcgcctcggatcataatcctctacacttgaagaagtcaagtgactttattattaacatgtggtcccaaagtcaccatgcatttgattgcagaggatctcaatctgttgcctccttgcatatggtcttttttcatttctagtttatttttggtttatttttcttttttttaatatgtgcatcactatctctatctctatctctatctctactacttaaaaaattaaaaaggtttccgaggtttatgtcgtcaatctaaatttttttaaaaaaagagcgaaaaaaagaagcatgattgtatggtaaaaagggaagaaaaaaacgcaaaaaaaagtctgattccctccccgtgtagtgcgcacgattttttttttccaattcctcccagatcgctccacaatttccaattctcttcctatattagtttaggtccatatcacgtttagccccactacgctcagatcaagcccactcagctcagatcttaatccgaacatcacaagaacactgaacaccccatattacatccaagccgaacaccacaagaacgttacatacattctatatatatatatatatatatatatatatatatatatatatatatatatatatatatacacacaaccaaaatatgtagtcggcggtgtgcatcgtcttccccgagaacgtctccatcgatcccggtcatggggaccacctgctcatcgttctcactggcggcggcggtacctcgccacataccgctctaagttacttactggtggcaaggtcgacggcgtcgaaccgcacctcccggaccttgcggcggaggcgggagcggacaccatcacccgtgcggtactgcttggggaggtggacacggaggcggtcgtaggcgcggcgccaccacagcgagccgacacaaccgtcacggtccaggcagctgcgccacgctggcgcccacgacgatcgcctcctcgtcgtgctcgtctatgtctaccacctcctccatgcatgactgttgtcgccgctgttgcaattgccacgcgcgcctcttgaggaggagcagctgcagagagatagtagtactacctcgtactggtacgacacttgataaggtaggagtaaattagcggtgaactacatgatggggggatttttttttttggagaattacacagtacaacgtagacactcacaacatacgcgcactcacccctatgaacgtacgcacgtaaaccctacccctatgagcatcttcgaagactgggccagcaaatcatcctggagattgatgaagtcaccgtaggccgacacttgataaggttggagtaaaatagcggtgaactacatgatggggggattttttttttgagaattatacaatacaacgcagacactcacaacatacgcgcactcacccctatgaacgcacgcacgcaaacgctacccctatgagcatctttgaatactgggtcggcaaatccatcctggagattaacgaagtcatcataggcgcctcgctgtcgacgggtacatcgcctaccattgaaagcacaaagccgttaaatcctgaaaaatttgctcccatgtggagttgaacccaagacctatggtgttactgagactcttataaccactaggctataggccctttctcacatgatggggggatttagtccaagcatctgtggtggtgtctatttaagatttgaggagcggatgttgttattctgtattttttataaaccatttagcagtttaaaaaagtatgtaaacgaaaactgagataaaatttgtcttaattagattagaaaagaacgagacgttaattgatgcattgcatataaacttcaaccttaacctaaccttatctctcctgtacccagtacactagttcgtccgtttcacggatgttttgccctgtatgcttcactccacatcactctcgctacaaaagaccattccgggggagcttgtcccagctgcagcttttctcaaaagctgcttctgttagaagctgtcccaaacagtctatagcttttgagaatctgtagttacatattctgaagaataaattaagaagccagaaactggagaagctgggtttcagagtttttccatattttcagaaacagccgcgtgttagaatctaaaaactaggtcaaccaagccctccatatctcgcggcttgacaagaagcatgccaactgatcagccatgtgtactactcgatgcctttgcttcccaagctctctttgtcgcgtcgtccatcagagttttgtgatcgagtctggagatataaggtgagctgatttgttttaatttggacatcagggttatttttttctctcgaagcaacatttatggacttcaagattaatagtaaaagagtgaaaatgttgtatagaagattagaagtattttccttgacaaaccaacggtgtaatccacggatgccatcagtatgtattagtagtcaaagtattcgaattagtatactttgttgcgagatatgtatatgtttaaataatgtgaaaatgatgtagatataatgatttgatattacttgcatattgagttctagaaatacaataaaattgtaaatgatatattatgtttacatgatatttaaaatattgtagataataattgctagtgggtttatgtggtacacttgcatgttaaacttttaagagtcaataaatatcaactttatagtattatatgattcatgcaactagcttggggctatatgaagagtatagtcagcgaggaacattatcggccttataaatcgaccacctggaaaccacttgataaaattaattaagctcatactctctctgttctacgagataaaatattttactcttctattttatcctaaaatataagatattttattcctcaatttctaacttttctactatttattccctatctactaacttttgtagttatattcctataactatcacttttgtatcacgactttgctacttccttaattttggaaaaagaaaaggtttaatcccttgtgtggttatgggatggatgaagtaaattcaattgtttgataaattttgatcaaatttgattggcagccagttagttatggaggttatggatgaaactgctaggcaacaatgggtcattttggatcaatgctaaaacgtgtcataccaattgttttggtagtttgagcagtaaatacgatggtttggtttgatgccaaatgatgggtaatgcacatgctcagtttgaaacaattctagaactttctttgctattatataaattttggcttccaattaatatcaattcgaacaaattcatttataatactctagagttattttggtgggctactaaaccaaacaaactttatatatatagggaataattaactatttgccgctcttacaagtgataattaaggatttgccactaggcacacatgtcatagattgcgagtggtaaatctttaattgccacatttcaaagtggcaaaaagttaaataccccgatatatagcgttgtgttgatttttaagactctactgaggatcaatgaggcttcccttgaagcatatgattttttggaaaaacttaggaggagctaaaatatttcctgtcaaaatcttataagattcatgcgttccaaggagccctaaatttggccatggaaacacatgaattatcaaacaaaaaaaggtaacagtatttgctcaagagaaagatataacacatattggcgtgaagtgagtataacttaattggttagtttcttcgtggtgcaatctatccacccgggtttttatagggataggtgacttcgtgaatctcaagatatacttatacaatcttcaaaggtgctcaaagggatagagtgattgcgtgcacatttatatgagcatctgttgttttaaaaaaaatgcaacaccacctagtcaaccctttgctaaggtgtggccaagatctattgttcacaccttaggcaaggtaaggggaaaaattaaatatggcgagtggagtctgtggctaggtaagaagaaaaaatataaggtggtgtttggatacagggacttaattttagtctctatatttagacactaatttaaagtattaaatatagactacttacaaaactaattacataaatgaaagctaatttgcaagacaaattttttaagcctaattaatccataattagagaatgtttactgtagcatcacataggctaatcatggattaattaggctcaatagatttatctcgcgaattagtctaagattatgtatgagtttttattaatagtctacgtttaatatttataattagtgtctaaacatccgatgtgatagggacttaaaagttttagtcccatctaaacagggtcaaatgtgatgagcgtagtctgtgactaaaaaccaattgactatgtttgggtaaaatgtggcattttttggttttcttttaggtgtttaatgtagctttggggaatgattttgaggtgtttttagtgtttgtaatattatggtgtttaaagtgagaactttttcttgggtcatgtgtatctcttgcctttgtttagaaaaaaatgtggcacttaattaagaaaacaaccctgtaaacagatggcctggcacgttaaagcgctgagctgttcagcgtgcagtggccgtggcccatggcagctcagcttgattatattccaattaggcccaaaactgtggcatttgggctaggcaaaatttgctacaggacacgcaaaaaacgtgtaattagctggaagacaccgcgaaaacgtgatacggctaacggacactacaaaaattgtgtaattagctataggacacttgtcgtattattttattattttcggatcaaaagaggtgagatatttttctaaatgcccagattgccccttctctttccttggttttctccttcgccgggatcgcgcgcagtggggtgaggttggcgaggtcggcacaagaggacgcctgtgcatgctccgacttgcaaatcagagaccagatcgagcccctgaccggctgcagctgcctcctggctgcctgctcaagctctcaagcctgaagtctgaaggagctcgccattgctgcctgctcaagctctcaagtctgaattgaaggagctagctagccatcttcttgctggtggagcgagctcgccggcgcatgcttggctgctgctagctgctagctggccggtcttcctcttgtccggcgagatggaggtgggcgccgtgagctgctaccggagagggagttggcggcgatgcgccgctgctctcgccctcgccgtagtcgtcgtcttcgccgcggacactcagcgccttcgccgagaacaccgagcgccttctcgccctgccgccccgctgccgccgagctcatgcccgcccactcgcgccgagctcgccgacgcctccccccacccgcgcggcagcggtcggcgacccctccccccgggtgcctgctctaggcccgtcgacctcgccgtcgtcgtcagcggccccgccggcctcgccgttgcgctgcgcatcgccgaggcgggcctctccgtctgccgccccgctgccgccatcaagctcgcgcctgcgccgacctcgtcccatcgcgcgggttcccggtgacctcgccgacctcgtcccatcacgcaggttcccggcgtaggagaaaaggaaggaaagagaaagggcaatctagacattcagaaaaatatatcacttgttttgactcggaaataataaaataatgcgaccagtgtcctatagccaattacacaaattttgtagtgtccatcagccgtgtcacgttttcgcggtgtctcccagctaattacacgttttttgcgtgtcctgtagcaaattttgcctttgggctactacaggaagtacactacagtgctccagtacctggtactaccctagcctttagccctgtttagatcctccaaaatagcaaaaattttgccattttgaagtacattttgtcattttggatctaaacactagtattaaaacttggcaatttgacatttggcatttgctagtccatagtagcaaattgtgccaaaaaaatgctttgggaccactccctatctctttctctctctcactttagtgctagaatggcaaaaatttaaaatacatctaaacaccaactaatacttttacaataataaaacttttaccatttaccatttgccatttcaaatggatctaaacatgccctttgctgcctttgctgcaaactgcactactgcagtgcaggctgtggctgtgcaccgtgcagtgccctgctctctctctctcacccttttctgttggtcctcttgtccttttgccttttttttccagggggaggacaatgtggcgtagtacggcctctcgccacctgcccaatcaattctgtctgaaccggatctagcgtgcaatcaagggaaaaagaaatggatttacatttataaatgatactaccgcagtttttcttatatacgacaccgttaatttttcatataattgtttaaatattcgtcttactcgtcttattaaaacttcagtataaatatgaaaaatataggttaaggttatagtttctttgatgataaaataagttaacaataagtaaataatattttatatttttaataagatgaatagataaatgtcacatcaaaaattgacatcaatattacaaaaccgataagcattcagtgaaactatggtcctatactcctgtcgtgtctttaagacaaaatacagtatgttttttccgttttccatcacgcccggtactccatatttagccgtactctgcgagataataacggttgttagtttaatatttcaaaagataccatatatatatccatatttcgttttttccccaatgtgaacttgtgaagactaccacgcttctagaaggtttgcctgtatattatgagaaaaaaattatgttgtccagatacttagacattgaaaaaattttcagtttaaagtcaagcttgtttgaatttaactaactttatataaaaaaattgcaatacgtagaacaccgaattgatttcactaaatatattttttaatatattcattttatgttgaaatgctgctacattttcataaaaacttggacaaacgtggataaattaaacttatgatagataaattaaagagaatcttataatataaaatggagggagaggtaattcttccacttcttacttagggcccctttgaatcgcgggattgaaaaaaacataggattttgataggaatgtaagtgtaaaacaaagaattgcaaaacgcaggaaaaacacagaaatgactgtttgattgaaccgcaggaaaaacacaggaattggatgagagagatagactcaaaggaaagttaccaagaggttgaagctcttgctaaatttcctctaaaacctctataggattgtccattccataagaatttcaaagaattagatatgacttaatcctttgtttcaaagggcttcatagaaaattttcctatatgattaaaatcctccaaaattcctatatttttcctccaattcaaaagggctcactccaatcgcacacccccatttaattaagctgcattcgctactacggatttggaaccctcacttcagcacgtaaaacggaacaataaattagcgtataattaattaaatattagcttaaaaaactttggaaatggatcaaatataatttaggaaacgtacgtgtaaaaacggaagatagaagttagctagggaaatgttcgaaagaagacaaacttactctctatactcttccatgcaggcttagggcatgtacaatggtctttattagcggtctctctttattatcatgcaagcatatttggtgacgtggaagagagagggagaaggaaaaagaaagatggttgctacgcatgacaacagcatagagtcgactcttagtatttattaggaaatttttcgttgcattgagtctaataaaggaaagatcactagtaagaaagtattttagtgcattaatgttagagacagtattgtcttaattattgtaacgtaatagcctctaattaacgtagagaccataccggtctctacctttgtacttgcccttagatggtgctaccactaacccgttgtctcattaactgttcactgttggccacgcgaccgttccatctatgtagccctctccccctcgaaacagtcctcccacaatctatagttctatcccaatatataatttgttatagcattcattcgatttttctaaatcgaacaaaaaagaagtccgaagaaaccccggagatcaatgaccgtaacaaaagaaacaaatatcactcaccggcctaaataacactccaatgcatgcctctttagatcaaatcgaagccaacacacttagaaaaaacatttttcctgatatgggggtcttttttttcacaggcgaacatgacccttggaaccaaataatcgcctataaaaatataaatcggggtgaagttcgctatccacctgcgaaaatagattttcgcagacggaccacttaagcggcacctgcgaaaatcattttcgcaaacggaccacctattttcgcaggcgaaccttatgtggtccgcctgcaaaaatggtacctaccaaaaaaaaactttgatacttatctactccaaccccctccccaccactcatttccctcaacactaatcttctcaactctctctctctctccctccaccggcttctcagctctctccccctcccctcccctcccctccatccctccaccggtggcgcagacacggtggcggcgtggacggcgacgtcggcggctcccgttgcggcggcgacgtcggcggctcccgttgcggcggcgacgtcggcggctcctgttgcagcggcgacggctcccctcccctcccctcccagatccggccggagggaggccgggggagggcggcggcggcgtggacgacgacgttggcagctcccctcccctctcctcccagatccggccagagggaggccgggggagggcggctgcgacgaggcgcgcgcgtggacggcgacgtcagcggctccctctcctcccctcccagatccggccggagggaggccaggggagggcggcggcgacgaggccattttttttgttttttcattggattttcgcaggcgggccattgccctggctgcgaaaatcgtgtcgttggtctgcagccggtcctctcctccgtctggaaaaattgcttttggccgcctaaaaaatgtttttttctagtagtgcaagcaagattagcatttagtagtttaaaaaatattc

SEQ ID NO: 64023 - DNA, 9205 bp, Oryza sativa
  unsure (1)..(9205): unsure at all n locations
tcccccggggccgccgctccgtgtcccctgccgccgccgctccgtgtcccccacctgccgccgacccacgagagagagaggaagagtggaagaggagtatgacaggtgagtcctgcttttatacaaatagaattctaactggactgccacgggtacgccacgtaggacaaaactgttctagattgggtcgagggggtgaacgttgtctgattttcgggttttagggggtaattcggtcgaccgcaatagttcgggaggtaatttgtacttttccaaaataaattataggaaagttgttttaaaaaataatattaatccatttttaagttttaaataactaatacttaaataatgatatgctaatgacccatctcgttttacgtattatatcaacatttttctttctccttctctcaaacactgttaaggatttattagcttaagattttgagaagcagctggttggtactcagcttttgagaatatgaagaaacagcttcaggtttctagtttatttttctaaattttacaaatagaacttctcatagtataaaaaaaaagttatactgtttgagaaatttttaattccgagagaagctgcaaactacccgaaactctcataaacaggctctaagtcttcacggaggagaaagtactaccaccacctcaacaacgtatcgactaaccaacggcatgcacatgcgctcctctatacaacatccaaattggccctatttggaagattagcccaggactaattttgagagctaatgtttagtcttgaatcggtaggctaaacattagcttagagtgacatgtttggaaccataggctaattcaggactaaaatgtggcgagagattagagagataggagagagataactgctttttttaagtccctatagaaaattagcccattagtacctcttgtatgggctaatgaattagcccacctgtttggatcagcccatgaaaccaaataagataataagctactccctctatcccttaatataagggattttgacattttgtttgcactgtttgatcacttatcttattttaaaaatttgtgtaagtataaaacccgaaaagttaagcttaaagtacattagataataaagtaagtcacaaataaaaaaaaataattctaattttttttaaataagacgaatgatcaatcagtacaagtatcccttttaaggggactgagggagtaattaattaatgaattagttaacgaggacaaacccgcacgcctggctcgatgaaaattcgggcataggatgcggccgcccacgggcccccgtaggagtacttggggtactatacgtgtcaatcatcaacaaaataaacaaataaataaaatgcccccacgccccccgtgcacgtgcgccacatctcactctccctctccccccccctctctctctctctctcacacacacacacacacaaactatcgtaacggtacataccccgtttgcttccttgcttctcacgtcacgctccttttcttgacggattcttttctttctttcttttcggcggttggttggtgcgttgaggtagagtagagtaggtgatgctggccgggggttagtgaggggtttagatgcaacggtgtaaaattttagcgtgtcacatcaggtattatataggatgctgtatggggtgttcggccattaataaaaaaaaaactagttacatattccgttagtaaatagcaagacgaatttatcaagcctaattaatctgttattagcacatgtttacggtagcatcacattatcaaattatggagcaattaggcttaaaagattcgtctcgtaaattacttgtaatctgtgtaattagttattttttagcctatattaaatattttatgtaggtgtttatacgttcgatgtgatatggtgaaaaatttgaggtgagatctgaacggggcctagtgagcgagtgcatgtatggatggtggatttgtggtggcatgatgagattagttgactttttgccagtatcaagaacagtaggagtatatatgtgtttgtgtgtgatgctttcagggcaatgcagcagaatgatgcttttgattgacatacagaaagtgcaagctacctattggcattttagctgtagtaatcttggccggtgattttttttctttttgattaataaatcgacacagatggcatagtttggaaaaaaatatcctctaagggaaatgaaaatcggttgccgaaggtggcctatacgagtatacaacttccccaggccggtgatattttggttgggttcgaaactcatgacgataaagataaagttaaaacgagaaaaagttatgaacttattattaattaagttttaattattataaatagatatatttgatattttaaaataactttttttatagaaagttttcgcacgaaatataccgtttagtagtaatggaaaccgaggtaaaatcttaatctttatgagaaaataacaggaccaaagtttatggctaaactagtggattagactagttaatttttcttggaagagaatcgatcgtggtagatttgccgttgagacgtagggaaataattattccttagttcgttgtgctagaaaacaagcgtgctttccacatgtgagtatagttgatttgatcacaagcgaataagagacttggggttggttgggccatgtactacagtaaagagtcatgccgtaccatgtgcttaataattattaatttttaaactaattttagcgctaaattacatctcattctacgcatatgtaaaaacaacacctaccgcaggattgcgaatttttttattgagtatcatattttacaataaagttataagccactaaattctaaaactcaaaataccacatcataattcattaacaattattatattttaaacattatacaagcatgatatattatttataattctataatttgttaaatttcagagctttaaaatacaagcatgttaaatcatcatcacacataattcacacaatatgtcaatatatcttttcattatcacttagttaatgatatttctctcttctcccattaaaccatatcatattaattatttttagcccttagatgattaatctatggtccaaattatctctcttttttcttctcttattaagacatatcatctcaattgttttagcccttaaataattaatctgtggtctaaattatcttcatcattttctcatctcataaaaccatatcatcacaattatttttagctcttagatgattaatctatagtccaaactaccgttctcttttttttttctcgtaaagccacgtcactttacttttacatttgaacaccattctatatactttttaaattattgtaaattacatcgacttatataaacttatgtcatctagttctcacatattatttgtatttattgctattatactaaactctcacaacaacacgcgggtagttatgtagtataaactatataaatcgaattagagatgtatggagtacacggtagtcgtgtcgtccctgttaatatatccttttgtccacgtgtaggctagtaacgtcatgactagcacaaggatgtgatcaaccgtgtcgtagttccgatgacggctattaaaggttaccataggaatgcggggtccatgcggcaacgagataaccaaaactcaacataacatatatctatttatgacgtgcaaattaaccttttatggttacgaagaaaatacataacaataaaaaaagaaaatttaattaggacacaatcaagacccagagataacacgcgaaacaatagatgacatgacaaaaaaaacaacacatcgctcgtacacccaaatacataaagcacgcccatttacaccatttcgtgacgtcagcgacacacattacacatatatcacctttttggtcacacgaataagcaaaaaacaatgcacataaaaacaacacatggcctctactacacacaaacacacagcccgcttgctcgtgtccactatttccatgacgccagcgacatgcatcacacatatatcactctttcggtcacgcgaataggatagtcccaaacacatgacatggattatggatacctcgaagtaattatcacataactcacctcctccacaccccacactcaattaccataaaacatcctagcaaaaagcaaatgaagcttaatataactccaaccgttaccgcctccatccccccacatttatgcaacgaagaaagaggaaaaaaaaaatcaccatcaatccccacatgtgaagtgagtgatagatccaccccttgatcaggcgtggtcctttgcacccccatcccaactcccattaaatttaaaagaaaaacaaaaaaagatactcaccatttcaggttataagacgttttgaactattttaagtttaactcagtttaaaaaataaaaacaataacattttcaatctaagataaatttattatgaaaatatattcaattattaatttaaggtattataaatattattatatttgtatataaaattagttaaacttaaaatagtttaactttgaccaaagttaaaacgttttttaaccttaaaaggagagagtagtatatatactaataaaaagtgaattcttttttttagaaagaaaaagagaaaaacagaagaaaccaaccccgtgtgaaacccggacaggtgctgcaaaaaaccagcggaaaaaaaggcaaggaaagggaggaaaaaaaacgaggagagagagagaaaagagcagtagccacaccacaccagagtggtggtggaaggaaaggaaacgcgagaaagagagagagagagaggagagagaataagaggaaacaaaacctcacccccgatctcctcctcctcccactccgatcgctccccgccccgatcgccgccgctgacgccgacgaaggcatggagcagccgcacgccgccgccgccgcagatggtggaggggagggggagggcggggctagccccgacaccggcctggaaggtgcgtgcgtgcgtgctcgttgtgtgcttttttgtgtttggagctcgaggatgtagatctcggcgtccgtacgggggtggcgcgggatctgtgtggcgggggtggtggatgagcagctgcgttttggttttggttttgttggttgtggttgcagggccgatgtggaggatggggctgggaggaggaggcgggggaggtggaggtggaggaggaggggatggggacgcggcggggaggctgccggagcggcccggggaggaggactgtgtctactacctccgcaccggcgcgtgcggcttcggtgaccgctgccgctacaaccacccgcgcgatcgcggcggcactgaggtgagtctcctaattcgcgcttcccttcccgatctggttcgttgcggcttgcgcgcgcgcgcgtgcgtggatgaggcagctctagggtggatggattaaccatgtgatcagcttagtgcccaagtgaggatcgtgccatggggaacattgattcggccaatgtaaatgtagttcttctgtagcttgaaaattgggcatgccactgcctagatcttgtccggcgcatcggtagcactcatcgggtagcagcattagagtttgggttcgcggtggaggtgcacctctgcaagttaaagcacttggatatccctttgaaagcagaaagctgtaggttgcctgctttattggccgcttcatgtttacttattctgcttttttgggtgttttgtgtttgctaattttgcttaattggattgtattgtactgggtcagactacatgcatctgcagatggcaaacttctgtgctcaatctttctttaagtaagatcagttgttgattctgataacataataaaaaatatccttcttttcccattccgttgtcattaatttggttgattaaatcaaatgtgtcaacaaagacatctaggatcaatgattattgacatgaaaatctttcttgcctgttttcttaccgttggttagcaaagtcctttgtttagcatatttggcttttggctgatagtttaccctctatcctgattttgtgaatttctcacttgttgggtttgcaaaagatatagcaactattcagtagttcttgttataagtttacattcttctgttgcaactgtgatctttctaaatgatttatgaaactcatgtctattgatagcctatctactttccatgtttctgttttcgttaagaaattgattagtttgtctgtgcgcatgggatgccatatttgcctatgctagtctataggtagtaaagcttcgcttgattttggaacatcaaaattaagtagttgctattttttcaaaatgtagtttggtggaggtgcaaggaatgcagcagcattggattatccagaaagggcgggtcaacctatatgcgaggtactcaaactaaacagcttggtgcttgaattcaattatcttttatgcaacgaaaaaggcacccgccatcacttaagcttgcattaacaccatgtgttctttgcttgctaactggcaggcaggcagggcatgcaacataatactcaaataataattggctgagattgttaagcacataacaattttaatgtcatgtcatatgacatgtaaatgttggtcctaattctttttccttgttttacagtattacatgaagactgggacttgcaaatttggtaccaattgcaaatatcaccatcctaagcaagatggagctgtgctacctgttatgttaaacaacagtggattccctatacgcctggtgtgaaatctctcgtaaaatattgcttattcatacacttgtttttcctgttttgaaaaagagatgttggtacaaataaaatgcagggtgagaaggagtgctcctactacatgaaaactgggcaatgtaaatttggaactacatgtaaattccatcatccggaattcggtggtgttccgatgacccctggaatatacccaccattacagtctccatctatagcttcccctcatccatatgcttctcttgcaaattggcaaatggggagaccacctgtagttcctggatcatatataccaggctcatacaccccaatgatgctctcatctggaatgatcccattgcaaggatggagcccttatccggtaattgatttgaattacatgttctattgtggaaaaataaacagcatacctataaatgcaaaactgataaacaaattggacatgacagccaacttatactatgaaatgcaaagtgaatcaacaaatgaggcacgacagcatacttgtgtcatgatttgtgaagcaggttctttgtaatctagacgaaagatgtagaatgtgcttattgtcttttaggcaagagctggaaggcactcactgatgtgctgcctgaataaccagccagtgtttaagtgttaagcaaacaatcagatgggacaaaataattgacacatgccatgatggagtcttctcattgtggttttaactcttctattttatacaggcttcggtaaaccctgtagtgtcaggtggagctcaacaaaatgttcaagctggacctgtgtacggcatggggcaccatggatcttcctctacaattgcttatggtggtccttacgttccatatgcttcctcaactggacaatcaagcaacaatcaacaagaacatggattccctgagcggccagggcagcctgattgtcaatattatatgagaacaggagattgcaaatttggagctacatgtaaatatcatcacccccgagagttgagtgcacctaaatcaggctatatggtcaactccctttgtcttccacttcgtccggtgagtaccctgaaacctctaatacgtaccgtagcatcaatgtccttgggagtggggttgaacttccatagtcctaatgtccatgttttttcttttttttttaaaaaaaaaagctgcacatatatttttgttttgaaaaacaggttgtaggaactagtcatatgattatgtccactactcgttgaagcctcctaacgataatgttctctatgtgcactttcactaggaaatttattgaggttcatggatntatccttggcctgtgtgtttgagtatgtgttaaaaggaggcgcacttatgcatgtgctcatgtttctgtgtgtgtgcacatgtgcatctttctttgtatcacaaaaagaagaagcagattattgggcaattaggcattgtaagctttcttatgctgagtatttagggattatgagatcatggaacatagttgattacttaataattttggttagctgataaatattaactgtgttatattgtcatctactagtatataacttttatgggccaaagattggttgaaacttgaatgtatcaagtaagatacattgttcaaacttagctcctgagttttgaagctatttgcagcttaaattgttattggatgaagcattcataatgtttttttttgacttaataagcatttataatatttcagagggaaaacttactcaataacactgagcatgtataaattgaaaataacattgaatgtgaggatgagccatgtttggcccacacgtcagtgtaactcagcaagttatagaaacaggggctcccaaatattcccataaatcagagatcactatctgagtgaagcgcaaacttcaacagatacatggactttaaatagcctaatacgcataatttcaaatgctagtgtctgatttaacttgctttgtagggaaatatgtcctatattgttaaaaatatccattggtgatattactttcttttctataattagtttggaggtcttgtaagatccccttctttagttgcaaactcatactaattgtttttcagtgtgatatcctgaattagtttgcactgcccaaaaggtttacacagttcttaaaatttatgctaggagacagcacattcgtgcattaatcatctatagtgtcaggcttgcatagtatgtttggaagaagttgattggtgattgcacatagacctatgtttttgtctttgcttttttgtagagaaaatgctccttggtttcttgctaagctgcttgtgttatctcaacttgcagggggctcagccttgtgcatactatgcccaaaatgggtattgcagatatggagttgcatgcaagtatgatcacccaa

SEQ ID NO: 64024 - DNA, 2271 bp, Oryza sativa
agcttcatcttaacctttcctgtagctggagctcagctaaacagtttcagcttcacctaaaatgagagcagagctgggtggaacgctatcataaaataaacaactccactttagacttaagctaaatttagaagttggagttctaccaaacaggtctttgaagctgaagctaaatttaggctgtgtttagatccaaagtttggatccaaacttcagtccttttccatcacatcaacctgtcatacacaactttagtcacatcatcttcaatttcaaccaaaatccaaactttgcgctgaactaaacacagccggaggagctaaatttagaagttggagctctaccaaatagttccttgaagctgaagctaaatttaggagaagtggagagtgcatttggcagctcgcctgtagaaatagtctagtagtagcgagtagtgacactgtagatgctgctggcttagtgcaaactgcttcttcattgccagtgtgtcctgatatgtgaagcattaatcagtgaagctaatctggacgtgacgcttgaaaagcttcaatgttctgctgtaatgcacacagtttcataatgtttagaatctagtacagttctgttttataatcgcagttttgttttcatgaggcatgcgtctctagctgccctttgttttgatctataggatccatttttgttgaaaagaaaaatgtttttctatttttttagataaaaatcggacattctattcattagcaggcaagtttacattcataatcagagtacgggaaggaattgagaacccccaaaaatgtttactagcgtagatacgctggaggcttcctcatacagatatcaaaatcttttgtttgagcagagagcacacttcataactttgtaggccaaatgatttttgatatttccatcagagcatgtaactaccactgtccacacaatcaattaattcgtacaactgataatgccaaacagaaatggctcattccgtaacaccgttatttctgatatttcctgttacaccatactgttatgctagcattcaaaatgaaaccagaaatgtagatgtaaggcagtgtcatacattagaaaggatagttttactttgtctgggaatcaaaagataatcagaaccaatatagctaagattatttctgagatgcagctttagcagctgaacacgagcaaggagaactcttcagaggtagcaatcaaatcatttgcccatttcccagacaatggcactgtcctctgcatcagcaagtaagaagagtaagtatatgtacaaaaatatacaggcaacaaacaaaaaggtgttacatgctttcaattgttcaacccaacattatccaagacaaaagaagagtaatgctttcaattgtataatacaacatcataagttttcaagaaaacagttactttgcaagaacgtaagttgaagagcactgctacacgtactaattttttcttactaaatttgtactaacaatcatatcaaccgtttgatttaagcagatggaagttataaaaaatctagatggactcatagcatgacatgtcagtgttagtaaaaatttagtaagaaaaagttagtacgtatagacttttcctaagttgaatggcccctcctgctaccaaataaaacaagaatgcacctttgatctttttgtttatccaaacctcaagcagcatccctgcgccaactccagcagcacacgcagcgccatagattgccaatgcagaaggcaaagatcgccgaggcagaaaatagcattcaggaacttgtctgattttcttcgggagacgctttttaacaactggttggcttgggtcggtgctcaccgaaccaccaactgttttccagtccacattcttcagcatatcttttgtgtcctcactgcccatcctgaaaacgcctgtatgcatcaatgttaatcagaaccaagctccaaacactatctgagaaagtgagtggcagctccaaacaccacgtcccactaggcccgaaaaccttaatccgcgaatgtctgaacgcggcaatgggggtttgggtttagggtttccgggggagaggaagtgggggatggattccatggtcttagagggatggcctgggaggcagaggaccggcggcggcggcggcggaggggcggggcgaggggatgtggaggaggaggaggaggaggaggcgcggagctgacctggatcgcctcaccgtcggggaggtcgagctcgtcggcgtcgtcaggaaggtcgccagcgttgttg

SEQ ID NO: 64025 - DNA, 7410 bp, Oryza sativa
gtccctggtttcgtttgacgtggcaaaaaaaaaaaaactaggacccacgtgtaagtgactgttcgactaaaaataaactatttatagtgggacccacgtctcctccccaatctcgctgtctcttgccgtctcctccttctcccaatgcggcgacccagcggcgggatccatgcggcggcggccaacctggcggcgggacgatgagcagtggccggcggggaaaaggggcagagcgcgccgacttggagacgcttcggcgacatcgtccacctcgacacgagcggtggacgcggcggatactcctcttcctcctcccctctcttggtcactggccagtggtcaccgctcgccggagaggaagacaaacttgtggtggtcgtcggccgattggcaatcattcggcaacgacgaccgatgctggttcagccgccgaacgccgacgcccagcacactgacatccccgacggccgctccttcctcggcgtcccccgctactaccgccacagcctcaccgtcctccagagagccgtccgctcctggaatgcccacaaccacaagcatccaatgacggcggcggtggcgccgtccgcttttgtgtcaacttcggtgacatcgtcgacggcttctgccccaaggacaggtcgctgctggccgtccaggccgtcgtcgccgagtttgaccgcttcctcgacgcgtacgacttcaacgccgtgggatggtcgcgcgaccacccgatggccgcggcagcggggagattcttggacaagaggaacccgaacacggacaagaacaacccgagcggccttgccggcgtggccaggcggttcgtgatgttcaacggtgccgtctgtgaggcgcagctgcggtggctcgacggcgtgctgcggggtcggtgctgtggcgggaaactgcggtggtgtgcaggcacctgccgctacacctcggcgcggcatcactgtcagggctgatgtggaactatgagggggtgatgcgcgtggtgcaccggtacggccgccgctccgcccacgttccgccgccgctccggccgccgcccgccccgcttcgcccctctcttcctccatccctctgctctgccgccgctccggccgccgcccaccacgctccgccggctggagaaagagaagagggagagagagagagaggggatagagagtagtgaggatgacgtgtgggcccacgtgggtcacaccattttttattacgattttgctatcgattttgctatatctcactcgaaagattttttcttatctctcactcgattttcttactcaaatttacagtgcattttcttgtaagttacagtgtaatttatgaaacttacactgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgattataaaaatctttcgaaagatgtatagttactcccttttgctatatctcactcgaaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctagaggatatggtaatttaatgttcattatggtgtttcttaattgctttttgctttttattatatctatcggattttaatacaaagattaaaaatctgtgtgatatgattataaaaatctttcgaaagatgtataggtactccctttttattattttgtatgtgcaactgacatgtgggtcccgtaggttttattattttttcggatctaattgacacgtaagcgccacgtcaacgacatgtcagataagaccgaatcaaattagccacgtatgcgccatgtcagccaaaaccgctatcaaaaccgctgagggacctcgtttgcccggtttttgtaagttgagggacgtgtcgtgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctctctcctttcccccgaggccccacctgtcgggtccttcccccacctcccgccgatcccggtgcgccgccgcgccgaaaccgccgccgcacccacttcctccgctttcgccgcgcccacgccacgtcgccgccctctccccgcgtctcccggccgcgccagcgcacgagaggggcgggattcgattttgaatctcccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacccttcccggccgctgctctgcgtcgccggaataccaccgaaaccccatttccctcgcgtcgtcggtgagttctctctcccctccgactccggccggcgtggatggtcgccgtgggggttttcctccgccctaattcctctcctctctttccctaggtgtcgccgtcgctcgtccgcacctcggcatcgccggtcttcgccgcctccctcgtttttctccgccggccattgccgcccctccggtgaggtctccctccccttccttcccttcttttttttttccccgtgcgccgccgccctcttcgcgcgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgccctccccctttgactcgctgacgtgtggggcccgcctgtcggcgccggccctttgctgacgtcagcggcagtccttttcctttgagaaaataattattaattgcgcaataattcgataataattatagaaattcattaaaatggctcaaaaccttctaaaactcatatctaattcattcgaactccaaattgagccattcaacttgcaaaatccatctaaaattgagttctacatgtttgtttactttttatgtactgtttccttggtttttattagagtttttcctcgttttgcgtgccagcgtgtagttcccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgtcctttgtcaaccttgggtgataaatcgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagattttaatgttacttaaattactcaacagttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacaaagtggtatcagagccaactcgactgtaggttgagccaaatggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggaggataaactgtcagcttcgtgtctgttcggaagtcaagtcaagcatcaagcttcgtgcagcaaagagcgagaaggtcggttcagagtcgtcgttccgtgaagatcaagaagagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagagtagcggaaagaactccagcagtagtgtgttgcagtcaagagtcagtgtgttcatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcgaggacaacagttcaaaggttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggtttttctggaattacttgttatttgaattgggaccagtcgaagcggacatagggtaaatgatttataaatgccagattccattttcatcctcttatagctagcgtggtgaattctcaggttaccaaaattgctaacctcaacagttcagcccaagctaagtaagtttcaggagcatccgcagtcctagactgggtcagttcaagcaaaaccagtcggtccagttttggcaaagcaaaggaacagaaaggtcgaatccagccagttcaatcgtacaggtttgatcaaccagtcaatcaatcagttcgaagcagaatgtggcagttcaaggtgcagatcagtcagaccgcccatcagcaccggctttctttctagccatcccagaatctcgggacgagattcctgtaaggggggtagatttgtaacgccccgattttcgttcgggattaaaaatcaattaataatgcatttcctagaaattaaataaaagttaaagcaatttaatcaagtgaattaatgggagaattaaaatttttcccttaaaaatcattggccgggaatattttgtaatattctttgtgccctaatgtactctccggaattttccgtgaattttcggagctcaagaagtaattttaatggcacaaagttcatcgaatcaattaaaataaaaagaaaagaaattaaaatcccctctttgtctttgggctcggcccattctcccttccctccttccctcctttctccgcgtgggccggcccagctcggctccccctcctccaagtccacataacccccagcctcctccctcctcccctcgccgacaggtggacccgaggccccacctgtcatcgtctccccccaaccgtctcctcctatctcctttcccccgaggccc

SEQ ID NO: 64026 - DNA, 2790 bp, Oryza sativa
  unsure (1)..(2790): unsure at all n locations
ttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacatgtcgtacccggttttgcggttcagggacgaaaatcagactggacgacaaatagagggacctaagtgaacttattccaacaaagaaaggggagaatctatataaattggcaaaatttgctacaggacatctaaaaaaacgtgtaattagttagaagacaccgcaagaacgcgtttttgctgtaggcaccaaaaaaatagtaattagctaatggatacccgtgtgattattttattatatcgggaagaattgaagagagaaataactgtgtaattatgtttctaccctttgatttttttcttttccttttttttcttcattatctttttctccctctctcattctttctctttttctctctctacacccaaccaccactacgttctctccttccgctccttccgggaggacgaggtcaggcgcctcatccgctccatctccgccgagagcagcggcggcaccgccgccttcaaccttgcccgtcgtcgccgccgcttcgcccgttgtcgcggggctccaaatccacctgtgtagctcaaaaccaaagctggtcctggggttttgggggcctagggcaaaaacttatatggagtcccctatatatacataaactaatatatatatatatatatatatatatatatatatatatatatatatatatatatatatatatatatttatttatttatatagtcttattaagagaaaaaaagatagagaaattcatcagataagatgaattggacttggaggagtgtaggaccttgaaatctgatgaattggaggagtgtagtccaggcagcaggtggcaggggcagcgagcaatgagcagtagcgagcaaagaaggcgatcggtggacgatcgacacaaacgagcatggctactggtgagccgcgatttgccgacttgccgttttcgtttgcgagacgctaagaagtcgccgagagcgcaggagcagcgagcgacgtgagtagcatgcatgatgtgatcgaggcgaagcgacgggagtaagatgaagatcgcttcggcttcgctgaaacaaacttggcgatggactaaaattcattttctgtgttgggctatttagctgtctaacttaatataggcccatgtcccaagaactaaaattatacaatacataatatatatactatatgtgtacgtataaaggcccctagattttgagggactcgagcggccgcacagcctgaccccccctagggtcgccctgctcaaaacgacgcacaggcagagcagctagcaaccaaaagcaaagcaaacaatggagctgcgactgcgagcaagaggggacatgatgcggtgtagccgccgcctcctttgcagcctcttcctcgccatcgcagcgctgtgtagtgtcgcgtcggccgcggcgacgactgggacatcagctaccagttcacgtcctggactacgtccgcaagctggccgtcaccatcaacggccacacgttgggccccaccatccacgccgtccagggggacaccatcgtcgtcaacgtcaagaactcgttgccgacggagaacgtcgccatccactggcaagacatccggcagatcggcacgccatgggcggacggcacggagagcgtgtcacaccctgaagttctcctcccaagcctaaaatttaatttataaatgaccctaagaaaatgccggtgcaaatcaagagaaaaccctaagaaagtaatacaaataataatcgaatctgacatgtggaatttttcttgagttctacatgtcgaaattcactaacaggatttttagtggaattttcagagccctagaaataattttaatcaattaaaattgagcacaggcaatatttaaatccctggaaattcctttctttctttttccttttctttctccttttcccttagtgggccgccggcccatttcccctcctctctccccgcgccttgctgggccggccggaggccacgccctagctcagcccgcgccccctcctctcccggggtcaccgacaggtggggcccacctgtcgggtcctcccccaacctccagccgctcgccgccgcgcccgcaaccgccgccgcgcctcgcgtccgtgcctcccaggccacgccgtccacgtcgccctcgcacccacgcctcccgcgcccacttccccctctctcccgctcgcccgcgcttccgagacggccgggattccattttngaatcccgcctctctctcctctcccactccccccacgttggccggcgattcccgcctctcccggccacgtccggccccctctctccctatttaagctccgccgtcatcctctctctctttttccccatttcgccgaactctcccgagctc

SEQ ID NO: 64027 - DNA, 923 bp, Oryza sativa
ctctccctctctaatcttttccttttcgttctttaggtcgtcccggtccccgtccgccgcttgtcgacctccctccgccgctcctcgtcgccggtcgtcgtcgtcccctccggtgaggactccctcccctttcctctccttccccgattccccgtgtgccgccgccacccacgctcgtcgtcgccttcggtcgccgtcaccgccggggcgccgtccgctaccgccgcccgcgccgccgcttcctgtcgccggtggatgtgcgcgtgccgccacccttgccatggccggccggccggctttgtgccaagccgagccgagccaggccgccgccgcaccgtccgatcggccccgggctgatccgggccgtcgatcccgtggaccggcggtggaccacccgcgtggtcccggtccacggtagaccgaccactcgtgcgccgctgccgagtggggcccgcttgccggcgccccttttccctctctcccgagccgctgaccggtggggcccgcttgccggcgccgcgcccccccttgattacgtcagctctgggatttattgcgcaataaatgatttaaggactttttgttatagtaataaacacagtgaatcttctaaaattcataactaattcatccgagctccgtttaagcccattcaagtctcagtaaatcaagaaaaatgtgtagaatctattaaaaatggttttgttccctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttttcttcaaatattgcattgttttataatgttact

SEQ ID NO: 64028 - DNA, 2243 bp, Oryza sativa
ttcaattacctaagaggagtgacatggggttgccattccctcataaacatcatcaccgatattgacatttacaaatttaaccaatggaagattcctcgggctttcggttccacccaacagacgaggaattgcttgtcaattacctaacaagagtgaaatagggttgtcatcccttatacataccatcaccaatattgacatttacaactttgatccatgggagattcctcagggtttcaattccacacgacggacgaggagttggttgtctcccaaaatgtatcgagaaaatgcctttacacatagaaatattagataatgtctcccaaaatgtctttgccacacaattttgcacatatttctaaaatcacctcaagccatatctaaaatgtccctatgctacaaatattaaggtgatctttatcatgtttctaggcgaggagtgtagattatgagacttcttttagaccatttgaaattgtctcagcatggagagttgccctttttgtgtgtttccttgtgtgtttgtcctaccaaagctcacatttcttggtggcacactgtggcacacttaacattgtagcacacatgcacacctttttgccaccccttgaataggccactacttgacagcctcattggttggctgttgctaaggctgattttcagcaacagcccatcggttggctccttagactatagcatcagatgatagaaaaacttatgctgataagcatcagcctagttgtgctgatatacaacagcatatgccaaccgatggtggcctgaataggccactataaaagaccatccatccttgaccaccatcacactaaaggaactcaacaatagtgaggattctatcatattctcacttatggtgatgtggctcattttcttggccagcttgccaatggatttctagtttcatccgacagatatcgtcgatgttgccaaaagattgctgatcacgacgggagtgttgtcatctcattaacatcatcatcgatattgacatatacaactttgacccacgttttttattgaatatccatgttttggtcatacatactttattattgactggacagatccaccggttgttgaccttgaaccactggcaatggaaaattctattattgatgacattaatgttgtctttatcaatgaggcaacgaccaaggctatcctaatgaggatgatgttagccacaaaattgatacaaaaattctaaacaataaacaacatgtgtaaccaagagattgatgctcatggatcgtagcttcatttgcggccagaatcaacaccgagcatcaggagtgaattggtggatggttttcatttcctttaaaaattaaaaataatttattcatcgtagagaggatggccaaaggcttttcactctctttttgtttgtggagtggcataacaaactaagttgggttaaccagtatagcttaatcgataaaaccataataaatcagttttaagtttgtggtttccttgtttgcatttattataaggctatcaatttgtacttatgtgcatgtagtttatgtgtatgtagtataccgcacaaactcagaagataaatcaaaattcaacatgtaaacaaagttggagaacaaaggaggtgatgcttgaatttatgtaaagaacacggccgtgttcttttctccaacaaaagttggattaaattttggatactcggggcacatttttcaaactgctaaacggtgtgtttagtgcgaaagttttctatataaaagttgttctaaaatattatattaatctatttttaaagtttggaataattaaaactcaattaatcacaggttattataacctcgttttgcgtgaaacacttaatcttcgtcttcaggacattcaaacaccacctaaatatagagtttgggtaataaacagaatcttgtgtgaaaaaaaatgtgtaaagaaacactttcaaaggagtttgtgcgaaaaggaaaaaaagaaaacccattcccttctcacgcaagaaatagctacagtaccatcaccactaggctgctactgctagtgctagccagcgtcgtcctcctactactcgtgaggcgagagggcacgtgacgcggtggggcccacctgccagccaacccagcagcagcagcagcagcagcagcagatggcagcgaccgtcacgacgaccgcgcattgaatgcgggagggagacgcgtctactctttccgtttcgccccctcctc

SEQ ID NO: 64029 - DNA, 2542 bp, Oryza sativa
gcggactgcgtctactacctccgcacgggggcttgcggctacggggagaactgccgctacaaccacccgcgcgatcgcgccgccgcagcagtggtgagcaccaattccccctctcgctgctctactcctctttttttttttttcacctcctgactttagctacggtgacaatgaccgccctattggattacgtccggttgattttgaggtggggggcttcaagctgaaacctctcgccgagaattaattctacttatggcctgtgggatcttatcttgtgagcatagaagtgaaagttgattgcgcctttgctggtagcgatggtttgcttgattagtttggtgtctcggtcttatggttgatgtggacaattctgagctccacatgcaggcctagccacttgtctggtcctttttttttctgttggcaaacgcttccccttttcttttttaatctatgttttgcttatggatcaagtagatggaccatgtgctttgaactggtggtaaagattagagccttaggtagagtgtaatgattgtgaattcatgacaatggattgaaatcgaggtattttatcctgcttttgatttaaacattcatattgttatttgtttattagttaaatggaggtgggaagaccacacattcggcagagtatccagaacggccggggcaaccagtttgtgaggtaatttatctgattctcattttgtgcaagctctcactcatatgatcatatcaaacccaaaaaaatgtgcctatagaagtgggcaacctatttaggctacagatgatttttttttttgtgtgtgtcatgtgctggatactcttcgggttaacattttgtgataaaaaatgcagtactatatgaagaatggaacttgtaagtttggctctaattgcaagtatgatcacccaagggaaggctctgtgcaagcagtcatgttaaattccagtggataccctctacgctcagtgagataattcattcgatcaattcttattaaagtagtggcctgcctttttcattttctgatgaaatttcttatgtgcagggtgagaaagattgtacctactatgtcaaaactggccattgcaaatttggatctacatgtaaattccatcacccagaaattggtggagtttcagagacacctaacatgtatccaccagttcagcctcagcctatctcttcctctcatccatatcaacatcttgctggctggcaaatggggaggcctcctgttttgccaggatcatttttatcaggctcatatccaccaatgatgcttccgtccacagtcgtaccaatgcagggatggaacccttacattgtaagtttgtcatcattttcttctttgtaccacatgtagtggatcatcgagcaagggtgttattattatctctactactttaaaagcacaatcgtttacctttccttccctatcccaccctccacataaaaaaaacgtaccattccctataaaaccgcttccatccccacctataaaaaaacgttgtagaaaaggaccgagaaaaaacagggccacctatgttacgatcaaactaaaccatgtttcttagatcccattgcgacacagggggcatatgactagtaaattattaaatagatcttctaatctagtacaaactatctagaaagaaatttattttttcttattaaggatgtactttgaacatttatagtcatcacaataaaataagagaattggctggtaagagaattggctacagagtgacccagaaaatttaacgtgattcatactttgttgtaagaacaattcaggatgacttcttaattttgtgctacaaataatgctgatgtaagtgtcagaaaaagaaaaaaaaaagctgtattgacctctttactatgttttatgttcttagtcacctgtgaaccaagttgcgtcagctggggggcatcaaactgttcaagcagggccgttttatggcttatcgcaccaagggccttctgctgcagtcacttatggcagtcagtatgcaccgttatcttcttcaaccatgccttcaagtagcagtaaacaagaacctgcctttcctgcgcgacctgggcaacctgaatgccagtattatctgaagacagggagttgtaaatttggatctgcatgcaaatatcatcatcctcagtatttgaatacacctaagtctaactgtatgctgagtcctcttggtcttcctcttcggccggtgagtagctccaacacatatctgcttttatatgcttaaactatgtgtagcacgctgttgccaggatagtcagtccaaatgtatatcgcttgagtctggattagtatttgatatgttgtcccagataagtttgccatatagtttattgtattgagagaaccaaattgacgggtgagttttggtgtacacatgtaggctgtggttgttccagccggttcccaacaggaacagtacgcacggaaaacagaccggtccattagcgcgtgattaattaagtaaaatggatcaatatgattttttaagcaacttt

SEQ ID NO: 64030 - DNA, 933 bp, Oryza sativa
caaaatgcttatgagaatatgtatcttgatgatgaaattgatgtaaacccttgaactggatgattgtaattgatatgaacattttagctatgggctgtactcttttcctttctagggttttctcacgaggtgtgagtttttacctagaaaggtttttaatgaggcagccattgcacaatcacagcttatataaaccccttttatattctaactttctaaggtttgtgattctgagatggacttgatggattatagtagatgacttgatgtatgcatttgatgaattgatttgaactgattgtaaatctatgagactgtgacttgatgaattggtgacttgaagaattgttcatttgtttgtaaatctgtgacttgatgtatgcatgatttgataaactggtgacttgatgaattgtttgtgattctttgacttatttgatgaattacatgtgaatttcatgaatttgatgtgttatgtcaatttgttgtgttgaattgaacctttgaaggggttttttgccagggcgtgcctgggccggcacgggcacgatgggcttgccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggtcgtgcctgggccgtgccgtgccgggcggcccatatggccaactataactggggcggacggaggatttgggtggtatccggaaaaggctagtgccgtccctggtcaattaaggaccgagccatgaagttaagcatgaaacgacccccgtacaaccgcgcttctcgtatgggtatagacctagcggagtagatggctgagcggaggcagtatccatgcatagtggtttcttgatg

SEQ ID NO: 64031 - DNA, 9856 bp, Oryza sativa
aatagccgtgctcacggttaatgagcaccgggacatgtattacacttggctagactctaaattcttaacttgtgggggatgggatattgcatgatgaattttatgctgatggagccatttcccgagaggagggaaggtggacatcctcagaaaaccatgacgattcaatggcgggaagctatccttgggatcacaatggatggtggacagaaccgtcgttgtttgaagtgaacactggtactaaaatttgatcagtctatgctaggtttcaggcttgtgaaaagaattgtaaaattagctttatgcaaaagaacctgaagccattccttgaaataccctctatcatatgcattgttgttgtggtggcttgctgagtatggttggtactcacccttgctattcatatatcttttaggagagtgttgaagagaagcccttgtcggtacgcttgtgtatccaacaagatgatcggagtgcggtcttgttctaggtctcgtttcccagtcgactgcctgtggcatgttaaccgggctcttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtcaacaaccccctaccgtgtcgcccttcgacctcatcagtcctgaaaggcaacttaccagagcggccccacttggccagcctccttgctctcctcatcgcctcgctattgtcacgcccggaatttctatccgaaattccaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaaaagataaacgacgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcttttattatggtgagaagtgtgagactaatcacgaaagacattgttaggcccgcccataaccgcgggcacggctattcgaatagttttactctgatcagaggtgtaccactgtacccacaagacacagccccacatcatgtcactatgtgcctcaataccaccacggtacctcggaaaggagctgtgacaataccccttgcacaacacaatccactacagcgcacctttcctggttcataatcacccccttataaacaaggcatggactccccagcgacccctgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgccatgagcacgactctcaaaaccatgtgctcacaacccaccattatcaagttttagttggcaaataattaattaaccaatcacgattgacaatcgtgatctatcattaagccatcattaaatactagtgaatcataagttatcccaatagtgtgctaatgtttctaagcatggctaagcaatcacatctaatatctagctgaaccaatatatatagcccaactagtcaagttataatcacccaaggtatcaaggaataaagtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgtcttgctggccttagaactcttcaaattcttctcctgcgaaaacggacactccggaaacgtcggaatctaaacagaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggctcacgggaacgaacggccgagatcgatccatccaaaacggacggccgagatcgatcgggtctacggcggctcacggcagacggaccctgatgacgtcagcggtgacgtcatctccggcggcggctcggcggctcggacgcgcaagctcgccggcgaacgacggcgcttcggcacgaacggagggcactaggacgatgcgggcatcgcggcgaactcaccggtgatcaaagcaacggcggaggggcaacggacgacgtcggcgacgaggtcgaagcggcggagaccttcggcttgacgacgacggcggtgctccggcgatctacagcgacggcgaaggggcggacgaggacggcggcgacttggcgaccacgatggcgacctccccgagcgacgacgacgaccggaacggcggcggcgcacggctggagcggcggcgacgactgcggcacgagatccacggcgctagggctcttccgacgacgagagacgaaggcgagggtggcggcgggtagcggcgagcttggggatccttttataggggcaaggaggcggcggcgaaggcccacggcgaccggcgacgcgaaggaaacattggggttcggaggaaagagaccgatccgattcgacctcgaatccacgaatttccaaagcgatttagacgatgattccaaaagagaaaaggtagaggagatcccgaagatcatttcccctctattgatttcaccggagaaggaaaggggcggccgaatttgggaagcggcggcggcggcgcggcgctagggtttcggccggaggaagacgacgactccgacaggcgggacccacctgtcagcggcagcgagctcgcgcgggcggctgcggctgcggactaggccgacttgggccggggagagagagagaaggttttgggccgactttcggcccaaagccaaaagagacttttaaaaaccttttttaatttaaattattcatgaaatgcaattccatttattaaaaatacttccttagctcaaataaatcccagaaaaatctaggaattatagaattaagcaaagtatttaatgaaattttatctgaccccattttatattggaatttattaattaaaattagatcttctcttctagacttttaaaaataaattctaataattccatttaaacaacaatttatatatttaggatttttagggtgtgacagctatgcccccgccaccaacgtcggcccaccgcctgctaccgacctcgtggcgtcgtcgccgcctcgccctccacccttgttcaccacccattgtcagtccgctgcccctagccaatccctctaagtctgatcccccactttcccctccctagttccactcactccaccaccaaagttctaacgctaatcttaagttggggcttgtcgttatgtggatgggacgcgtttgtgagatggacatctcgcgagtgtttgcgaactagtgtttccacatgccaacaattcagtagaaggcagaagtaagaggcaaagtgagagtatttgctgctacccagtggtcactagctaatcgatcaatcggttgtgcctaatttctaaataatgaatatgaattcaaatgatgatggaggcttcaaataagaaaagcagtgatgcgctacccgatacgttccttcatgcttcaagcttggccagtgtttttttttcttggcaagttgtctgtgactctgtgtgctacgccgacggctatgatgattggtcatctaggtcattgttgacccccactagtagaggataactttttccatggagctattgatgggatgaaaacagatatagcaaagatagtgatgtttgattatatctagaccgtagataaaagacaatggttgatattggctcaaatccacattgtgaagttaccaactctaggagatccgcacctatagtattactctcggctgatggaaacacgtggtctgtggccccgattgcatcaattatgagtggattgtctatctagccatttgattttgtttaaaaaaattactttttgaaatttgaatggttagaaattctttaaaattttgggaaactcttataaactaagggtgcacccatactataaacctaacctaatccctcctttatcagttggccactccctttgcctgatccgtcaccgccgccgccggcctatctcccatctttgtacctctttgcctaattcatcgctacccctttctaacctcctcacttccctatgcccgatctgcttccctcctctcttcccaccatgctaatgcacaccgttgccatatgtttcgtctcctccttcccgcctcccctatctcttgtcctgccctcattttccactctagcacgattctccctatcccgcatctcccccatctctagcggctcctatcatcaggcttgctacgatcaccagtccaacaccctcctccctcatggttgaggtgatctctgcctcactgcggtgtgtagtcggagagacgccagaactatggagggcgacaagagcatgaatcttgtgcatggttcgatggtgagtatattcgaccggtgtttttaatattttcagtcacctgatgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccatatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaggcatatagtcaaggaataaataatccaaccaaccgagtggttttgataatcgtaatcaaccaagtgacttgatatcaatatatagcatatgcggtgtgaaacctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccatacctggaaatatatggcatatgtggtgtaaaatccgagtaaataaactcataaaggatttaccaaccgcctagaaaatgacaacaatatataatcagcctaagccataatattggtcaataaaaatgcacacttacgtggcgaaaagcaatgatattgtatccaatcaattgcttgataaacccaaacagcaccttgactatataaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttccgggtaatatagaccaggtgtagctcatatgaacagtttctgatctgagtgattatcccttaggagatactccaaaatatatataataattgaatcccgactggcgcaagtattcggttgatagcccttacggggaataataattggtccagtctttgagcatagaaaatagacccatgatcatgaattcatgttgcatatatccggagcaagtccaaattgaagatataatacttgtatttgagctagtaagcccctgagcatgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagcaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatatcgagattcacaacaacgtcatggttggtgatgtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaaacaccagtcgacggcggcataaccagtcggcgacggaagatgatgatgtccatcagtagtggtagcggtataaaccagacgtagaggcgagggcactagtcaacagcagacgagatgaccggcggtgaagaagataaggccaatcaacactggtagaatcatgcagccatggaagtgcagaaaccagtcggcagccatggcaaacgtaggcagcttgtgttgaagatactgatgcctattagtagtgacagcaatgtagccagccgtgaagaagatagcatcagttggcgttataacaggccagccgtgcaggcggaaacaccagtcgggggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcattacgtttaaacgctctgcccaactagtcatagccaccaagcactgggagtcggcctaagcacttcccaagcatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcgga

SEQ ID NO: 64032 - DNA, 1139 bp, Oryza sativa
gcggcgacggaggcaggccgcgggtgaagtcgtagacgcccaacagcggcggcataataggccagccgtgtaggcggagacaccaatcggcggcgacggaggcaggccggtggtgaagacgtggacgcccatgaacggtggtgtgaccaaccaaccgtataggcgaggacaccagtcggcggcgacggaggcaggccggtggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatttattacatattccataga

SEQ ID NO: 64033 - DNA, 725 bp, Oryza sativa
ggaaataccagtcggcggcggtcgaggcggccggtcggtgaagatgtagacgcccaacaatggcggtcataataggccagccgtgcaggcgaggacaccagtcggcggcggcgaaggcaagccggtcggtgaagacgtagacgcccaacaacggcggcataaaggccagccgtgcaggcggaaacaccagtcggcggcggacgaggcggccggtcggtgaagacgtagacgcccaacaacggcggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgtttcataacgtttaagggctgcaggaat

SEQ ID NO: 64034 - DNA, 1968 bp, Oryza sativa
acgaaggaataaggggtaaacaataatcaaggcatggcataatcacaagtaggatgtttatcattgcatgcaattttatttgtaaacaaaacaatttcgcaattgggatcaacatgttcaaagaatagtgatgacttgccttgctcaggataatccttattattgatataatcttgatcaaccttcacctcctggaagttgcagacgttgcctcacgactaaccgatgcacaaggtctataatacgcaagaaaaaccaatattcaaataacaaccaaatatgcacaacaaaatatactattcatgtctactaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttatttatggaagctttactttaattatgaacatattttacttgtcacaataaattataaaaggttaataattatccatgctttgtatgttagagttgtttaggttaatcatattatggttacagattatcctatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaacttttaagtggtccaaatacaactagctctgtgattactctcctaaacaagttaaagattcatctatgtgtgtttatattttagttacaaaatatgaggctaaactttatgtaaacaatttataagtcatggatttagttatatttggacatagactagtaaatggcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatagtgaattatatatcattggaaagcttatgaatttagatgaatttaggttcaagtttcacttaaatccgagttaaaatgaataagttatgctagtgtaaagattcaaatttgaattaatccgagaaattgcgaaaagctactgttcataaacgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacccacatgtaatagacactactaataaagattaagaagagggttactattcaccaattacgtggggcccactaatctctcctctccttcctctctctttcttcttttctctctttctctccctcccggcttcttctccctcctctctccctcggctctctggcgacggcgaccgaacaaggggaggaggcgggcggcttactgac

SEQ ID NO: 64035 - DNA, 11263 bp, Oryza sativa
gagcgcgagggggcgcggcagtggcgcgcgcgacagcggcgacgtgacggcgcgcggcggctcgaggcgcgaggcgcgcgcgggagggaagatgggacgggcgcgcggcggggcaggggcgcggggcaggaggcgacgatgtgacggcgacgacgatggcgcgcggggctcaaggcggcgacggcgacggcgcggcggcgacggcgacggctcgacggcgacggcgatggcgcgcggcgcggggcgcgagctggcgcgcggcagcggcgcgggcgacgacgatggcgacacgagcggcatcgggcaggagaaggaggagggctaggacggctaggaactaaatcgaacacctagggggctaatgaacagtgctagccggctatttaaccctattttagcctatttcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggttaagtttagttgtatagcaatatattttacacggataggttcaatctatttattctataaatagtaaattgagactcggcacaatattaatctaattatttaattaaaacctcacaaaattttataaagcttaatttaattatacgaccattatttcatgtgaattggtttagctttatatagaccattagagtttagtaatatcccattaattactcctagtgaaactatgtcatagatagagttccattataaatggtcatcatttcatgtgtatttagacgtcatgacacgcaacacatggttcacgtatttagtatttaatccataatttaaattagtaattaactttccatttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgcaaaagttttaaaaagttcaaaattttagtgatttttattgtctttgaattttcaggatgttacaggggtggcggtggaaaaggagctgaccttgttgcttgacaatctcattagaggaagctcgccggagggaggaagagggagctcggtagagagaggccttcgccatcgtcatcaccagaggagcaccgctccactgtgtgccttctttttcattggagggagctcaccggaggagggggcttgccgaaggatgtggagtgacctcgccggagggttgttgtcattgcagccgccgttgtcgctcgcggtcgagagaaaaaggaaggtgcgagacagagagagagagatagagagagagagagagagttgggctgggctgctgggcttgcccattagaccaacccactggtacgggggctatggccatgtgtcgcatctatgagatgtgctttgccaatgatctacacgatgagatcgagaatgatgataccacaaagtgtatcaggttgcatcggacattgggatgctcttgctcgagcggtcaactagtgatacgaggaagatgagtgacgtggcaatatcaagtccatttgaaagaaatgacggttatgattggctcaaactagaaaaatgcccatgcgttgtaacgggaaagtcattttttcagcgatacaacaactattagaagccgagcaataaattgaaatattgggatcaatatacattagaattgaaacatttaataaaaatcctaaaactgggattgctatacattacaattaaaaaagttaataagaattcatccttggttttggaccgaaaacccattcaatgtttccttttcagccctaagccaaacctttacctccctttgctcggcctgcctcccttccgcccatctcacaagtggagttgcaggtccaacttgcacagccgacaaccgtcttcaacctctcgaacatggtcccatgcccgtatgatgccaaagcagatcttccccatcaaatccggtcgaacatttctcgatctccaaaaattggttgagggcttttgatcccttcgatatcctctttccgttcttcccaaaatcagagtgtaaaacttgagataaaaacgatcgaggaagatcgcccatcgatcatcatcgcgactgttaaaatgaagattaaatccagtgaattaaaactgaatcgaaaggggaaatcatttagaaaatgatgagggacgaatggggaatcgatttttataatcaattggaggaggaaatgcacgattgacatgacggcggtgcggcactagggttcggcccgtggaaggcgcggggttcaacaaatcggatcggatctaaaaacagaaaacacccaaaaaccacacataattactaaaaattatcattaaaataaaattaaattccaataaaaagctttagagcgtgcgcacaaaagaaactctttcgcgtgtaaaaaaatgataggaaaaaataccggcgccataaaaaaaccgaacagacaaaaataaacataaagctttgcgtatttttttattaggtatatataaaaaccaagtaattagctgtttaattaaattaaatgtaaatgccttacagcttatggctggtgaaaatttcgaaatcgaaggacacgcataaggaatcatctatactaatataaaaaggaggagttgcaccctccaatcctacgtctccaatcctacgtgtgaaatcatccggatcaatcctaccgtccatccgcacacacgatttcactaccgcccgatttactgtcgcgaagactactctccatccacgcgcgattgcgcgaagacatcgctcctcctctctcgctcactcctcgctcctctgtactgtatccgaggtccccttccgccgccgccggatcctaccatccgccgtggccagctccatacgctgcggccggcgctcctcctcctcactccggattactgccgccacgcatcctcctctctccggattactgccgccgcatcctcgccggagccgcttcttctccgtccgccgccggagcaggtcccattccgccgccgttggatcctaccatccgtcgcggccggccccatccctcatgtgcgacgagccgtaatccgccgccgccttctccctcttctccaccgcttgccctaccccgccgctgccgcctcctcacgcgctcgcctcccctgtactcgcaccgcgggcgtgagaggccggagagacgaggtcgccgtcggccacctctaccgctgtcgccgccttctccctctctaccgctcgccctacctcgcctcctcgcgtactcgcgccgcgggtgtgagaggcagatcgccgtcggatgcctccaccgccgccttctccctataccccgtgctcctcaatcctctatagcaagtcctcgatccgcgcctcctcggatcctccgcggcaagccggcaatccccacacccctgccacttttgtcgccgtcgtcaacatcctctctgcccgagcccgaagcctcagatctacgctcatgccgccgccgtcattgtgtgactccctgccatggaattgtggccacgccacctcggcgctgttgtccataccctctccgcctgagcccgaagcccgggatacacgacctgaggtcagcgtgcacttctgcctctgtagccgagcctggcgtggtgctgactctgggagaagacatctagtgtagatggctcgacctcttgctgcggcctctgtccagtgcccgatgccaggtacccagcagccagcaacctgcggccggtatctttgcaccgtgcgactgattttgtacaactattggaaatctttacttttggttttggtttggtccggcatgattcaagatgtatgtttctgctctcattcttgtgtttatgtgttttggtgcagttgcaggctggaatgtggatcgaccacatcgtgatgattgggagcattcccaaggacagattggtattggtttcgaactccttggggttcaaatcatgttggtgatattccacgttgttattttgctttgtaatatagtatccagctggacatgttttggccagctatggaagaatacatcaaataaatatcaaatgctctctattttgtctgtacatggagtaagtggttcttttgatgcttcaatgattcattttgttaccttcaattttaaaaggaggaatgcctataagtaaaggcatcagattcaatcccaaagttggtccttttgcttcgaaaggtaactagcataatttcttccaaaggtaactagcataatttcttccaatcctttaactggaacattaatcttttctattcatgaactggatgcccatgagtcagtacttgggttgatacatacgtacatacatacatacaattgctgtaaatatagctttttatctgaatatatagtgaagtataaaatttcactatcctggtgatctttttactctacaattgctgtaaaagcctggacatcccacttttcaccgagtatttctgtacaattctgttggagagagtacaactgcaggtctaattctgtgtgctaaaaaggtagattttgatttaaccaaattttggcttgatctatgaatatatagtaaaataaaaggatcattttttttcttcaggaaagtaaggatgtaaaatcaaggaggccagctgttccattttgcttttgaacagctcacccaacttgcacttgatgcaacgattcgattttgctgctaaaagacatgttcaattgaatatattttcattctagagctgcaagtacatattcaattaaatgtcattttcttttcattttgctgctagaaagccaggttcaattgaataccctatctaatcaaattttctatttgttcagatgtctgtacctattaactccgaaatgaacatggtaggatggtttaggtttggagactattttttgttcaagacttcatgtacctattaacgtttgcagcaacaaccgtattttctgatttaggccaaaacaaccgtattttctgatttaaacagaaaagcttattttctttgatttaaacagagaacccagtaagaaatcatgcacatgcaaaattacaggccaaaatacccatattctcctatatatttaaatacaactagaaatattggcgcgctacgctgcgcccggttgacgttcccattgactttgaaggaatacccattataagtaatgggtccgacaaatgtctgaatgtcattcacccgaatcacatcgatcgcacaagaacataaacatgtttgcttcggcatgtaatggttgaagtaggatagaagaacttctacgaaatatctttacacaaagtggtgtctgaaatcaatgtcaacttgcaattacgttggtattagaattaggcagaattaactaatgtatggagagctcccatgtttggccatggccaggacaccataaaaacaaaaggtaaatatttgctctattatccttccaatcgtgccaatatcattcagcaaggcatcacctatcatacaattcgatagaacatataccggtgttaccacactaatagattgaggatagtatcaatggagaaaagggaaagatgcaatgcagtgactgattccgtaaagatgggtaaggtaaggtacatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaatggttaaattctttatttgtagtgcagtttggaataaactaatattaatatgaatatataatatggacatgtaactttataaagggttgaataaatatgtttcaggttataacagaatcctgaaatgcaataaaggtaactgagttttagtcaagcaaatatttagagtgaatttattttatttgaacactacaataaaaaatgtgtgtggtaagaaatatctacaactactgcttcaattggttgtgaccaaagcactgttgaagatgaattcagactttatgaattattgcatgtaaaggaattaagaccccattttatatgggcaaccaacgtatctgaagaatacggtacatgcaaattgcgggtttaagtaagtatgttctctgaagtgatgtactagttgtaagccttagttctggcaattaactgttaactgatcttgtcaagtaacaacaactttatagctaagttaatgaccatgtaggtaagcctaattacccacaagccatgtctaactgtactaatgcctatctttttactatttaggtcaaatgaaacacgccaattttggacatttgttatgagtccacatttttcctaccagcaggaaagaatgctgaaatgactgttgttgtttcatacagatgctgtaaaaaaagagtaagaaactataaccagaaatgtgataaattgacattaaagaatgctaagtataaccagaagaacatgagaacctaacactgttagatttgtgctgcagcagaacttgcttcagcgactgatacttgttgaatacatcaatgaggtttgacaaaaagaaattgcagttaggagcaactgcagagaaaaagcattgcagtcaacctaaaacttagtgccactgattgggataccacagttatagcgcgctcactggcaatgctctggccaatatgaaatgaagatgtaattatgagaaatcagttctgataaattgaaaattactttgtcaaatcctaaatcattgtacattgctctagaagaagaatgcacttctatgaacagttgctgaaggcgcttgtttgaatgaaacattgtgttgaatcctctcaaaagtgaaaatttttctctattatgttaatgtaagataataattgacctaagaaaaatggttaacttaaattaataagcaacggactaactgagctttcaacgcattatctccatcatggattaatgataaatagttcatttaaatgtgcccatcttgtagagaaaaaggataggcaaacaatcttgttatgaataagcacaaaccaaggacagtaatgagcatatacaaagaaaagcaattagaaaatctattatcttctacactgctattgggaagcaaaattcaatgtatatagtttagagtttacttaactttgtgcagaattggctacttgtgtagatcatgtgctcgagaagatggcgatctgagtctgtctgcatcctattttctctaacaaaaggaaatagtgtatgagaagctagaaccaaatgtattccatgccaaactaaacaatggagggggaagcagatctcactaaaagatatggctaattgagacagaaaaaagcaggaaacgcgaacacactatagaatcattgatttgaatattatacctgattaccagagcagttaccataccagaaaaggcaaggcagtgatgtattcagcagttacaactgcaattaagaataaaatcatgcacacacaaattagcatagtaaacatagaacattaaagataactaacaaagagatagaataggatgccaacaaaagtaggatgggtgagggtagcatacgaccaaaacagaacaaagacctaatcagcatggcacaagcagaagggagagaagccccactcgtactgacctatggtcctctcgcataatagcagccatggctgttgcttcacctcagattgtgaggctaggtccccgtgccgtgatgcagaccctggtcgtggctattggtcaaagatgcgaggatagcgtccaggaaggtacctaagggtggaggaggtgaggattaccatggtcaccaatggaagaaaggatttctagtgaggagggaggggaaaatcatatcagcggcacaccatattgtggattttggaggaggcgaaggctagatgagagaggtcggatggaaatagggattggagcgatgggatcggaggtaatctagaaggctttcattggatcaccttcgcagataaagtggaggccctagggcctcccgaccgagcacatgcggccgaccaaactgttgaggcaagtagctccgatgggaaggcaatgcgcagccgaacggtgaaggaaaccctggggaagaagaaaaaaaagggagaaatcactggattagactgctactcagcaggaagaaagaggaaaaagaaaggaggagaaatcgccggcgacctcaccaagaaaaccgaagaggagagaatggggagaggagggatgtgcgcagcagccgagaagagacttcaccaagcatcctccactaccacgtacggcggcaggagacggtggccaatccggcgtgcgctgtacacggcaagcggtgtttctagcgccgctccgtgtggaacagaagcacggaaacacggaaacagaacgtgggctgagcaatgagaaagggaaaagcccatgtgcaaggaagggccggcacaggaaaatggcccaatagaaacgcatctaatcctgtgctactaaaaccaattaaaacataatctaatatatcgctgcgcactatcgctgctaattgctaaatgcatatgcgcgttaattatccgaaccaaactgatgacgtggcgcccctaaccttccaaagatcccatggggtttaagtaatctaatataagccagttagaaaccatgaatatgcagtagtaatgtcatgtgataaattcgttgtgggggtaagaatgagtctttccaattggtaatttgtgacctttcacgaatcacgatggtttatattccaatctgctagaacatggtgccactcatatttttacatgatctgggttagaaaattttcccctttgtagttcaatatatgttgagtgcaacctaaatactttttattggaaacaacatggaagaacagttgtgcagatttataattacttcaggcacatatttgttttaatggtctgctggtgctgggtgtatgtattaattattattacctgatgcgtgtatattgttgacctacaggattaaaatttgcgtggactacaaaggcggtaagttcatcttaaccgcttatctctatagtgtgtatcatgctcacttgcagaggtgcttccataaggagcataatacttcagcatattaatgttttcaggctttgtcaattgctcttcctgttgctacacacttcaacagtgttttaatatggtcaatggtcatggctatgctactgttcggagtcacctatgtgattatgaggtttcataaagtttcataaattatttgtgattcaacgcaacaaggtatcgttgtcattaacaggaactcaacttttcctttcatttttgtagaacatcgtcatcttccaagggctataagcattaggaatcttctaaacatgattggtttgggcaaatgaaaaatacaaaattggactcagaggtattgcctccaaatagttgttactacttttaactaggtatgcaaaaccaagttatgaagtcttctaagctttcctgtatatatgttactgttgtgccaatttatgcttgttagggaatcttagaaaactaaactatgtagttatgcccaaatgcttgtagtgcctaatcagcttagatggtcatgtacttgatcttgaacatctacactttctcagacaaccaattttacttttttttttgctttttaatggttgacacaattagccattacggtaagcaatccatccatgatcccagagtgccttatcctttcccatgctatcatcctcgatttattctactgctaactgcccttcgacatgttattggtgatggacttgctatagaagtacattggtgatgaagtgatgaaccagggggctaaaatccaagttgtgatgtgacgatgaatcaacgatgggaattggacaagaacccaagcaggcaagtaggatatgaaagtgatgcaagtaattatgatagcaatcatgtccgatcaggcttctcaatataatccttttaggaaagggatgagattagcagcattttttttactcttttgattgagattttgctgccacaaacaacaattcctaatattgaattgtgccaccacatgctttggatgattctaaaggaatatttggccatgtttttttacacttaggaaaagagaaatattgtttcaaatggattatattgtattaactccatctaagaatataagggattttgcccatgtcatttgaagaaccgtgggataatagatccggcattaaggaatttatccttaaatttatctccatgatattctcgtgaacttctgcatcttgtctcacaaaatgaggttgtaatagacatctctcaattattttttaatctttctggcgtgttgaaatgaatgaattggaaaacatgaaagtgaaaatgaaactcaatttatccttttagatggaaacagaaacaaccaatttcacgtggctctcgagaatatattttgatacaattgagaaattttgcattgaaagaatgtaaattgtgaaaacgtgcattgcacgtgcacgattactagatatatcttgacaattgagaaattttgcattgaaagaatgtaaattgtgaaaacgtgcattgcacgtgcacgattactagtagtggtaagtggcagactgcctgatttggtggcagcagtttgacagtgggtgctttttatttggcgggtactccagctaaggccatgtttagtttctaaaacaaaaattttcatcttgtcacattaaatatttggacacatatataaagtattaaatatataaaaaaccaattatacagttcatcaggaaattgcaagacgaatcttttaagtctaattg

SEQ ID NO: 64036 - DNA, 1005 bp, Oryza sativa
acatgtcgatgagcccgacgggcgcgaacggaccacgaagagggaggtgacgctggcgatgcggaagcggcacatcttcccgggcaccacggcgaacaccgccggcgcgcagtccgggtgcgccatgttgcgcgacgccgccaccgtcgctggcaaggacgagcagttcatgaaccggctgcgcccgttaatgagcagcgactgcggctcgccaacccagaccatgggcacggaggcgagccccgccgcctgctcatacgtgctccggtgccaccagtcgttgagcagcacggtgtgctgggcagcctcaacggcgatcatgcctttgagacccgccgagcgctacatccgtagtgggcgtggtacatgtacgtcccgggacggtcgacgatgaaggtgtaggtgaaggtgtcgccagggaggatggggcactgggtgacgccctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcgaaaaaaatgaaagacaacaggagctaagccttgactagaactgcagcgggaacaccactccacaggcatcctcgacggcacggacgaagcctactcctcagagaaacctccatctgacacacactcgtactctggggttgggaaaaaaagagcaagactgagtactacccactgtacttagcaagttataccggaataggggtatgatgcagggaattatcaaaggagagctagagtggttcatttgcataaagcgagcatttataaacagaagttggaagatttaaaccgttgtaataattaatcaatattaatcatccactgtccaacgctatgccacgttgcgacaggcccaaccatccacctatactatccaaattctaaagattacactagggtgagactaatcacggt

SEQ ID NO: 64037 - DNA, 5843 bp, Oryza sativa
actcttgttcgccctgatgactcctccctcgtaggctcaacgagccaggcaagccgccgcttctctcgataccaccgaaccagatctcctactttctcttatctggtggatcgtttatcttaaccctatatctcttctccacagagaattgtcagtcagttttgcatctcactcttccttctttactaagctctataaagacatgttactaaacatattttacatgtactctgtcgaagattcaaggtcgttaaatttaaaagttttttttgattttggctaaacgtttaaggctacgagtataaactttctaaatctgagcagaaagttttgggtttttagttttagttgaaatatttagatttcaattaagttttccagtttaattgaagttgaaagttttcatgttattttggctaaacatttgaggctatacccggaaactttccaaaatcagagtagaaagttttgagtttttagttttagttgaaagctttagatttcaattaaaagtttttatgttttagttgaaattttcaaattttgaattaaattgaaaagtgaagatttctctattgaaatatttgcaatttagatcttactttagttacatatattattatctatagaataatactcaaatgacaattagatcttactttagttgtatccagtgcttccttcatcagtgaggcctttgttctcttcagcctcccaattaaaacatcggcaaatatctctccttacactgtagcctttatgtgtacccagttccatgaagggttagcaaatataaacttgcaatactcctcagtaattctccttgaggtcactctcttaggatcaattttgataaagtttatcacatttcttaggcttcagttgtgtttagttccgcgccaaaattggaagtttgactaaaattgagggcctctttgaatcgcagggttgaaaaaaatggaggaataggaaaagcacaggattccgatgggaattgaagtgtaaaatagaggattgcaaaacacaggaaaaacacaggaatggtcgtttgattggagcgcaggaaaaacacaggaatcgggtgagagagataaactcgaagaaaattttccaagaggttggagctcttgctatattttctccaaaatacacatgcaatgtgccattccataggaatttcatagtatttggaaagcttcaatcctttgaatcaaatggccaaataggaaaattttctatatgatttgaatcatatgaaattcctatataaatcctttgattcaaagaggccctcaaagtttaaagaaaaaagttggaagtttatgtatatagaaaagttttgatgtgatgaaaaagttagaagtttaaagaaaaagttaggaactagaccgggccttcgtttgtagtatgtaagtactagttggcaactcatttttgcggttaggaactttggtactgtggatgcactattgcgcactgttcatggcagacagacggggaaggcatcgacgacgctgtttgcccgccgacaaaatccgtcaagatgcaggcgatgacccggcttggcgcaaggctttgctacacgcacatgcgtatcgtcgcttgattgaaaaggaaataattttgtgaagggcaattatatcagacgataagcggaaggcttgtaatgcaaacttgcaaagagaaaaaagaattaatgaaatgaaacatttatttatatggtttaaatttcgtaattatgcgatgtaacatcttaaaccatgtcattagtctgttgtatttgttaagaatttattcttgataagatgttatgagttcttgcaatatattgagaagaaaatgattatttttgttgccgaaaatattactagacagacaattatgaagaaatgatttatcacacaattgacacaaaaatgagtgcatcaaaattattgtgaaactgatgacataaatttgtactctttttcggtgctactatgaaaatcaccacacaaatttaagccttattgtaatattgcaaataatatgaaaaaaattaacacagaataatacaaatcccaatttataagatagctcacttctgaaatgcgaaatccatgcataataattaaagacaacacaaattgaatttcacaattcaaatctcactactgactagaccgtacataaatcactactagttgaaaccatacaaactcttcgggactaataaaaacagacgtaacatgcattagggataacatgtgggtcacttagcacctactgatagcgatagtaggcctcatcggcaatgcagtcacacaaggtgctcatagcctgcttgctatttgttgcatagtacatttgatcgaacgattcgttctgcagcggcacgggatagccgttgtacatagcattattttgacaggagttcacatccttactatccaacctgaaattgtgcagagcaaaagcagcacgtatgaaatgtgtgtggcaacaccctcctctggtaatacggtatttctttcattatttttcacattttttttgacgataccaaatgttctttcaacgatacctcgcaacgacgagtgtcaatggttaaatgtctcttctcatccttcgggtggcgacgctctatcatcaccaagttgatccatgtggtatcatacatgtgagtacggtgcaggaaatcccatcctactaggaaatctagagtccacaagtagataccttcctgtttaacgtgagagaatattttttttgctttacaagtcaagcttgaaatgtagtaacatatgccattcaaatattttagggaaaaaattgaactcaccaaacggtagccgtgggaaatcgtcggggtaatactgcactgcctcgttcagaatcctttggtcgtgaaccgatcctggtcatctagcaacgcagaaaataattctcccgtcatgatcacatatgactagaacatttttcatcgttatgtggtgctgattcttgtgttgcataaacctggctgaagaagtcacaactgaaacatgcatgccgtcaataacacccactgactggtaaaatggtttgaaccaacgttcgttaagaatcaaagggtgatattcactgaagttgggatccattggtttcaaaattttcctagccaggtcgttcatagacaccaaaacttggtggaagtaaatagacattgttgagttggagcggatccaccgattgtttgcatctctgcagggacgatttccagccatagtgtacaagaaaatcccaagtttttctagtgaacataccctggatgttccttcgaggccgtacgacgtgatcgggaggtcatgtaaactgtgtatccgttctgcaattagccggaaaattgcccaacattagcttcgatttgccatcgtttccaccatccaactgatttcggtttgaaccggtattctcttggtgctctctcgtttatctcaatgctagcggctagtatgtcactgatggtatcgtcctcgttgctgctaatgtgccctcctgtccagctcgatccaccagcgacggaactcatgcacggatatgtagaaaaaaatacttgcaatttgcacaaatggagtaataaaaccgcaattgttggacagcacctcgtagcaaatgttagcacgcataaattgataaacataatgacatgtttatttttaaaacaacacactgcacaattgacagtgaattggaagtacaaggtacaaactaatgcgtgccaccagatgaggaatctgctccgtttccacgagtagagatatattctaggcgagttgcggcgtcctggaggcaaacgaaacagtggcagtggaattcatcacggaaaagacgacaagtatcataccacactagccctccagtacggtgcccaacattttccaccaactccaagcaagcctcaagccctttagccttagcggcatctgcctcccttgtgcggctctgcatggactgctctcgcagggctgcaagcctccctatctgcagtcggtggtgctgatggagatggcatcggtggtctataagcggcactgtactgctccttgcggtgcggcgctggggcagcccccgtgacggccgagtggttgccgacaacggtgcgcccactgaacaccgcttggtgaaggtcaatgtgcttaagaggatcatttttgaaggcgctcgcacctttcttgacctgtcacagttatagacatgcacaagttacataacagatgatatgcactgatgcaagcaaagacacagacacaaggatgcaagaaagctgaatcaacgtatttcctaatttgtgtgtacactgttattcttaattagtaataaatacttcttttggctcatgtaatatagattatcagtgcaagtactcacgctgtgacatagcccaactgctgctgcaactactaccacacaatataaatgacaccatatggctagcatcacccttcctagatcttttcaatttcattcataaatatgaaacaacacaatattcagagtttcagacaacacaatattcagatctcttcaacaagattttcagataagagtttcagacaacacaatattcagagtttcagacacacatccatacctctactccccttgacagacacgacaacaatggctagtaccaagctaaggaaggaggaagaggagatcaggctctgctcccatgcatccacaggtttctgcggtctagggctatggtcgttaggaagtgttgttaggaaacgataggcaaacaaacaataaagaactatagatcaatcacagaagacacgagattttaacgtggaaaaccctcttaaagtaggagagaaaaaaccacaggcgccagccagcaaaaatatcttcactatttctggggtgaggttacaacgccgcacgacggcttacaagaggtatatatacgggcctccgctccactacggcagaagctggcctttattaagtgcaaatgaatttggatcacaactcaacaaactccaccttgagacaaatttcttcttgtagcatgaaacaatccttcaccctgaacacaacaaagacaaaaaaacactttcggcgccaaatagcctcttgggataaaccactataccaattaagcttgagcaaagctcaaacttagcaacaggaacaggctttgtcatcatatcagcaggattatcatgagtacttatcttgcatacctttagcttaccttacacgactacatcgcgaacataatggtacttgatatcaatgtgctttgtcctctcatgaaacatctgatctttagtgaggcatatagcactttgactgtcacaaaacaagttaatgcaagaatcaactccacaaagctcagcaaacaatcctttcagccaaactgattctttacatgcttcaacaatagccatgtattctgctttagtggtagactgggcaacaacagactgcaatgttgccttccaactcacagcacaactaccaatagtaaacacataacctgtgagtgaccttctcttatccaaatctgcagcaaaatctgaatccacatatccaacaagccccttatcagtcctcccaaacttcaagcaagcatcagctgtgcctctgaggtacttgaaaatccactgaacagctttccagtgttctttaccaggattagccatgtatctactaaccaaactcatagcatgagataaatctggacgggagcaaaccatggcatacatcaaagaaccaacagcactagaatatggaactctagacaggtattctacatcctcatcagtactagcacattgtaaagctgataatttaaaatgaggggctgcaggaat

SEQ ID NO: 64038 - DNA, 2421 bp, Oryza sativa
ttcatacctagaattttcttagcagcaccaagatccttcatatcgaactcactacttaactgtttcttcaatatagtgatttgttccttgctcttagcagcaatcaacatatcatcaacatataacagcaagtatataggtgatccattaacaaatttaatatacacacagctatcaaattcagacctcttaaagccatgtgacaacataaatgaatcaaaccttttataccattgacgaggagactgtttcagtttgtcaccatccggcgatgggcctccgctccactacggcagaagctggcctttattaagtgcaaatgaatttggatcacaactcaacaagtgtgagactgagagagggccagggaggcaagcatccttaatcgaaatcgcagcttacttagaccacccctatttggatccagggacttatttttggtccctatcatatcggatgtttgggacactaattagaagtattaaacataggctaatgataaaacctattccataaccctggactaatttgcgagacgaatctattgagcctaattaatccatgattagcctatgtgatgctatagtaaacatgtgctaattattgattaattaggcttaaaaaaatgtcccgcgaattagctcttatttatgcaattagttttgtaagtaatctattttcaaacatctgatgtgacatagtccctggatccaaacaccaccttagcacgtgcggtcaaaaatcgtctgctgattcagtatgttgactagggttaaatggccacatcagatgaaaccacctactatactactcaagtagtcgttttacacgggtttcaccacttttgaaatacctggttttactcgggtcatagttgagggagtcaaagtgtactttttcctacaaatgatagacacgataaatttgactcattgtcgattttatagagcttcttttttgtttatttggataaatttgacccatgttcgattttatagagctttttttttcgtttgtttgtttgagtgggcattggaccaaagttcaggttttcatactacataagatagattaagaacgactactgcttatgtataaaatttaattagttcaggtatcatctgaggatggatggggcctgggggagaactcaggcgggtgtgaatcctgtgtgcagtaatacaacaagcaataaaaatttacacctactggcaggctcgcacgacaaggaataaaattttactagctagtactatgctgttacctcgtttaagagcaattagatttctatgtcactgtgatctagtaataacacgttgttactgttagggatcacacatatttcagaatactccgtatgaaaacgacaacttcacaaacaactcctttcttatcagtcagacagttgaaaaggtagttcaggtaatcacgagttctaatattatactccctccatccctaaatgtttgacgtcgttgactttttcaatatgtttgaccgttcgtcttattcaaaaacttttgtgaaatatgtaaaactatgtgtatacataaaagtatatttaacaatgaaccaaatgataggaaaataattaataattattttttgaataagacaaatggtcaaacatgtttaaaaaagtcaacggtgtcaaatatttaggaacggaaggagtaatatatatccaaaaaataatttcttagtgagtctctttattaatttctatccagaactattttatagttacacaaatattctccggacaatttttctattttctattcttgctaccttttgttaaggtacttgttccagctaattcttcacatatctatcgagcttaattaaatttacatgacagatccagcttgcatgattatcgtgtaatctaaagaattctactctcgccaatgacaaggactcaaggcaatgtactgctatatgcatcggatatgatgactaggtccatctcaattctttacagtgttggaacctggactattacaaactgtaaactcgtggaatccaatgttgggtagcacatctcagctgtaaaaaaggacacagctacagaaagcaactacacgtggactgtatatcaaactctattcacatgcatggctcatgtttcaccattaattgtaaagctgaagtttaagacagtgggcattttatcaaacatgaattttgatggcattctcgaagttcaaattaagaaacacttccatatgtgtcctttctatcataaacattacaactagcatatatactgaaatagagcaccggaatggaaacatgatagttcacagttgggttaataggaattgtgtgacttgcctcgcagtaaaaaagagcagccagtagcggagtagccgttgctacaatagaagctttcaacctgcaaaacagtagcaagagaaa

SEQ ID NO: 64039 - DNA, 1906 bp, Oryza sativa
atcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcaggtactgaacacaaacatttttctgctgcctatcctgttgccatctttagtttaatgttaactttgtttgaattaacagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttcttctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttagatgttgttggcatggtaac

SEQ ID NO: 64040 - DNA, 2148 bp, Oryza sativa
tgttctggtcgtcttaggcatagcggtaggcgtggggccagagccccttgaagaacatggagtagctcgtaagcgggcagacgtgctcgaacttaaccacctgggacacggagctcggggaggcacctcgccgtgatgtccacggcgcagctcgactcgcgccccgtgctgaacccggcgtcgccgccgttggtcagctggaagctcaccagcatgttgaacccatcgatgagcgacaggtcggggtcgggagccgagcgtgtactctgtcagcgtggcgggcggctcgccggagacggagcaggacagcgcgccggcgcagttgcccatgatgcagcggacgtggccgccgcctgagctcggacagcccgtgcgcggctcgcttgctccgctgcccaccggcccgtccgctccccgcctccccgggaagaagagagagagaggagagggaagatgagaggagtgagggtgaggaagaagagagaagggagaggaaagaaggaaggagtgagaccgacatgtggacccatgtgagccccattatttttaaattatttttttgtgtaactgaaatgtgggtccacggtttttattattctttcgggatataattgccacgtaagcgccacgtcaatgccacgtgggatgaagatctaatcaaaccagccacgtaagcgtcacgtcaaccaaagtcaactaaaactgccttccaaaccgctgaaggacctcgtttgtactggttttgacagtttagggaccggttgtatctggttttggggtaggatgaaaatcggatttagtgtaaagttaagggacctcagatgaacttagtcccgaaccaaattgagaattttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaggcggcctccttgccgccctccgctagggcgattttgtactgtgcggggggccgcctgcaaatgggcggcgagggggcatggaattttgcaggcggcccccttgccgccctgggggagggcgatttttgcctccccctataaagcccagtccaccctctctgaaatttcattatattcactaaaaatccaaaaaaaacgaaagagagagaggagagggcagcagaaggggagcggcgaagccctgctggttcgctcacttcatcacaggtttgctccaatacatcttttgcatttgtactaatatgttatgtttgattatatatgttgcgttttagttttagttccatatattttagcatatctgtagcacacagcacatatgtgtagatccagagcatagaatataattgtatgaattgagacatagacagtagtgttaattgtaagatgtagtttagtttgatctggagaatgtaacctacttttagaattttggagaacaatatttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaaataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctagaggttcttttgcataaagctagcatttaaaagcagtagttgaaagcagtaagacagttgtagtaattaatcaatattaaccaaacactgtccaacgctacaccacgttgcaacaggcccagccaaccacctgaactacaccagttcattaagctaaactagggatgagactaatcacggtgaatctggttgatcgcccataaccgcgggcacggctatt

SEQ ID NO: 64041 - DNA, 27033 bp, Oryza sativa
  unsure (1)..(27033): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattgacggaacagagggtacacctcatggcgctagaaccagcgagggacccctgactagcggcactagggttgctcctaatgtggatacactactacagaatcgattttccggatgagaccgcctccaaactgcaggcgggacatatataactaatcccgcatgcaaattcgctccctcagaagcggttcaagggccggatgtgaaaatctattatcgcaagtggtctcttaagaggaccgcatgcgaaagtatatttttgcatgcagacaacgtggagagcaagaggcccccatacgtcagtgtactattttttcccacaccctattttctcctcctctccacctcatcactcattttcttctcttgtcctccaaaacagcatctcttccccttccacttccactcttctccatcactcctttctcactccatcacctcatctcttccccttcccgccatccctctcttatcttctcaacctccagcagctgagacgatggcctcgcgggcgggtggctgacgcggaggcggaggcaactgaggcgaagacagtgacctcgcaggcaggacacaccggcgctctgagatgatggcctcggggccgagcggcaccaacacatggatcctcaagagcaacaccggtgcgtggatccggtgggcggtggcctaggggcggatccgtcgcctccaccctaaggagcagcgatggtgctcagatctgccgcccctgtcctcgggagtggcggcgacaggcttaggcagtaggagcgagcggcaacaccggtagtatctgctatgactatgagcaagggttttggcagaatagggagatagggtttcagctgaatttgttttttttttgggggagggggttagttttttttttgccaaaattattttctcatgcggtcgacataggtgactacatgggaaaatcctatttttgcatgcagttgggctacctgcatgaaaaatgttgattttcgtacacacttgggtgcaggcgggccgcccagcctcatggaaaagaccagttttggctgtgtgggaaaatgattttggtactaatggtaaacacttatggtaaggttaggatgccaggtaccatttgatatcgcgtaacatggttcacatggttgctagtttgtgtcatgtgggtacacaactgctgtaaggtgttgaactaatcaataagccatgctcacgatcataagcgacttggtgaaatgataaaagtgtagtgttggtgatttgataaatgattttgcgaaattggtatgatgggaaattggtgataactttgcccggtgtgggctgagaataaaatcgttacttgcagtaatgaagggcataaggttgatattattatgatgcttatgttactactactattgtttacatatttctttacaaactccattgtaatatattattatatactattgtgaattaaaatttgctttttttgaaatttagtccacaatcatagcctactttgaactcagcttacagtacacataggattcccaaggtttcggtaggacttgccaatacatttgtattgatccacctcttgttattgttttttctagacattgatgtaggaaataagatgtttagtgatgagtattttgcatcaggtatcggaggtttggaggaagatatctagggtgattcctagtcggttacctatggtgggttggcagatgggcataccgaagaacttatatatttttctactcatattccactgtgtttttatcatccatttgtccagttggccaaatctatgttatatggctttgcacttgctaagttatatgaaacatattatctatttgtatgtgtattatgtatggatgtgaagacaaggttgtgggttgtgtactagccactgatcttgggactagtacggtgtacgctttggttatttgggaatttcatccttgggtaccgtcatgtggggatacccggtttgagtacggtatcctgaaaccacccgcgaccgtccacgatttcgatcgcgcacagattgataaacagaacagctttcgatacatatacccaagtttttacagaaattattacataaaagttaactaagacaggtttaggggccgacaggccaaacacactccctacaaacagaagacccatacacaaaataggataaaaacaccacaggcaatgcctgagagcagatcgacctagaacaagaactcgtcagcaccatagaattcttccccttcctgtgcctcctcagggaagaactgatcgtctgaaccacattttatgcaagaggtgagtaccgaggtacccagcaagccacacatccataaaaatacaaatagaatatatgcaaggcgtacaaagaatatagttcatcaaggaggtttcataacaagcctattataaatagtttttccctactttgtaaaacatttcatttgcaaacagttgtaaaccatcatttagtagcaatattaatcaccattcatcctcatcttcatcatattccatattttaatttaaaatctactcataccatgataaataggaatcacccaatgacatagcttcttaaccggaagcacggcacattcgaatgatttaagactcatctctgcagagactgtccagctttacccacatgatgtcaacagcttgcaaggctgaggacaacatagccgttcgagagtcccacttactactagttactgcccagtgggatattgatccgtcctaatagtcgggcacttgctgggcctaagcaaggctagacggtcactgctttcacgggttccaccgttgtggatcatgtcaacctggccgaagccccttccacatgtccaccccaaaccagctcatagagccaccctacagtctttcatatagtgggacaatgtactaggctaagtctgattactcagtcctgtggatgggcgcaaattacatcactttccatggcataagagggtagtccttatatccgggggaaagccaccaaaactagcacaggcccgtgcatacttcaagtgtaaatttacactttccacaaaataattataacaatatgcatggcctcacacaccacaacatccatcttcacccggaattaatcttccatatcactctaggcgagtgactcatatcaaataacacattttatatcacccgacacaccaccacgtgacgacgggtaaaccatgtatatgagtatagatatttggtggtcttatccactgggatattattgtgaagtatacaaatctacacctagattatcaaagggcgtgatatagcaatccatggatttggccaataataacaatgtaataatgggtaataactaaacttacaagtttattcaaaaataaattatacgcaaaataattttataaatactcaatgcagaaaataactaagtggttctttactaggttttaatatgatcaaagattgaaactgtggcttgccttgtggaacgtggccttctgaagcttcagcttagccttctaggtccacttcagttcctgcgagtccagtgggatcttcaacgcgatctatcgtacgcacatgaagaaacgaccaaataagcctataataaaaatactacaaataaacgataaaataaatattatgaatcggagcctgagcaaaagaaaatgataaatcgagagttaagttgatttgaatggaaaaagatttatcctatggttatgattcatggtctgtgtagtagtgattgcaatttgatattaacgctatagataacagaggtgacaactgaaattgatttggtgttttagagctcgaacaggagcaaaacatcttaatagaactgtttggacaggttttattgtggttaggcactatttaggtggatttgatggggttggttgggttcaaccactaggaaacagtgttggccggcactgttcatcttcttcccgtggcttttcacgtgagtaacagagaaggaaggaaaagctccagagctccagtggggaaacggcgacgaagacgatatcatgacgtgttccacaggctgacacccccacaggatgtggacgctgggctggaagacaacgaagctagccggaacgcgagttccagatctggagctatggtgacaccgagcatggaagtggcatagctccggtggcgaacgcgggcgagtgagcgtgtcaaaacgggttcccggatgagaaggttccatttttgtggttagttgatatagatgaggcgccggaaaaactgaccacggtggtagccatggtggtggacaggagcacgatgggagctcgacacaagcaaggaaagaaggggaaaaaggttggggaagttctcatcgatgagaggtgttcctgcggtgccgtggtgcggtggcagaagatcgacgccggcgaaacggctgcacagccggacttggctctggcaggagaagttttgggatgaaaacgagattagctcttgatgtctacagaggggcagcctttagctcattcactttgaaggagggaaggactggaggaggagggaaaacaaaggagggatggctacgagcagctgcgtggctgttttggaaccgcacagcggcgttcgcacgcgtatacgcgagccagcatgagacggctcagacgggcgtgtgctgcgcatggcggaatgcggagcggagtaggcaggagtgaggcggcatgcggctagcgcgtgcgaacacaagaagggcgcaggacggcgcgggcggcggctgcctcggctcggccaacagcagtcgtggaccagcacagcccaaacagagagatgggtaaaggaggtgaatgaaaagaaaaggcgatgggctgggttaaggtagactttaacccagggagagatagtgttcaagaaatttttgaatagatctttggtaggatatttttgaataggaaatcgatgagactggggattttagaatatttgcacgatgactccggtataacttaaaataaacacgagctcttctgatgattttgagaattttgtttgggatatctcgaatttggtttggagaggaaacttaacgaagttatgcggaaggtggaatctcagagggaacaaaagaagtatatggattgggaggctccaattcgaaagaacgaagaacaatgactttaaatattttcgcaaaaattttaccctgaaaaatctagtatgttacacgtcaatgcccacgatcacgggtgaatgtgagatgattctcctagtgtagatttgtttgtctatgatttgcggaagtgatttgtgggattgaaagtgttactagaatcgaccatgatggctgatgcatggatgaccattacatggtatgaactggtcttgtgtggatcgggatgtccaatggcaacatagatcaagcttcccgaatggatgcagtttgtgcttgaggctatggatagctttgggggctgaagagatagagatttttttttaaacgatcgcggcaagagtcttgccgaatatattagaagggggaaaaacacaagtttacattaggtgtttacagataaaatacgatgaactacttgaacagaaggcggtgatagaatagggatcaaggtggttcaaaaactacgttacattctcggcagtcttctatgacaaggtgcgcagtcctctgtgcgttgggctcttctcccctgaatatctttgcgtttctttggagccaaacgtgccaccaggtttttattaaggcgccaatccttgccttgacttcttttttggtccccccccccccccacagcaagatttctcatccattccgcaatagtggagtgattgtgaccatgatagaaaccgctcgcagtagctacttggctccaagtttcctggatgaactcacattgtctgaataggtgatcggcatcttcgaaagcgctcctgcataacgggcaaatccaactacactcccagtgttttatgagtaaattgtctgccgttagcactttgtgatgaagtatgagccatcctaagaatatctgcttgggaagcgcttgggttttccaattgattagatatatcatgtcttgctgcgatcctaggaactgagcacgacaggcgctgcgggccgtataggtcgcaaaactggatctcttccagatgatctcatcttcctccccttgatcgagctcaacctcggtcaataagcttcctagttggaccagttcgtgaatttcctcgaccatggtgatttgcctgaaggattgaatccaattgccatttgtgcgttcagtggagacgttcctgcttttcctctttgctagcttgaagagagccggggtgacgtcctttgggcaacgccccttaagccagttatctttccaaaaaaaggtcttagttccatcacccaaatggatttcagtgcaggcttggaagagatgaatatccctctcattgcatggcaattccattttgtcccagggcctggattggtctttccactttatctagagccatcttagtcttagggcagaggagaatctctcgaggtcgaggatccccaatacccccatgtccttcggtctacagactatctgccaattgaccaggcttgctcgtggtttaacattctcgggttcatctcctttccatagaaatgctctatgcatcttgtcgattctcttgattacccattttggggatagagatatgagatcggctgatgcttcatggatgtagaaagtgaaaagaaactaataagggagctgagaagagagttgcctcatgacaaccactatgagtaggtgtgatgggtagaggactagtatagagacttcaccaataactttaatcaactaaactttgccttgtctgcttgagttattgcaaagcaattcgtggataggatcaaggcgagagccactttccaatcacttgttaaataatccacacttggtgtttttggaaaatgatttgaaaagtttatgaaacaaacctagcccactttgaagcctggatactcatatttcttatggcttgctgagtactctcatccctatgaagagtgaagtaaagttgaagattaaggtttctttcctagtcccaagccgttgcttatgcattgagtctaattaaatattgttgcagattctctacttgcaggttacattatcggagttttccccaaggtgtgcctcctgtaaggtgtaatttatctaggttatatttagttgcaacgatgcatctccgttagccatgggtaccagcattgtgtcacaggactagtactggcaatgaggttccgcggaagtcggttcacgataatatcttgtggcgcaccctctctggtgtcactacaagtggtgctagtgcatggtgtgacaatctaaacgatggaatagcaaactactgaaagatgaggtgggtaaagttaaatattcgcacttctccaaaactaaccattacctacatatttgaatactagaacttctaatcaaaacttagagcacgactagagaaggtggatcaaaactactaatcacagtgatcggaagcccaagagcattgaccagaacttctggtctaatctctcggctaaacagagaacattggccggaacctctggttataagtactggaacatctggcccgcattaagaactaataccattttgccatgtgagtatagtgcatggtgtatctcacttaagatcaagcatattttgagcgcttggaaaacaatttagtccttcaacatgaacccctcttaatagtacaatcttccaagtactcaatttcaaaataaaatggaatttaaatcatcttgagtcctttttaccgcttgctttaattttgtaggggctccacgacttaagacattcatcgtcaggactagcacatgtactttagctcaattgaaccaataataccttaattgtcatgttattaatcatccaaaacccactagggcctagatgcactttcaaggggtggctgttgctagggcatgtgttgcccatgaagttgactgaggggaaagaaatattcctttatcccaaaatattgtcatagaataaatactagctcaacatagttgctaaattatatatactctcgtctggttgaaaataattgtcattttggacaaggatatacagtctccaagaaataactttgaccactatacatatggtctccaagtaatattctagaagttatccataatcaaaatttataaagttcaaaaacattcttgtccaaaccgaaaattattttcagcctggaaggagtattaaacatacaggtccaacactagaccaacaaacaataatcccacaattctaccttgatggctcgatcgaatagatgtggagacaaggatgcttaagaacaaagatgtagtagatagagaaaacaaaccatagaaaatggccatatataagcacatagcatttgtgtataacagatgaaaaatgttatctaaagatatggatataattattggcaaagatagacatagaggaaattaggagaacacaagcatagaaaaagtagaaaaacagagaaattataaacctagtagtacattagtacatcatttgtttgatagtacaactagtatgtagaattactgggctgaaaatgcatctcactgaacaacattgatggatggatggagtcccacacagaccccacgcgcctgatgcaaaccattaccaagtacttgagactcaggatcctcagaagcaacacgatggttggcaacctggctcaacttcgatagcatagcatggattgaaatgtagcctagaacaaatattgccatcgcgatgacatatccagatgtgtcccaatccctactagagccagtaccataggctaccaggagtccaatcatgtcgagaacaactgtcgtgttcattgccttcaacaaccactcattgacattcagttttagcgactctggcaacaacaagatgataacaatgatagacgccatgaaggaaatggagttactgtagaagaaggcgtgataccgtagcttttgcttgtcatgcaagactgggtcacccgcagcatgcccagcatcatcattgctctgccacacgccacccggtgggtgcaagccggcctggtaggtgacactcgctgctagaatccccagtagcatcaagttcttgcgcttggtgtactgtttacgcttgatgtcattcgtattaggtacttccgcttcatttgttctcctgttctgcgtgccctgagatttctggtgcaccacgaatgctacaagaagtaagaccagaaaaatgaatagcaaaacgaagatatatatggatgtccgcatatgttgtgagcttccggcagcataggcacccatgagaccaaacatgccagccaccatgcaaacagagagcgcatagctatgaatggctggcctatacaaatttggattgaccaagagtatgataagggcgatggatgacatgaagcttgttgtgttgcagtagaagaaggctttgtaacggcgtgggtggttgctaaagaggactgggtgacctgcatgataaccatgttgtttatcatcatcttgccagcagccgcttggcggggttagcccagcttgataggtgatggttgcacataagatcgcaaaaaggagcaacctcttgcgcctcttttccagcagtgcattgtcttcacctagcatactgccatcattgtgatctagtgtgaagaacacgatatggatcaccacatacaccagcactgcaccagctatggccatgacatttatggaggtgcttgcatcccggcagctaccagctgcatatgcacccatgagcccaaataagtctaaaatcatggctgcctccagtgcatggcgcttaagcagagacttgctctgcaccaggatgatggcgagtaaggatgccacgaaggcagttgagttgaaatagaaaaatgtcttataccgcttagcattaattgttaggagaattgggtcaccagccttgtggccatccttgtcaacctgccaataaccacccggcgggtcaagcactgcttggtaagttatggttgctgccagagtggcgagcaatagaacaagagagcgagccttctctagagcttggttcagtagcttctccctagtaattgaaaccaaagaaaagtaaatggatgattgtctaataacaaaacataaaattaaatgtgtgagtaagcttttttacatgttttgggaaggtagggaaaggtaccgtcgtttacgagtatgcctaggaaacactataccattcctttaacggaatattatacgttgacgtcagtatgatacagtatgtaatagacctgatagctatgatatcagacttgatataacctggtactaatgttatacggtacaaaatacctaataccatacacaatacatgtaggtaccagtgtattacgtatgtcaatatagatttaccatccaacactattgatacggtagcactaaggagggaggtattaggaaaggtcatcatggattaacattaaaaatgatcgtacgtactttttcaagaacagtagatcaaataaacactaaataattttgtttcacactgagacttaaagagaattatcaaactctaagatctgtaaaatgaaatattctcgtgagacgacgacatatacctgtcatcattagcctgggctaattctcgggccggttgcctgagatgatatcgccgttctttcaccgaagaatacatcccagcaagcttctccgacatgccggtgttgctaagtgcgcgcgcggcgcacgcgacgacggccagatggatggcaatgtaggcgaggacagcgccgatcagagctactacgtaggcggtggtgtgcgccgccctggagctcccggcggcgtaggctccgacgagccccgccagcgagacgaggacgcacccgtacagctcccaggcgcgcaccgtgccgtcgcgcagcttccggtcgaggagcagcacgatgacgagcagcacgcgacgaacgcggtggtgttgcagaggaggaacaccgtcagcctcgccgggtgcctgtcgcccatgaccgcgtcgccggcgcggtggccggcggcggcgtccgagtccgaccagaagcctcccggcgtgctcaggccggcgacgtacgtgaggctcgtggcgaacgtggcgagcagcaggagcaccttgcgcgacttctccttcacgacgtgctcgtcgccgtcgtgctcgccggcgggcagcgaggcgagcaccacctgcagcgcgacgtagacgacgacgagggagacgagcacgacggtgaacgtggtggtggtcctgtcccggcacgtccccgcggcgtaggcgcccatgaggctgacgaggtcgagcaccatgaccgcgcgcagcggcatcacggtgacccgcacgttccgcttctcgtggagcacggcgaagaggaggatgaggacgatgacgacgagcgacgacacgaacgcggtggcgttgcagtagaagtagaggaggtagcggccgttgtagtggtccctgatgacggggtcgccggcgaggtggacgccgtccttcgcgtccgaccacacgccgcccggcgggctgaacccggcgccgtacgccaccgtcgccaccagcgtggccagcagcaggaggtacttccgcagcgtgtactcccatggctgctcctccgcaacattcccgggcggcggcggcggcggcggcggcggcattggcgaaatcttagtgaactcaagaggaaagattgatatggcttgtacacttgtacactttgagctggactcatgcacccacctccaaatatatagacaggagagagtaggggtgctctgctagtgcgcggctgaccgtgtgggaaaaaaaattttacgcggcagtgccgcacgacgcttctcgtgcaacaccgtatgaattggtgatgctgtatcctactgctgcccatgcgagacttttctttgagccgctaatttagctatattggctcggctcaaagaaaaatctcgtgcggatagcagcaggacacacgtcgctagttcgtagggtgttacatgagaagcatcacgcggcactgccgcatagaatttttcttttatcgggtgcgggtgtgggcacgctggcagtctgcaagggagtggactctcgagggaacatctccttgttatttgcatgtcatctaatagttgtagaaaacttaaaaaaaatttaactagatagatttatatgtggtactccctccatttcatattacaaatcgtttgactatttttctagtcaaaccttgttaaatttaacattgaatatatttagataatatgtttgttttatgttgaaaatactactatatttttctataatcttggtcaaatttaaaaaagtttaactagaaaaaaaaagtaaaacgacttataatatgaaacggatggagtatatcactccaaaaacatataaaatttaacttctacaagttgtaaaaaaacaagttaaactatggctagttaacgtatattcacagtcaaattggtttttcattgcagcttgtatatttgtggagtgatttatcacatattagtctatctggttgaatctttttatattttttcataaccatttaaatgacaatagatacaatgaaggagtgtcgtccctttgagagtcagaattgtagcccttatgcatatacgtataaattgatacaaatatataaagaaagttgccacgcgatcgcgcaagcagagtagagagtggtacactaagtccctgactctgtcaagagagacttgactctgtcggtcgtcgtcgaccagctgtctaacacttcaaaagcaagatatataatcgcatcatgatcaaagtaattagatatatcctctattcgtaaactatggttatgtcgatccaattaattgcaaatcttgaaaagaataatataaactccaaggtcagatcattaactatacgtgtgccacaaggacacgcgcgttcattccctccgtgactttcagagtcttggaggtttcatacttccgtacgtagaggtggacttaatataactatcgaaaaacaatactcgacgtttgaattttttttttcttaatttatattcattgagggcgatttgactattttttttgaaaatttatgtcactttttttatttccttgaataacaacatagtagttgtttttcatcagtactccctctttccaagataaaaaagttaagcaacaaactattctaacctggaaaaattgaaaaaatgctgaactacatgatagaacttacaattccagtacaggtaaaaaatattcaaactcaaccatgtagcgccaaaattccagtttaaaagaagtaacatatattacatattgcataactctgcaatttagggcttaagaatgtacaaaattttaggcgcttgaaatctagcagttcccttaattatatttatactctaataagtttgcagtactatgaagtagttttttaaagataagtttgcacatatttaagttttcaaattaaatatctaagaagtcattaccaatatgatatatagaatcttgtccaaaacaacaagtggttttttacccgatgacccgatagagcgccgtttctccgagtaatgatggatgtatgccacttgagcggtgtgagctcagtaattaaccagttgtacactaataacatacttaatatagaagtggagcttccgcccctgattagcgtttgcttaactatgtttctctttttgtaggtgtacgaaacgtaggaaaaggtagtaaacaggctaactgatcgaaaacagccgcggagattacactccggacaaaatccgtttgccgccggcccaccaccaagacagcatgtgcatgccctgtccgtccagtacgagtggatcaacaggtcagggcacttgatgatgatactatggtggtagatgagactgaaaacatatctcctaaggtgccatccttttcctttgttttggttaatttttcactttggaacatatatttaggataaaagatacacatggataagaaaaacgtaagatttttctcatgcatagaaaattacacggaaggtacagaaatgacctcttccaataaaggaaagaaaaaatacaggcacgccgaagaaaaatacaggcatcaaaagaaacatatagaaagaattttttccgagaggtttggatcccatactaattataaattaattctcaaaaatcactatgatttgagaccgtcccaagaaattttgaagaaattggaattttataagattttggaatggctattcctttacaccaaatggacatttatgaaaaaaaattgtagtattttaacgagtaatacttacgtatgtactaagaaatctttactaaactcttactaacaaaatctcaaccattggatttagtgggttgttataaaaatgaagtttcaaccacatttgacatatcaatttaatatgatgtttgcaaacacgttttttacatgtatcctttttctatttgaaccctataaaattcctctaaaactccttgttctaaattggatcccttagatttttagtcgttaaagcacttgtcgtgcggagcagttaccatgcaaagtagatgtacttcaaaccaatgtgtcataaaattttacaaacttttttcgtaactatttacatgtgttttgatgagaaatgatgggatgacttctaaaagtctcacgggataaaaatcactttccatgcatctggtgcgtgccaagactcaactagggatgatagagaaaaataaatacggataccattagcaaatacttctcagatagtccgaatataaatatttcttaggtagtctgtatacaaatacagatataatatcagagttttcgacggatacgactatccaatgaataatactattcggatatccgctaaagacataaaacatacttattttgtttctaactctagaccttcagcatacctatttagattttactagagctttataaattataccagtccacactattaatattatttaaacttttaaatattttataaatttgtatgataatatcagttagaaatgtacttatacaaacgatgttgtacatgttgaacttaattagcattgcttattcttcgatcaaactttttatataaaacgagctaattatgtgtgatgctatttgtttttgtcacaagtttaggtcgttcttgtgttccgagaaatatttatttctgtactcttgtttaatcatattagatccttatttatattcgatacgatttgtatttatttctatatccgagctattcatatttgttttctattaaaaaaacaaaaaagaatatgttacgagtataatccgtcctccattccgtattcattcctaggacctttgactaccgaaagtatgtagccgttgtgcattcgagttcaatgtttgcaatataacattcgttaggttcgccaggtttagatcgccaggtttagatgagtaagagcatctccaataggctatctaaattaggttctccaaacactcatatatccaactcttcatctgatttatcaaattaaactcgttgcttactctgacaacatctctatctaccctctctattctaagtctatgatagtgcgattcatatgtcagtctctccaccatcctcacaaccacacatccttcaatccttcatgcatcctgagttagcaaccatgctgggaagaggggagaaggcagcagcggtggcaagtggcgagaggaatggatagccaccgtcgttggtggcagatggcgagagcagaagaagacgacaatgcagcggcggcagcaccagctgcgatggtggtgagctcgcgctgtgggaaaggtggagctatgacagcctgtgatctcggccggcagcgaaaggagcagttacctcggctggcgacgctgtgacgactcaactgtggtgccacatcgtcatctcgctccgagccatccagccgaccaccgtcgtgtcattgtctcgcactcactactcccttgccaccgagccgccatcgcgccctcgctcttccctttccaacatcgtgttgtctcgccgtcgagctaccctatcgccctcgctgtggagctgcgtcgatcttgcgccctcgctcctcccttgtcgtcattgccttaaacgaagaagacccctgggccaccttgcgaaatgccgtgtcctcctaccgtctctcctccctcgccgagccaccctcgccccatctcctctggccgcgggtaaaggctggcttgatggagcactgccggatggctgcctggcaaggagagagagctagagagggggatagagtcatggggcccacggttggcgagtgatattgggtggccaaattatgtcagggattggagagatttggccagcgggttggagaggctgttggagcactttttttttatggagttgccaagttttagcttggaggtgcacttagagtctgttggagatgctctaagttgctacttgctagctgctggttacagcgacttcgtccaaactaactaaatttatgtggcatgtaaaagagctataaaaacgttatggttaattaatattaattattatgaccttaaaataaaaatttatttaatttttaaaagaattttaaattttcttttaacaaaacaagttgtttagaacaatagctcagccaagaagttgtttagaacgcagccacttggatcgtatgatggcgtgagcattattatcggctagtctatgtttagcaatataaaacagtgggatgaggatcctttatcataatgttactaccattaccattacagagactgatacgtggtattagccaaatttaccgcattttattcgggccaagagtacagtgttacttgtaactttgacccatccaattctgataggaataagtccactttgactcccttaaccagtggccgaatctgattcgtatctctgaaccacaataccagatatctccaccccccctcctctccccaaaaaaaactattaaaaccggtgcaatttgactcctcatcggttttcgctgatgtggtgctttgacttggtcaacttgtgttgacatggcaacctagtcaaaaatacaagtgatgcccacatgtaagtgactagggaaaaaataagaaaatatgaagtccacatgtcagccccttctctcctctctatctttgcaagactccacgctcgatcggcagctctctgtctgggtatggtgaacctcggcgtccctggcgagctctgcgggcgactgctagagctagggaagcagttgttgggtcgcaaccccttcgagctgaagaaggcgcgaccgagctgcttctggggcactgcgccgttgaaggcgtggctgagccaggcctcgacggccaccagatagggttgcaagtgagcttgtccgcgaacccgcttacaggcaaaattagtgggtaacccacgggtttgactcgcaggttacctattaatttgacatataaatgagtttgtagattgacccacttacatctctaaatgcggcaaaccggaccacgacacaaaaattcattagttatcatctatttgacctataggtaaattcgcgggtcggtccgcttgcatcccaaccaccagacggagcgccatggcttcgtgcgccatgctcttcctttgcctcctgcctcgggatggagccccacaccgacaattccgtgctctccatcatccttggctaggaccatggtggtggcctgccacgacaatcggcagggacagcaaggttccgaggtttgaggtccgagctcctccaaagcggcatagcaccagcacgacggtggggacaggaagcatcgccgccgagggcttcttcggtgagtttggcagtgcgattggcgatctttctccacccttcccaccgatggtgagccccttcctccacttcgccactgctgcatcaacgttacacctcctcctccaccaccacgccgccgttgtcggatcgaactgcgagcgccaccagaagctgcaacaggcgaggcgagcattctccaagccgtcttctccaccgctgccctgcattcccgcgctatcggccactccgccactagcgtcagggcagaaggggccagggtgggagagaaaggaaatccccaccatcgtcccgctacctccgccgccgctctccgtcatcgtgccagtaccctgctactgtcaggtcgagtagaagaaaggggggagagagggtgagagaggttagtagagagaggatgatgacatgcgtgccccactttatttttttaaatttatttgatgactgggatgccacgttagcgaaaccaccctccaaaacaattgagggatttaaagtgcaccggttttaattgttgaggaattgagatatccgtattacggtttagcgatacaaataatattcggtcactatttaataaagtctaagtgaacttactccattctgatatatatgtagaaatagggccttattctacaggaatgctaattggcgcgtatgccaaaagcccacgaaagcccacgtactatactgccaaaagcccacacatgtgtttctttcctgttttttttccttttttagcagccactttttttttctctattttcatctcaacttttaaaaactttcaactgaaatttgaaattttcaactcagatttgaaatctttcacctaagatttgaaaattttcaactcaaaatttgaaaactttcaactcgaaatttgaaattttcgaagtcaaattttgaaaactttcaacttttcatctcaaattttaaaaactttcaactgaaatttgaaactttcaactcagatttgaaaactttcaactcaaatttaaaaattttcaactcaaaatttgaaaactttcagctagaaatttaaaatttttaagtcaaattttgaaaactttcatcttctcatctcaacttttaaaaactttcaactgaaatttaaaactttcaactcaaatttaaaaactttcaactcaaatttcaaaactttcaactcaaaattgaaaactttcaactcaaaatacaaaaacttctaactcggatttgaaaattttcaaatcgatatttttgaaaaactttcaaatcgtattttgaaaatttacaagatcaattgtttttgttttttattgagaaattactatagcattttcactaatcaccatgattaatactaattgttaggattagtgacgtcgttgtcggtggaggcccgcgtgcgcgcgagctagcctcctcgcgcgtacgtgcgagctagccatgccccttattctagcttaccaaacattcgacgtgggccaaaatatatgggtcagcctgcctaccttttgacctattaatttcttagtgggccaaattcctgtggcctgtggtcctgtggatcacattttagcccattaagctgctctacaccagccaatttaacagcataagtgggccatttttggcaatatattacgatctaaggaataagtctacttgatctccctagtctccctcaaccgcaattctaagtttaacgtctccccatcttgaaaactggtgcaaatcgatacttagttttcgtgccatttggcgtctacatggcacttacgcgtcagttaaaaataaaaaataaaagtttaatgaactcacatgtcaatcagacaaaacaaatactaaaatatagtgccccacatatcagtctttatccttcacccatatctctctatctcccatcttgttcccactaagatgtccctgacgagctcgacgtggtgtccactgaagctccctcgccggactccgtcccgctgccgtcgccgtccaccaccggtcgccgccccacgctcccttgctgtcctccgcgaagaagaaaatgagaccggggagaaggggggagagagagccgtgtccccgtcaccgccggcgctgccgccctagagagtcgcgtttctgctgctggcttcttcttgcttggcatctgcgaagcacaggagtaatggcacgaggtcgacgacgctacgctgccgttccatggcaaggatgagccgcggaggtacgggaagatcatggcgtaagtggccaggttgaagaagtcttcttttctctcactcacaccgtcagctgctagctttgttagctaggagtagctagctgcttgtcctcttgctgtcgagaggaggaagaaagactcgaggtctcggcgccggagctaagctgctggtggttggttatcgtgttgacttgtgcagagcccagacggcaatgtcatcgactgcgtgccacctcacctgcagccggcgttcgaccactcgaagaagctccgaggacagaagcccgaagtgactgatcaatccattaattattcattcttttttgtttcgatttgcagtgatcgttcctatctcggtcgatgttttcttaataatgtttgtgactgtgtgtgtgcggctgcttgcaggttgagcccgagccagaggagaggcccaaggtcgacggcgcgtcggcggcgcagggggaggcggcggaggaggaggaggttgtgttccccgcaggcgtggacggacggcgacgagccggacgacgaagcgcgatgtgctgaggtccagctcctccctccgttttgggatgaagtagccccgtgccgccggcgtcgtccgctgtgactccactagcgagtcagtggcgtagctacgatttagagtaaggatggtccgtctacatgtaatatgaaaattaaatgggtggtccactgtacaattttattatatacatatactattgttttaatctcgatcaaattcttaggtggtccacggaccacagtaccacctagctagctacgccactactagcaacggccactagaggttagggatggcatgtgagtcccataatatttttaattttttcatgtgattgacatgtgagactcatagatttttttttttggtagggttgcaactgacatgtggatcctattgaatttttaatgccacgtaagcgccgtatagccgtcacgtgagatgaagactaagtcaaccatgacacgtaggcgccacatcagtgaaaaccactctcaaaactacagagtcattttataccggtttcgatagttggaggagttgtggtgtcgacgttgagggaggtgatttaatcaagagcaagaattgaggaatgtcaaatagacttattctgagtaataaggtatagtggactaaaatttcacccggctgtcaactactacctcctttggtctatttggaaataagttcactttgagtcccttaaatacatatctaaccttattcatattcctaaaccgcaattccatatatcttgagcctctaataaatgaaataggtgtaacttaattctctcaacagttatcagagtagttttctctggcgtggcatgttggcctagtccaaatagctgtcaattatgtggggcccacctgtcattggcccctctctttcttctcttttcctcacgatggcggcgagcatggcagcagggcagtggtgggatgcagcaaggcggcaacgggtggcaacagggtggtcctccaggcgcttgctcgtgatgagccctcgccaccgagtccactgccagagcacgctgcccatctaaagcagcaaggccatgatcgatgccgtcctggggctcgatgccctcgaaacaacgatgagaaacaatgacgcgacctcggagccaaacaaggatgacgcgaccatcgattgtcgctgcttctttgccagacggatgtaatcgcagtgggcagcggatgggcatctcaaagagcacgccccagtaggcgaggatcacgtcattgcataaggaggtggaccttgtcgccatcggcaacggtgcgcgtcttggtggagtgggcgttcgatctacactcctctgccgccgaggccacctcatgcttcacgagcaccagccggagcgggctcaactaagagaacccaaaggggatattgctctgtgacggccggtgtctgcccttccatggtggcagctcgagtggcaatgggtctgggctcgaggagggcgagatagccgacagtgtgaccaaattggcatacgacagcaacgggagcgagttgagcgagaagaacattggctgcgactatgaccacatgtggaggatagagggttccaccgctgccgccgctaaagggagatgcacctgcgggtgtgccggttgccgcaggtagctacccacttccaccaccagcctatgatgacactaggtgggagtgcgctgctggattgtctaccttgtgctgtcatcatgcgatgctagtggcttcctctccttcattgctatggcagcgtgttgctccagcggtagacgacatgacccagttgcggtggttgcctcgtcagctcactccatcatcaccaccgctcccctcatgggaggagggtgacgagtagagctacaccgctcgccgtcaaggtgtcaacgcttttgtgtgaaagaaaggagaggagagaggggatgataagagtggggactgacacatgggccccacactttttttcccttgtcaccccatgtctattttaatcttcacaacgactgggctgctatatggattcgcgcattgccatccacctacgaaatagctgagggagtcattttgaatggttttaatagttgaggggttgatatacccggttttgcgatcgaattatacaaattagatttcaacctataattaagggagtcaaattggactttttccagtctatttagtgcctgtttggcacggctctagctctaactccatctcttctagagttagagcctagccaaacagtttcagctccatataaaattgtagtggagctggctagagcgctatcacaaaatgaactagataggtggagctaggtttaggctgttccacaactctattttagactcaactcttgaagttaaatttagaagttggggctctaccaaatgatgtcttagatctgatcaacctaattttgattttctagcacaattcaggtatattgagcagcagtttttctaatttcggcaaatgatggaggggataaatttcgcccctttttttattttaggtcccacccccactcccaactccttttttttgcttgcttgtagtggatcaaagttcgagttcatttagtactacataatagatagattaagaacgactactgttgtgtatgaattcagtaaattcaggtttcatctgaggatggacgagaactcaggcaggtgtgaatccagtgcacatggcaggctcgcacgataaggaataatattttactatgctgttatctagctttaagagcaattaggtttctgtgtcactgtgatctacacgctgttactgttagggatcacagttatttcaaagtactcagcatgaaaacgacgacttcacaaacgatctcttttcttgtcagtcagaccgcatctcaaattgcacgagttctactattaacatctaccccaaaaatacgtttcttagtgagtctctttattaatctctctccagaactattttatggtcactcacacaattgctaccttttgttaagtagccctagtacttgttccagctgattcttcaccatatctatggagcttaattaaatagcagatgctgaataaaggtacgtgctaagattacatctaagatccaacttgcacttttattgtggtgtaatctaaaaaaagtctactctccccagtgttaaggactcaaggcaatgtactggcatatgcatcagatatgactagatccatcagattctttacaatgttcgaaccagtgacagttgcaacttgcaatctgtaacttgtgcagtcaaaatgcaacatctcagctggaaaggaaaggaaggccatgaggcaagcgacccagtcatgcgggaacaccattctatccgtctgaaggcattctttctcttaaatgctactgcatttgtcatgtccctgctcaccattatgctgcttctagacaagcggctcatcatcccattactccatgacaaggttccaagcacaactagaccagtgcggactatagtgctcaaagcatacatctctattgctcttgtcggtcttgcgggggcctatgccaccggaagcagccgagaaagtgacactaccatctatgtgggcagtctagtttttgccgttcttgcatgcattattgtcctcaagacaattatattccatcagtcagattcaagtgacaggtatggaatgcatgtatatttttctgcttccaaatattattgacatatgcaattccatcttaaatacacatgctcatgaatgactaggtcaagtaatgggacgagaagaagaaatggtgaagcacaggcaaacccaagcagtagaagagaacaaacaggcacaagccatggtggagccaagttgcccacaagcaatggtgtaccaccgaccacaagaaatgttggagtgcagacggacacgagcaatggtggagcagacacaaatacaagcaatgcggatattctggagaaggctcaatctcttgttgtactgctttccactcttgtagcaactgtcacataccaagcaggactagtcccaccaggtggtgtttggcaggacaactggaacggacatgaggctggcgatccaatactcctatccatgcaaccagaacgttacaaggtatttttttactgcaactcaatggcctttgcagcgtccttggtcatcatcatcttggtccagtataaacctatgctcaagcgccgcatactacagtttgccatgatactggatttgtttggcctaattggtgcatactctgctgggagctgcagagatgtaaccacatccatttatgtcattgccttggctggagctgtcctagtctatgtgattattcatgttctgttcgtcacacttgaagatgaggacataggaaagaagggtggggacaaggacaggaagcttgaggacaagaggcgcaagaggttgctcctttttgctgtgttgggtgcgaccctcacttatcaagctgggttgaccccaccaggcgggtttcgtctgaaggatgatgagtttgggcacaatgcaggcgaccctgtcatcttttacaactatccaagccgttataaggcgttcttctactgcaactcagtgagcttcatgtcatcgattgcactcattatactccttgtgaacccaatcctgtacagaccagccatacgaagctatgctctctcagtttgcacagcggtaggcatgtttgctctcatgtgtgcctatgctgccggaagcacccaacacctaaaaacatccatatatatcttcgggttggtagctttagtgctcttcattatgatcttagtcctaatatgtttctatcatagagatgtcaatacaggaagcatgtcaaccaacgaagaagatttagagacaggaagtggagttaagacccctgtgaaacaagaagccttcactgagacaaagtctgttgatgaaataaaagaagataacacagcagcaaagtcccctaaaacaaaggaagatgacagcacagtggaatcctctgaaataaaatatgagggtgaatccaaacaaaatacaaccaacaagtccattgaacagaatagaacagacacagactctctcaggacagaggaagactcaaaaaagaaacatgcaacacgcaaatacttgatgttgttagcagtcttggcggcaagtgttacttaccaggccggcctcaacccacctgggggtgtgtggcagggcaatagcaatggtcatgcagccggtgacccagttatgcatgacaacagaaggtaccgttacctcatcttcttttacagcaactctttttccttcatggcatccattgttgttatcatcctgttgctaccggagaaactgctaagggagaaccggtcgtttaaggtgatgcatttaaccatggtcatgaacttgctcggcctcctactagcctacatggctggctccagaatgaggtcagagtcttctggatatttcatggagtttgttatcactacactatgctttgctgcactccacaagattctatccagcgaaaaggagcaacaaaatgatcagccttctcaggtagaccaacaaggggatagtcaagtcagttagtttagatgttactgtgccttgtaactctatcaacacatgatttctttgtttactaggatgcattttgtactttccaatatattagctggataaagtcaggcacaatcacaatgtatgtgttcccaaaaaataaaccatgattataaatatcaaagttaagtcctgcttgcccaatttttaggagccaaaagagacttccaggttttcagaagtattgaaacatgtcaagtggctttcaaatagtacagtttgcttctacaatatttttgaactaaatttgatattttctgatctaaaaaacaatttcttaaagggctttgtggtacatttatttaaacaaagtatatgaatcttaaaataaaatcaatttttaatggctagcgttttatgcaggagtaaatacatttcacgtgcttatgaagtataaacaacgaagaaaaaatgtttttacccatctctccaatgaaatcttccatgttttcttgggcccaaacctagatgcaggtcaaccattactt

SEQ ID NO: 64042 - DNA, 1216 bp, Oryza sativa
ttcctgcagcccgtaccagggccggcgctggctcgccgtctccgccgccccatcagagcaccggcgccgccgtaaggagagagagagaaatgtggatagggttgggggtggatggatagggtttcctaagggtattgtgggtattatgaataatagttgcattttttttttattttaaatcaaaacttaacggactagtggaaacagggtcagacgggagcttcatttttgaaaaggagggtcaaataagcaaactctaaaaagtagggtcaaattggtagttagggttcaaaacggggtcaaataagcaatagcccctaataattatggaagataggtgaaagaatctatgttcagtcgaggagccaatatgatcgtagctatgtaaagagataggagcgaaattaggtggtctataatctggggaaacaactggtcagccagaattaatataggatcactggagacaagtaaattctcagaaggcgaggtgaaccaacctctgtatccaatggcatccaaaatcaatctacatctgtggctcgacacagcagtagtatgagatgaaagcaaatactaactgttactaaaatgcaatgcgcatctggtttgctgcctgtgcatactcactttggaaaataagaaaccgcagatttttcgacaagcaacaagccagactttcagacacaatccagcaaattatcgactgtcttgaactttggaaactccgggccaacgcagccattaaagagaaattttcattctggtgtgactcaatcacacagagctaatgtaaatacaaacttgaatgttttttgtttctaaatttcttgtatattctactttctactcctacttctcatgtttccccactcagtaactctattcttctccattttatcaatgaaatggctataaggtagaaccagctctaccttcttacgtcaaaaaaatgcaatgcacatagatcagaaatgaagaacgcaaaggtcatgaacttgaacaggttcacaggtaggttagttggaggtgggtaatagcagtgagaatacgtaccttggaaagttgtcgtgattttttatcccaaactgatgatgtgaccatggctactacggatacatccgttgctcacatcatggatgaacaacaagatatcaagttcgagtcctccaagtgccaaaatccaattcggccacctgctacactgctgacttca

SEQ ID NO: 64043 - DNA, 10308 bp, Oryza sativa
ttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactaagggtccatcaagtggtatcagagctttcgttgcttggtgagtttttatcttcctataaccagaaaatagccatacaaaaaaattcgtatcatttacctagccatattgtgccatttcattgttcttttcagtttttgctttgttgaattttgtgttgcatcgtcacgtcgtgttgctggtcttagcgtctggttcgtttagagtttcgaattctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgcgtttgttttggccgtgcatgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctccttgccgagtcccacttgcccctttggccgagtccgactccctccctctcttccacggttccgagttgtgtcaaacaccttggcgaatttttgtttggtgtcggtttcgagatctgtttggaaaaacggaaccggcataaattcagcattccattttttttgtataattttaattttgggtttagacttttacatttgagtccctgtaaattttatatttatgtttgagtccctgtaatcttacattaaggtccttgagtcagtttttgttaaaaagaaaatcaagaaaaaagtgagaaaaaaaaggcagaaaggtgaaaaaaaagccgcacccaaaaaacagaaaaggaaaggaaagaaaaaaaaagaaaagaagaaagaagaaagaaagaaaagtgaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatataagcctacccagagctccacatatttgattacagccgtaccgcaagtgtttgccaaggcatcgatacatccaacctttattggggtgcttggttgagtcggtgtatgtcaccattccacttgcattggtaagatcttgtaagagcttggttacaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttggtagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaatttgcttgcaatgctgaaagtaaaatagaggagaatatgaaaaagaaacacgttatgtctttgcctccaattactaactatttgcaggaagtgtgtaatcacgaaaaggaggagagagacatgaaagagccaccaattccattgttcacactcaagttcgagacacctccatcatctaaagaggacatccaaggtaaagtaaatggtactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccatgtccaactaatgctattttttatatctttggcaaatataatgatagaggaatatatttggtgcatagagttttcatttgttcggatttagagaaacatgttattggatgaaacaggttattttgaatggactatatgaagaacaccatatggaaaaaccgaggacggttttccgtgaagaaggggaggatgatgtgaccatggctactacggatacatccgttgctcacatcatggatgaacaacaagatatcaagttcgagtcctccaagtgccaaaatccaattcggccacctgctacactgctgacttcaaacggccgccgaagctccatccgacctccgttttcggcccgtgagtacttgatggaaaactctcggagtcctctttccaatgcatcaagcctcattgccaaattccatctcagtcggcagcaactgaagaaacaaggtgctgcgacacctgtaatgggcctatgggcttgtaacttcatttgggaccctggcccaggtggggcccatgtggggtgcgccccaagctggtggagcacgaccctaggcacccctaggtcgtcctcccacccctatatatagctaattaccccttcagggtttctggggttttgttaaattaaagtttagccattgctacttgcttgcagcgcgcgtgtcggctagaccgtccgtctgcttgttcttcggaaccccaacatatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggtccatcaactgatttgtaagaaacttctgcattgtcacaggatattctgcaagaaatattgttctcttacaggctagcgaaaattactcatggttgcaagcaacagataagaaatcgtaacatatatagtaagattgtgacattcgtggggtagtaacaatcacgtaatcggcttaattaccgtgagcagttgttgggatatttcggcacaatcgatcgaatcgaccatacaatttacctcctgtaaagaaaacgcaaagaatgtgggagtagcactagcacaccaccgatgaacaatgctattacgaataggcgggtaggaattaatggatgtgattaggcgagtagctgacctgaggatggccggagtaaatccaaccgccggagcaggagggggacggggtgcccgcctgcgcgacaaggtgaggcggatcaaaaagcaggcgaaaattaacaaaatctgcggcgagatggggggaaactgcgggggcgaggccaaaggggatcggggagggcacgccacgaagctggaggggagcgagacgagaggtcgatttgcggggcggcggcgcaccatgccggttctcggtttagccgtccgcccgcccgccccacggccgtacagggatgatgacggtggatcgcaccaaaaatttcttattcttccctacgccctcgattcaattaaacatgtggccgaaaatttatctatattggtgaaatccggcgcattactgcggaaatctattatattattaaaggaacagaaaaaagagcctccacgttcactctcatggcctagaaattctcacattaatcggtgaaaaaaaaaacagagtccatatagaaatacaatttagaaatagctgagattgggaattaaaaaataaagaatattagaagagaagactagagtccatatagaaatacaatttagaaataggtgaaattgggaattaaaaaataaggaatactagaataggagactagagtccatgtagaaaagaaaaaggagcctccacgttcgctctcatggcctagaaattatcacattaatcggagaaaaagaaaaggcagagtccatctagaaatacaatttagaaatatctgaaattcggaattaaaaaataaggaatattagaagaaaagactagagtccatatagaaatacaatttagaaatagttgaaattcggaattaaaaaaaggaatattagaagagaagactagagtctatatagaaatataattaggaaataactgaattcggaattaaaaataaggaatattagaagtagagtatagagtccatatagaaatataattaggaaataactgaaattcggaattaaaaataaggaatattagaagtagagtatagagtccatatagaaatacaattaggaaataatataaacttggaattaaaaataaggaatattagaagtagagtatagagtccatatagaaatacaattaagaaaaaaaatagaaattcggaattaaaaaataaggaatattacaagtagagtatagagtccatatatgaatttaaaacttactaaaatttggaataaacataataaaatttaaaaatagagtttagagtctgtataaaaatacaatttacaaataactaaaattcaaaattaagaaaaacatgggaagaatagtttaaggacaacataggaatacaatttagaagtaactgaaattcaaaattaaaaaattaaataatattaaaagatgagtttagagtccacatagaaatacaattagaaataataaaaattcagaaataaaaataaataatattggaggaagagcatagagtctatataaaaatacaatttacagaaaatgcggaattaaaaaaatatattaaaagacgagtctagagtccatataggaatatatataatataaaaataactaaaatttgatattaaaaataattaataactaacaagtatataaaatataatatgaaaaatcagaaataaaaataaataatattggaagaaaatcatatagtctatatagaaatacaatttacagaaaattcagaattaaaaaaagaaatattaaaagacaagtctagaatccatataggaatatatataatttacaaataactaaaatttgatattaaaaataattaataactatcacgtatataaaatataatatgaatattacacattagtagttttgtaaagttattgcaaaatttaaaattatgttgtcattttaatatatttgaataatataatgagaaaacatatatgctattatatgagagaaaaaataatgatgctagccgcgcaatttgcacgggccaccatgctagtttagtatgataacaataaaaaataatatgtaagatagctagataacatcagattaagtaaattaatatggtttatgataatttaaatttaaatagtatgtagaatggcgattcaaacgtaaaaagtaaggtggtatgacttcatttaagaaaaaaagtagggagatagtttggaccgtagattaaggatatcataaaacgtaataaaaatatacattgaaacattatgtgaattatgttggatgataatttaatatgtttatatttgaaaagctcttaaattataaaacctataaagatatagcatgtttgcatgatgtttaaatgtgatgattgttagtggatgatgatgtggcatcttgttagtggatgataatgtgacatctttacatgttaagcttaaggagttagtgggggataattttatagtaagataggattcgatcctatatctatattttgagcggatgaagtacatactagtgatgccacatcaggtttattgttttgtgtacacgtacccgtaagagaagtgcatatacctttcccttcatacgggtgcaaagctagcatcaaaataattaggtgcactaccattgagaatctataaaatttcagtacaacactgtacattatagtgtttttaagtcagaaattaagaatttgagagtcgaatttttttgagaattaatattatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggcagggctgtcgaactgcccctattcgataggatatccgtcgaactggcgcagttcgacagggtcgcgttctccatttatttgtaataagttatttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctttgtctcctgcgtcagctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaactgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgctgtgctcgacgtgggtacccctgatccggctgaccccctggtgtactccggtgctggggtgtgctgaaaggaaggacgaccatgagatgtgtgggccgcttcgtacccgcgacgtgaagaggatagaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaggcctgacgactggaggtctcgcctctagtctttgcagcagggtgtcggactccacgtgaacgtgctcaacaaattccgcctgttccacaaataatcaaggcaattaaaattatttaaccagttgcacatttagtaagagtatttaacaagatgcacatttgttagaaataatgaaccagttgcacatcatttataaatactaaattagttccacatttatgtaagaaaaggaactagttgaaccaattgcacatttattagacatactgaactacttgctaactttttaaaaatattgaactagttactcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccttcatacgactcattgatatggtcgtccaatcatcgggtatgttagtttcgttgtcccacagtgttgtatattctccttccactacaagcgcaaggtattcctcgttttccacttccatctgatccactaccgccttattctcctccgctgcatcaacacgcataggcgaatccggttcttcatcgtctgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacatgttgtcttctgcaccactattgccagactatagcctttctcccttactttactaacaaacttcctccaactcccagttgacgcaacctccactactctccactgccatccatgttgacccctcactagccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaacctattacaacttatactacattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaatcatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcttttgggcctcctctcgggcctgctatcccctcccctggctccctcgggggctcacggcgacgatgtggcgactctcggcggtggctggcgatgtggtcctcaaacaaatggaactcgcggcctgggtggacggggctttaaaccggcctgtcgaacgcccattgttcgacagggtcggtggagggacctgtcgaacgcccccggttcgacaggcctcgcggcgccgggttgtgggccctgtcgaactccctccgttcgacaggtgagcgtgtcgaacgccagccgttcgacagggctttgtcgactgcccgtcgttcgataggtgccctatcgaattgcacccgttcgacagggacctactttcgcgattttccccggttagccactacttttgcgattttccataaaaataatattaattctcaaaacaaattctttgagagtctatgtgcactccccccccccccctccccacataatatagcttcgccac

SEQ ID NO: 64044 - DNA, 773 bp, Oryza sativa
acttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggcgtttgggaaagcaagcaaggcaagtcacatcatccttgaacatattgaatcccagtctataaaagtattttgatttaaattattgcattatcgctttatttaaattcccgcgttatcactgttttatttagccatgcctatttacctttgttatgaccttattattattgctattgttattattaccttgttcaccctagaataaacaaaaccctaactagtggacattatattcatggttccactagtatgaatttaggtagatgcttcgctgtttaataggacaacattaggtggtttttataactttagactttgggaattctcatatcttttggacactatggaattgttggtttatgttggaattggacacacacctccccctctattcaaaacccccaaaatggttttaggctgggctcgaggtgcgtggttgggttttgttagtcgtacctcgggtactataaggattaagctcgggcctctgttgcaaaacactaccgtacttccacatgtctagtgggtaaggcttagtttgtggctcagtctagtcataaacaaaag

SEQ ID NO: 64045 - DNA, 8263 bp, Oryza sativa
acccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggattttcaactagtactagatgattagttttgtgaagaagaaggtgccgtcaattgtctgtcgaagctccagaagactgttggatccgtcagcgcagcaaaggaagcagtgaagccagatgtgaagcaagagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcctaatcaacctgcagaataagcaaaacaaacaacacatcaacaaaaagagttagttcctttaaggtcttgtccctagttctggtctattctttccttgtatgctccccctctcaacctctaccttgtgacagatggataacactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtacctacagtccagcaacagtgcaagttatcagaatttctcaaaactgggcctccaacctttgccatggccgtcgatcctatggaagccagtgattggttgcgcacaatcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactacttctagaggattatgaaaattttgagaaacttgtggacaaagccatgcaactcgaaagtgagcataatcggatgacgaactgcaagagaaggattgtcaacatcccagtatttccatgtggaaaccaaggacagcgcactgagccacttcagatcaccggatcttctgttgcgcatcaagagtttccgccccaagaagatggacacaatgcagacaacaacattagcaatactaatgatgatgatgttaccaccaacaaccatgcttcttgccccaatagtgaccactcgaatcaagcgtgcaatgtcaacatcattcaccaagatgtcgacgatagtatcaatgatggcacccaaaatgacaaccctagtaattgggactctgggaaagactccgatggtgatagcaactatggtaccactgatgccaatgttagcaaggagttccagccaccaattccaactccaagtcagaatgactgtccccagacggatagctcagcaaagaagacgttgatttgctacaattgcaaagaaccagggcattactcgagggactgcctgcaaccaaggcaaagtcgacctccacattaccgccaatttacacgaagcagacatcccaatcgtattgtggtcactggagcaaacgccgtacccgtgaggcctcgtgttaatcagaacccatagcagaaacaatgtaccgatgctaagcacctttccttttaggcagtgcttagtattcatgtaatgagggagaaatgtgtaatacagacaagttccatgaggattcttttggaagatgcggatatgtgattatgtgtataattgcttgttgataaaggagacctagggtctcatttcagaggaactatattctaacctcgagttaataaccaacctgtggatggaaaagaaaaccaattaaactgtgttgggttaaaaagccaatgagacagtagttggggataggagtttgggtacgccttttacagatcaagataaggattgttggatgaaacccataagggtacccgccatgcctctacattgataagttcggatatacctacaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacaaaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgccccgcaacagtcaccttgtcattaagtaagcaagatgacctaggcaaaagtgtttctatgaaggcaaggagtgaaatcttcaactcggtatcagatgctacacggagtgaaaagtgcaagcaccggttaccaggtaatgccatgtcttgggagatgatccaatgggaaagaacgcatcaaggttaaaggtgtagaggaatacgttgaatgctaactgaggacaacctgaagataataatgggaagtaaactgaatgtaaagaaagtgaatccgagctgcttgttcgtgggagctattcccagttatgaaccaagtgatatgttcgaagatagtctacagaggtcagattaaaatcacatctaacaacgaagcttcagatctggcaggatcacgatcagacaataacaagtccagcagcaaagtcattcgggaagacgtcaaagcatgtcaagcgggataaattggttctcttgggaagcataacttatagttagagtggttgaccctggcatcgaatagcagaagtacctagcaccggagaccaggaaagccaatatgagacagttaatggcaagttgtcaatcatggtatccttagtaagcgggatatcatagtctaaagcgtatggtggtaagctggaaggaaacgccaagcatgatattctcatgataacaagcatggtatcctagtaatgacaagctgatatcgacgcataacgtgaagtgggtaacttgtatgaggttgacgccaaagatatgaattatgagaagttctggaactgaagtcccatcttcaagtgccacaatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcttgtaaggggggtggatttgtcacgtcctgataaatccatcccgaattaaaaatcattttctaaaaggaataatagaattaattaaaattcgaaaagaaattggcaaacactaaaatacgtacaagaaaaattcgaatgtggcccggagaatttttgttaaattctccttggtctaaaacgagccctcaaattttagtggaattttcagagcacaaataataattaagaagaaataaacaaagttaaagtggttttataaaaagaaaagccctaaaaagtcttcttttcccccccttcccttcttgggccggctcggcccaactccctccctctctctcctctcccccgcggcccatcgactcctccccgcgcgcgcgccgctgacgggcgggcccgcccgccaccctcgctgacgggtggggcccacccgtcatcgcctacctcgcgccgcgcccgccgctcgcccgtgccctagcgccgccgccgccgccgaatccgccgcatcccgccgtccccgcgcgccataaagagggggaaatcactccccgtgattccctctcccttttcccccgtttttccctctctctctctccctcggattcgtttggaatctctcccgaaatcctcgccggcgtcattgatggagccgagatcgccgcgccggtttccctctcatccggccgccctctctccctcccgacgctatataatcgttccccgtgcctccctcctccgtttccgccgctcgccgctctctctctccgtcggaatcgtgcccgcgccgtcgtcctctctctccgccgtcgccgacgagctccggttcgccgccgccgtcgctccggacttcctcccctctcggcgtcgcctccttcggcttcgccgcgtcctcgtcgaccccgtccgctcctccgtttcgcccgccgaccgccggaacatcgccgtcctcgtcgatccgaaccgcgccgccgccttcctccgctccggtcgtcgtttccgccgtcctcgtcgtcccggggtgagccgaggaccgccgcttcgcttccctcttccctcccctctctcggccgccgctccgccgcgccgttggtcgccggcggcgaccatcggggcgcgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggccggcgtcagtcgcgtgcacccggtccaccgtggacagagaggctgccgcgtgggccccactcccgtggacccggtccgcgcgccctctctctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccggcgtttgggaaagcaagcaaggcaagtcacatcatccttgaacatattgaatcccagtctataaaagtattttgatttaaattattgcattatcgctttatttaaattcccgcgttatcactgttttatttagccatgcctatttatgtcacgaccggaaataacccaacgggcattccttacgtgcgtgcattaatccttgtcccaggaggcaaggtacaccaaaagttgatacaattcagagtttaacaagcggaagcgtaaataaaattattacatgggcaacgaaggcccagcacactcaaagacaacgaaaaacagcggaagactagggcgacgaccacaggcacttgacggcaggcacgagctagacaccaaagccttcatcttccaggaactccccatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgttcctagaactaaacaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccatatccgagggctcggctattcgaatagattatactctgatcagaggtgtacatctttacccacaagacacatctttctcacgtgcaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgcgttgcaacagaggcccgaagaccggtccttatacggccgaggtgctaccatcaaaaccatgcaccccgagcccagcctaaaaccattttaggggattttgaatagagggggcggtgtgaagccaattccacaataaaccaacaattccagagtatccaggtgatatgaatatttcccaaagtctatagttgtaaaaccacctaatgttacctaattaaaagcgaagcatctacctaaaattatactagggataccatgagtagagtgtccactagttgaggttttgtttgtctagggtgaacaaggtagtaataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaagctttaacactaaataactccacataacagcagaaacaaagcacaaaaatgggttctttacatcttaaggaaaaattagagacttgaacggtccaattccgagttcgaatggccaagatatggccatttgaagtttatatgctctttaaatggatatttgcgaatttcttcatttaaattttaattaaaaatcccatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcaagcggctgacggccgggcccacttggcagccgcgagggcgcgcaatgggcggcctcgccggcgcggcccacgggagcggcgcgcccgcgccccgatggtcaccgccggcgaccaccggcgc

SEQ ID NO: 64046 - DNA, 14305 bp, Oryza sativa
cggccgcggagttctcgggttccatagatgcgccggcgacgattacgggattaaatccgagcgaatccgagggagagagagaggggaaagcgggggaaatgggagagggaatcacggggagtgattcccctctctttaatgcgcgcggggacggcgggatgcggcgcaatccgcggcggcggcggcgctagggcacgggcgctggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagggagggagaagtgggccgagccggcccaagagggaaggggggggaaagaacttcttttaggatttttctttttttataaaccttttccactttgtttatttcttttcaattattatttgtgctctgaaaattccactaaaatttgtttaagcattttaggcttttaggaaatatacaaaaatcctccaagcctcatttgacttttatctttgcacattttaattgttgaaggctttcacatgatttttaattattcttttgcacaatttcgaggatgaattttagagtcgatttgggacgcgacaatttacctttgttatgaccttattattattgctattgttattattaccttgttcaccctagaataaacaaaaccccaactagtggacattatattcatggttccactagtatgaatttaggtagatgcttcgctgtttaataggacaacattaggtggtttttataactttagactttgggaattctcatatcttttggacactatggaattgttggtttatgttggaattggacacacacctccccctctattcaaaacccccaaaatggttttaggctgggctcgaggtgcgtggttgggctttgttagtcgtacctcgggtactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtgtatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctttaggatcgtcttttttttaaatggctttggacaaccaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggtccgctagtccgctgctgtttatttttgattgtcaggccttaagtgcctttgtaataatgtaaatatcatcgatgtaataaagatgtgtcttttatatcatgtttgtatggtgtaccccggcttttcctgggacggggattaatacactagcattcgggaaaaggcaattttcccggtcgcgacatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcgacacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgatcagatatgagaggctgcacgatgactaacagatgcagtggaagcctcctctcagggcacgttccgaccagacagagatagggacgaactgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacatgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggttaccggtaaagaaatgacgatagaacaatttattactgacaccggtctaactacggatcaattgctaggagttgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcctaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatatgtatgcatatatatgtattgaaacatatatatgcatggtttatatatatatatatatatatatatatatatatatatatatatatatatataccccatgcagccccagggccatgcaaaaaaccgggactaaagatcgatctttactcccggttatttcacccgggactaaagatagcgatctttagtcccggattggtactcccggtttggaaaccgggactaaaggggggtacaaaccgggactacaaagggtttctccaccagtgatagctatcttcacagcttgcacacaaattttgcttcatcgtgatcatcctaattgaacacaagtttcttgatctgacgcagaatacgttttatcattggtcagcaggtagctagctgacatgagttgcacacttgcatagtttacaggaccctgataatgcatgacttgctggtctgaattatatagttgttcaattcgatccccttacagacttgcaggcagctggaagcctggactcgaatcatatcaatgttcgtcaaccatcaacaaggaaaaaaaggacttcgcactagtgccatgtttcacaccttacaagctaggaattaacaatcgtcctatgatcagggaaaaaatgttacatcttcatacaattttcatcagcaatatgagtttctgttcgacgtgagacacagaatacgcgtgagtgtgagattgtgtactggccaggtgcatgcgatttaatgccctactcctttatttcatattataaatagctttgattttttttctagtcaaatttcttgaagtatgatcaagtttataggaaaatttagtaacatctacaacacgaaattagtttcattcaaactaacatttaatatatgttgataatatgtttgttttatgtcgaaaatattactaaatgtttctataaagttgaacaaatttaaagaagtgtaaataggaacaaagtcaaatcgacttataatataaaatggaagaagtagttgacatggttgcttttgtctttatacgagtcactttatatgttttacaatgtgtacagttggtccagtagacattaaaaatgataaacacatattttgtaacactagactctccatcaagcagaagcaacattaaaaaaagtgtacaacagcaataagcaactgtctgatatggatacactacacacaaggtgcacacattgtcaaacgttgtcagctgatcctgatgaccatgaggccggtcgagctacttccagcgtcgatctagacgactgcgaggtcgaggaggagctacgtacctccgtcgttgccctgccctccgatcccttcctgtcacggagagacaggaacacatagatggctacataagccagcaccatgacggccatggcgacgacgtacccggaggtgccccagtccctgctgctgcctgccgcgtacgccaccaggaggccgagcaggtcgagcacgaccaccatgtgcattggcccgaaccggtcagggtcattgagctctgggaggatcaaggtcccttgcaggaggagaacgatggccacgatggatgccgagaaggatgtggagttgctgtagaagaaggcgtggtaccggcggccgtcggtgtcccccaggatggggttccccgctgcgtgccctttgccgtcgttcgtcggccacacgctccctggcggcactaggccggcctggtacgtgacgctcgctgccaggatccccagtagcgtcagatacttgcgcatcttgtacttctctttgtactcatcagtggtctcttcatcatgattattggtgcacttctttcctgtcgaacctttagaccccgttgcctgatcatgattcttagtgacctcgtcttgcttcttggaagagaagaaggaaagacaaccaatgagtattttatggaaaaatttgatgtgtagagcggcgaaaataagcaccgcgccgaccaaggcgaagacgtagatggacgtccgcagccttcgggtggttccggcagcgtaggcacccatcaatccgaccaagcctgcagccatgcaggcatagagtgcgttgcagtagcctacggcgatgctggagaggttccgactcatcaagcaaactatggcaatgacagatgccatgaagctcgtcgcgttgcaatagaagaatgccttgtatcggagagggtaattgtccgcgagaatcgagtcaccgtagcggtggtcttcatcggtgtgctcgatccagaagcctcctggcggggtcaacccagcttggtaggtgatggtgacggctagaattgcaagaagcagcaatagtttctgcttcttctccagcttgcttttctcctccaacttaccctttttgtcatgtggaagcttgctaatcacaacgtagattgccaccaccaacacaaagatggccacagccaatgaaaagacatagatggaggtgcgcacgtctcggcagctcccagcagagtatgcgccgatcaggccaaagaggtcgagtatcacagctgcctcgagtgcacgccggccgatcagagacctactctggaccatgatgatgacgatgatggatgctacgaaggcagctgagttgcaataaaagaacaccttgtaccgcttagcatgggttgcggggagtatcaaacccccaccactatggccattgtcgtcgtctctccagactccaccgggcgggtctaggccggcctggtatgttacggttgtgatgagagtggccagcagaagtatcagtgaccgtgccctctcaacgggatctgtgctgtcttcacggtttttggaggccggattacgtctggatcctgttgctatagatggctcagtgggttgctcgccctgacacggcccaggcatgaccgggtctgggccgaggtcagtcgggctagcacagtccgacctacacgccgggcagggccgggccgttgctgtcatccagccgcaacaaccatgtgtttgtgcttgcggtttagtttttttggataaaaacttgatcacagcaaggcaagaaatgtataggaggacagcgccgatcaggcagaggacgtacacggtggtctccgtctccctgcagctgccggatgcgtaggcgcccatgagaccaagcagcgcgaaggcgatggccacgttcagcgccgatagccttctcccgttgttgcccatgctggtgctcaggagcaacatgatgacagtgagcgacgcgacgaacgcgacggtgttcaagacgaagaacgccacgaagcgccagtagtggccctcctgcaggacggggtcaccggcgcggtggtggccaccggcggcggcggcggcgccaccctcctcggcagcatgctcccatgtgccacccggagggctcaaacctgccgtgtacgtgatcgtcaccatgaagatggagagcagcatcaagaccttgcgccgctctttggggcggagcttgccatcctccacggcctccttcatgtcaagcgggttacttgagcaaccatggagatggccatcctccatgtccatggccttctccttgtcaggtgagtcgtgcactgtcttcttctcaggcgtgtcggtagaaggggcgaccagcgcatgaaccacgatgtaaacgaagatggttgccgaaagcaccgaggcgaagatggtggtgagcctgccccggcagctcccggcgatgtaggccaccatgaggcagagcagatcgaccaccatgacccctcgcaccgccatgagccggggcccctccacgcggaacgggaggaggaggatggtgagcacgagcgacgccacgaacgccgtcgcgttgaagtagtagaacaggtcgtaccggaggcggcgggtgtccggcaggatggggtcgccggtgaggtgttcgtccgtggtctccagccagacgccccccggcgggtcgagccccgcgatgtaggtcaccgtcgccaccaggatggcgagcagcaggaggtacttgcgcagctgccactcccgcgatttggggtggctcgccaccgtcgccttcccaccaccacccggctgctgcttgttgtcgtcggcgtcgggctccatttgcacggtgcaaactgtctcagctacgggagctgaagtcgcctgtattgtgtgatcctgattagtggtgtgcaaatgctgttattgcagatgatgatgatgctgtgtatatatatatatatatatatatatatatatatatatatatatatatatatatatatatatatatatatatatctgcgtttgcaagtcaagtcgcggctaagaaaataaaatgtggtggtcaggtcgcgtcgttgtttaagctgcttctcggtgctcaaccagcccttccatttcccaacctccgtgttgatagtctgacagtcacatgtgaatgcagagtgcacgccatggatgacctgacatggtgccaagtcaagctgatttaaaagtgaaggtataatagtgcacgaatatgggaatcaatgctacgatgaattggaaatccatttaagtactagcagtagttatggccagtttgtgggatattgtgtgttatgatatgctacattaatggcaaaatttgctacggagcatccaaaaaacatgtaattagctggtggacatcgcaagaacacaaatttgctattgggcaaaaaaaaaaactggtaattagctgataaacactcatggttatattttattatttcaagaggagcgaaactgatgtggagtacgattctgtccctgcgcagcttcaatcgatgaggtcggcagcaggacggtggcaggtggcaacggccggcaggcagcaggacgatggcatcgatagcagctcctccgcgtcgcctccgtccgccacctctaccttgtcctctagaggttgttccccgacaccgaacacctctgccctggcgtcaatgtcttccccaacctcgtcaagctcggcatctgctacacctgagccatcattgcggagcagatccgtgcaccgcgcatgaggtccatgtcgccgctcggcggcacgtcctcgtggctcaagctgctcgatgtgctcgtccccgccccggatcttgcttggctcccttgcactcggctgggtcggaagagctagccgcgagagcatcgcatgaggacccttgacgccgcccaagtcgcttgagctcccccgccaccgcccttttgccagtcgctgccgtcccactgccagcctcgttgaactagaggaagatctagggaagaagataagtctttcaggtgggtcccacatagcaagtttgaccaagggcaaacttgtctttaatgagtgtttctctctttaattcctctggaaataataaaataacgtcgtgggtgtctatcagctaattaccagtttttttgtgctcgatagcaaattcgcgttcttccgatgtccaccaactagttgcacgttttttatgctctgtagcaaattttgcctacattaattgttgaatgaagtaaatttgaccaatatttttatttattccacttgtgttaaaaaaagaagcatgcggacacttatataaattgggccgagcattgcatgtgttaacactatatgtcaaacaagctatactttttggtacacatctctcctttttcatattattcattgtgctttagatcgataaataaattatctgctttggtggtcttagattatataaataccaaaaaaaatgcatgtgcattgcaataagtgaagataattttcatgattgataaaagtgtaaagtgcacagacggtttttaaacttgtttagatgtgtcatctcagtttctagactctcaaaatacatgttttagtcctcgaacttgtcatgagtgtcatataagtcccaaacgggctccaatatttttaggtgaagataaagaaggtagtcaaaaatgttattttaaagagaactgagaaggtttacagtgtgttcagaactacaggtttctaacttctactcattcgtttttcacgcctatgcttctcaacctaataaatagtgtattttctaaaagaacattctatataaaaattgcttttaaaaatcacattaatctatttatttcagtttttataggtatacttaattaattatgcagtaatgagccaccctgttttatatgcgcgaaagagaagtttccaacttctcacctgaacacagcctaaagagtatttttgttttattttcatgttagggccctaagggaacataatggaagacttagatggcaaagtcatccttgaaaggttacatgttgtggcaactttgggtaattgggttgttggccttcaggtctttgtccccgtgtcctttttttttcttttttagcaaatgaccatctgtatcagtgtatttttaataatagaatagaatcttggcctttgctcagagagtttcagctaattattacaataattgttcaaaacatatcacatctcaacaattcataaagaacacaaatgatagaggtacacaccaaaccactaacaccaactgaagagataaaccacatacttattgaattatatttgcaaatctcaagccgaagttgacgaaaagttagtgttggtaaaaaaaaaaccccttctctaaaaaaaatgcaaacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtctgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgattgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccatagtctcccttcatggcgtgattcaggtaccccgattgggcgaaggtcttcgataaattctacgcaaaattcgatgacctcctatgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaagggggaaatatcaactcaaaactgaccgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgatagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctt

SEQ ID NO: 64047 - DNA, 1960 bp, Oryza sativa
aatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtactcctcttcatgcatagccagggggggaggttgtagatacacatcgtaacgggccaagtgctatggccgctgctcatctctccaaaaggattcatgccatccgtactcaaaccaaaccgtatgtttcgtgcatcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcccccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttacgatctttagtccc

SEQ ID NO: 64048 - DNA, 5386 bp, Oryza sativa
ttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatatgactatctattgagtggaccaagctcaatctttgtggtcgcttggtgaggttgagcattgaacgcaacctggctcttagaaatccctcaacggagactacttatgacttatctattatctactttaccgctattacttgttttcgcctaattcatgctaatggttgtttaagcttgtatcaaagttgctttgtaggttcctctgcatgcttgctaagttgtggttcaactcgtttttgagtcaagagcttgctctttctaagtgtaattttcgctccttgcttggaacgaagacttcagtgaattggcccaaacttctaaactagactagaagttctagaacataaactagaagctccggtctttactagtccattgtgaaaatttgataaaattttcaagtatcacctattcaaccccctcccccctcccctctaggttctaggctacatcaaataacatttaggcctgatgtcaccatcgaatgtgcttgtgcccgtatcccttgaccttgtctccttttccagccaaccctccatccccttatctccctctatgtcgctaggtcagatcctctagccatgccgcgccaccctagctcctcgaccctggctgtcaagcaagcggtgtggcccctagccgcttcttccaccggaaggactttgtcatctcgattgccgccaccctcatgcaccatatcaagctcgtgctagcttctctagagcaggaggaacatcggcaagcacacacaacgaggccttagtgagcaggagctaggaagacgatgaggaagaagaggagggatttgagtattacatgaaagtttttatttttgaatgaaagttttgtgatgtctaggatgaaagttttagatttgtatagaatttttttttattttgagatgaaaattctaaatttgaatcaaatttttttgtgaattttgagatgaagagatcttggatcttcaattcaaaggtttgtgattttgaaatagaaagttttagatatatgaaaggatgttttacaattttgagatgaatgttttgatttgtttgagttagaagtttctgatttttgagataacacgcaatttgaaagcgttgaatacatggagattcctggattggagtccaactcgttggcacagccaggggcggaggtagtatatgttaggagggtgtccaagaacccggtcaagaaaactttttagctatacctcatctattttcaccatgtatgcaccccctcaatacaaacttaggcacccgtatcagcttaaactcaatctaaagtagagtaaattaagcaagtggcaccaccctctgtttcgctctagctccgcccctgggaacagccgagagatgccatgtgaaacagaaccagagagggagcacctgcgtgtgcgatttgcatccctagcccagctgcaccaaagcttaaccttatgcaatgcagttactcttgaaagtataggcatctctaaagcccccctctggtattgtaaactactagtgatggcaatcttcctcgcgaggccgggggtgggtgacaattcagccccaaagctcaacttgatgaaatactggggtatataagcaaaaatctaactagctaacccttacttatcctctcccaagaccccccacagccccatgcagccacacacaggtggaggtggcacactctctccggatcttgtctctctctgactctctcgccggcttcgttctctttctgcctatcaccggtcgcccactcccctccagcctcccgtcctctccactctcccctctccctccggcggcacgcaaggcgatgcacgggccggcgcacaggatgatggaatgatggatcatggaaatatttatgtaattgtgttcttactgaattttttaggatgctattcaaatattcatgccattttttatgatgtgtcaattatataaaatatttgtttttgctgaattgatgattgtcttgtattttttgtactgattgaatggagtggcaactcaatgctgggtcccggtcgagttgcgaagccctagaggggtcatggacgagacctgattcggccctgcatctccactcggggccagggcaatggagaagttgggggttggggacggggccgttccagcccaacccgccctgacccatcctgttgccatccctaagctacatgcactggtggagagatcgtttttagtcccggttcgtaaccccctatagtcccggtttttaaaccgggactacgaatccgggactaaagatccggttcaaatatctttagtcccggttagtgttagatgggagcggcagtcccggttagttttttttcatttattgctaattactacttaatctctaatttattttctcccaaattaggtgggatgcatatcctcaaatcaaagtaacatcccaaatacacaaatcaatcatatacaccatagattatacatcccaaatacacaaatcaattatatacaccacggattatacatcccaaatcaaagaaacatcccaaatacacaaatcatatacatcacaaattcttcatctcaatctatacatggatcacaaattcttataaaaagaaaaaagaaacaaagcaaagccgccggctggctcagccgctgccgcctcccctcctccccggccgccgtcgcgcaccgtgcggccctccgcgccgccgcgccgccctccggcgtccggcccgccctcctctggctgcataaactcatacccatcccacatgtagttgttgccgtgatctactcgcatgcagatttttctccctatccttcggcgcaactgcatggtggtgcagttaatctcagcgtgcataactgaaagagaagagaagagataaggaggactgctgcgcagactgaaagagaagagaagaggaagagataaggattagagatgaaggggtagaggagcttgtgtggacgggaatagaggataagtaatagggattatatagtgcgttttgatcaaccgggactaaagatcatcgataatacaaacggggattaaagatccgatctttactcccggttggagttaccaaccggtactaaagatccaggagggccctaacaacccctaatcagtatgtaaaccaggactaaagatgttatcaaccgggactaaagatcacgtagtcccgttctgcttataaaccgggactaaaaaccattattagtcctgtttttattgcaaccgggactattgtgatttttggttgaccggacaaagatggttcctcccctagtgatgcaactggccagtacacaattactttcatgcatatatataatctgtctcaagacaaacataaattcatactgatttagaaaattgcattcgtttgccagatcacagtacgcttttttttaattcctaataaggagtgaaatcacactacgctttttttaattcctaatgagtgaaacatggccacattttcagttgacctgtggtagcgtgaagcctattttttattgattgccaacgaacaaggctaaaccgctaaacatgctcagctagtctagcagaggaactgaacgacataataactgagaccagcaagtcatgagttatcccggtcctgtaaactgtacaagtgtccaactcaggccaactacttggtggtgaccaataaaacatatctccaccagattaagaaactttgttcagttaggatgattataatgaagcaaaatttatattttagttatatctatctgacagcagtgaaccatatgaatcttgaggttgagttgcaataatcttcatatgagcacagagaaaatgaagcctaagcaaattgtcatcactgatacacaggataaagacatgacacgagcacataatttggaagcatcaccagagactagaaccttctgtcaaagtggctaccacagaaacggcctctgaaaatgaaattattcatttcacaaacataatttttttttggttactgcgtgaatccagtgcacatggctgggtccccatgacaatgatatgctatgcattttacgtcgttttaagagaatcaactcgtgtaaaacaattgaggtagctgctgtcccaagtgacaaaaatgcagtgctagaagataactacaataacactattgaccatttctggggagattctgatagctataaccagtgttcacaatcgaactggcctctaaaaccgctcctgagtggtacttcctgtttttgagaaaaccgttgattacctataaaatttgaccaaattttgttaaaaactgaaaattcagtctgaactattttgaattcggttggtttacagaaccggttatgatcttcagccagctcaaaaccaccggtttccacgaaaatcgagcggttttcaaaaattgtctccaggactgaacttaacgagaagctaggtaacaactacttatccagaactgttatttagtgaaacaaaagataagctaactcatattgcttggagcaacgtgtccgagtaatttctctgcaaagaaacaactctttcttcactctctcttctacaccttactatgtaggagtaatacttagaaagggctaatttattgccttttccatgccagctaggcagctaccgtgggatatgcatgctgatagctgatatagacgagtaatactatttcattgtactccatatgaacaccaagctttttagtactatacccccccccccccccctcatggtatcctatttgattttgcaaatattgccgaataagaaaaggacacttttattttccaaggaaaagtgtacagagatatgcctctattatcaaggggaaaaggagctatccacacgacagttttaccaaccacatctagtgaatatatggtaagcggattccggcattgtcaaagaccaaaaagagtcatttgtaattataaaccaaaaataaagacatgtcccatcatgaactcaactgtgctgacctggctcactaataatgcaacattatagtacttgcagtttgcgcaactaagacattccgtttccatttctctaacatgaacagttgcaggattctatatattgtaacattacataacaaacaggatttaatatctgccatgatgcatgaatgcgtcaattccatttgcagggtctagcaatgtagctcctcacatcttattttattacctaaagattgcattatcaactttcatagtcaa

SEQ ID NO: 64049 - DNA, 982 bp, Oryza sativa
tatggtaagcctcaaatcattgcacgtttctttcagacgacaatgctagtcaatttgaaacagtgggatgtgagaaccccacaaggaataaagaagatgagacagatcaatataaaaagacgacttgggcaaagtcttccagtctacatcttcattgataatgctaagcccatccatggcatcactattaggcaagagaagcacagctatatacatcattatgcatagcaaagcaccttattagcattgatccattcacaacttggagtacctcctttctgcttctatctctcctgcaaatggagaatagcgagcaagagaggacggactcaccattggagtatgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtgctggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtaatctactaatcctcctaattcagcgcactaaatatggaccatgtcaatattcagaggggaaattgaccaggtgatgagaagaaaaaacggcaccgcaaggtactgatgcttctcgcaacatttgtggcaagcatcaatacatggctgggctgagagcaccgggtggctactgggataacaacca

SEQ ID NO: 64050 - DNA, 889 bp, Oryza sativa
tcaaaaaagaaacatgccacacgcaaatacttgatgctgctaggagtcttggctgcaagtgttacttaccaggccggtctcaacccacccggcggtgtgtggcagggaaatagtaatgatcatgcagcaggtaacccagttatgcatgacaaaaaaagataccgttatctcatcttcttttacagcaactctacttcatttgtggcatccattgttgttatcatcctgttgctaccagagaaactgctgggggaggcatggtcacttaatgtgatgaacataacgattgtgttggacttacttggcctcctactagcctacatggctggctcaagaatgaggttgcagtcttctggatatttcgtcgtgtttgttataggtgcactaggctttgctgcaattcacaagatttggtcatatttgcaaaggaaaagaaatgatcagcacagactgttagaccaacccagatagtcaagttagggagtttagatgttctagtgtgctttgtaattctatccatccatgctttctttgtttagtcggatgcattatgttccaatatatcattagctggttaaagtcagactcaatcacgctactacttcattcttatctccccattaacagcccataaatcaaacaagagctacaaatgttaaaagttaaatcgctatacatattaacttaagtgctttctaaaatttttaggactttaattaactctgtattttttgaaagcccttacccattttcagaatccaaaacagatttttcttttccaaattttcaaaagtatgtgacagattaagtcttgtacttaatatatgctagtatctattttggaaaatacttgggtgccttaggatataagctactagtccatatgtct

SEQ ID NO: 64051 - DNA, 34861 bp, Oryza sativa
ttctctttccatctttccccctcttctctctccaatctctgcccgtcctattctttattctctttccatctttcacccttccctctccctaaattgtcgcacatgcgatttccatcctatcttaacgcgattttcttcccagcatgcataattccctacagcgcatgcgcccttgaccccccccccccccccaccttgcccgtgtctacctgatttcacaatatattagaatccaagacgtgtagaagggtaggcggtggggacgctctgatccctgatggcgctcagacgcctaggcgatgcttttaaaaccattggctgtgatatttttgaactgcatatttttgctattacatggaaaacatacattgatagtctcatacacaccattaagcatgcacacaacactcacaaacccataagtgcaccccctgatacatgctcaaagagaaggagccagcgacaaatccctgacttcactaaattcccattgaaagtacaccatgtgtgtgtaatatatgtgggcactaatatttaaatcctagtgggtggaatcatgcactcgactccaccaccacacatttggtgtttccccatttttgaactgcaattgatatcttttcaatcttaaaagttaacatattttctggaagggtttttctccgtaacatttctttagaaaagtttgtcagtaccaaaataaaagtgattttaatggctaggatcttatagaggagtgaacatatgtcacttgcttataaagtatgaaaaactacgaacaattgttgtttatttatctctctaataaaatttctgtcttcctgggcccaaacctagctcagcccagtcttctgctcgtcccctcagcccagtgcggtctccacttcagtccaagcatggaatcagcaatgaagaccaaagatatgtgattagggatgagcaagggtcaggcgacccattttagttcatctttatgaacataactaagtgtatatatacaaaattgaacaccacatggaccagatgtgaagtgggggccatagccaggctcaaccctacacctcaaaacatatttctgtatagtgcaaaatttcctgcatccaggactcagctatcatgattcatgatcttgcatacatctagacaggccatagatcagtcctaaagttgtgattgtatacaatataatgggtacaaaaagagctgccaaatataattcttgctgattttgcaaagaaatgaagaggagagaagtgcatctcattatatcctaaagagtaaaaactatcaacttctgctggtcatttaaaaataatccacttctgctggcattcactatcaatgtactttgaacatcgatccagaagcaattgaatagtctgaatgagggaacaacctacaactacatgatatattatagtgtaaattcacaaatggccagggcctagtggaaatcatgaagaactttggcccggcatccatgtggttgaacctcatgaagattttgctatttcatttgcaaatagtcggatgtatgtatcagttaagacgggacgaaacaaataactggtactggaatgcaatgcacatggatcagaaataaagaacacaaaggtcatgtacaagaaacagataagtggaggctaaacagttgttttttaactgatttataagaaacatgtgcgactatgtcccaagataatccataagaaacattgttctcttacaggctactgaaaattagtcagggttgcaagcaacagataagaaactgtaacagtagtagtaagtttgtgacattcgttgggctatttcggcacaatctatcgaatcgactatataatttgcctcctctgtgaggaaaatgcagggggttagtgcatacgaatgtgtgaagcggtacaccactgatgaacaatgcaattacaaacagccgaggacagagcaggaggaaggagatgaaaaggaggagcgattaattagggcgagtagctcacctgtgacgactctcgcgtagccagcagaacgtgtacggtggcggctgccccttcccccatcggtgcgcgaggcgaggggatgaatcgaagaggccaagggaggagtttaaccatcatgggttcatggccttgtatgctcccgccgccgccggcacttgtggtggtggtggtggcggcgggtggtagccgatcggaatgccggcgcaggtgggcggcgccgcggtaggtcaaaggggatcgggggagggctcgcgctgcgggctgcggcaagctggagggggagcgagatgctgggagtgggaggtcgattcgcggggcggatgatcagggactgacacatcggcagttcgagccgtctgcccgtccagggatacgatgaatttgatgacgatggatcgcacgagaattattttttcgagtaaatttcaaaataaaaaaaagcagatacattaaattatacaaaactacatatttaactcgttgtatcacaaaacaacatatttaacatcaaatttatcataaaactaagtatttaagataaagtttcacaacatgtttagtaactaaattatcacaaaactatttttttagtggaattgctacctgtctgtcgacagaaaattgagggttgcatcgttcgttttttggaccgtgcgatttgcttgcgattcgtgctcgctaaccgggtcctcaggttacaacccattatgactagtcaataggatgagctcgatgggctttttaccgttcccctcctagagaaattctccctccgtcgacgcgaaatgagaggcgatgccattgacgattctgaggcgatttgttcttcggttccctactcgatcttagtggtaatctatggcgaggttcttattttggaagcttggaatctctgtgcccgttttggtgagttttttgttggctgatttgctcttttttatgcattttgagaagtagttttatgcgatttgacaggaatttgagttctattatctgaaatcctcgtcgttaaatggatttgtgagccactaatttgactggatttgaggttcttcttcgattccgagacgttgagctccctcgttatctaggtattctctgtggacttgatttgttctgatagctgatttgtgagctgattcggtttatggtgcttcttgtgactcgttagtgcttgttcccaacttgatctgttcattctatcgagctctgccatggattgtggaaatggagtgtggctgtgctgattgacacggtgtttttcaggcgaaaggcttgcgaggaatgtggtgaccatggcggtttgggaggcgtcgaccaagccgctggctgccaataatggagacgaccgagttcatcaacgccttgaaacaggaggtacataaacattgctttcctctcagctgaaatacagtattagtcaaggtgtactaacctgagtattatgtctgaccaaccacttgaaccatttggtatttgcatgcagtgggacagaattgaggacaagtacacggtgatgacactcgcagccactgcgtcgctcaggatgtggagccggcggagttgcatcggtcggtactgaaactggagaatcacatttgcttaattttcagggagtttttgattatgtaggtacagtcgttaacttgggtgtttggttaattaccttgcaggcaattggcatgcctcatgttattcctggtctaatgaaggctgttggcattgtgtacagtgaaggtaagattatgcacatcagaagttcaggaaaaaaaaatctccccatttataagtaatataaattctttgacatatagatatactttgtgcagttttctaggtacatgcctaaatctgatatactctgaattttttgacatttttgctattgactttggctgtaatataaattctctgaaatccaaattttgatataagttctgttctgaatacagtacatatgcagtacatattctttgaaatgcacctgcacatatgttctcctagttgttcaaaaatggttttaaatctgtactgctacttattgtaagacagattacttgatagattatatagattctatattgttaacagtttctatagattctataaactgaatcaaacatatactaaatcttgatgtttctgtaaagtctcaagtctacaagatgttagttacatatttttagtattgaaattacagtgttttttttatgtaattcttgtacaaaatgactgtaatttaacaacaaaaatttagaatgctgctgaatattctcaatatagtgatttgaatcgtttatggcaacttgtagcaatttttagtttatttttaggttgtaatgcattatgttattcggattttgttgtgctatgaatttctgaatttcctgctaatcagtagatatgcaatgatttgtctgttttctgaatattctcagtgagttatggtctgaatttagaattctttgaagagcaaaaaaataatctgaagttgtatttcattgctgcctaaggatgctagattgcaatctaagagtttcctgacaattgtactttaaatagtcaaaatgctagcttaagacaattgtcatctttttttgtaaccatctatgtctctgacattgatcagcaagtgagtaatgtaaagagagtggtgtatttgaatttttttttctgtctgatcatccttttgtttcctctctaggtgactgaacagaagcttgccgtagtgtttctaattgtggacaagtaacttatacttgttcatctctgaaatctgaaattactctctgtcctggagactgtactggaagaagctatactgctactaaagttcagattggacatataagttcagaaaaaaaatcagaattatatcttgaattcatataagttcaaaaaattcagaattatgtcttgaattcatacatctgagtacagaaattgataccatttaagtttctcagatctgttcaaatatgcaatacaaaattgtcagatgttttctgtgaagttctgtgatgtttctgtaaagtttttaagtctagaagttttttttttgttatgaatttaacatgctgattggtttttcgattggttttcctctttctccttgtatttgattcttctcctccatctccatctcctccttctcttctctctttgatagatctgtttgtgtgtaaaaatcccgaagtgttttattcttgcaaaccaagttgctttattgctttactgatcagatcacgtgacactgtaaagattcttcttagtagtcaagttttctcaatagggtataaggtacgcgattctgttaatctgggcctaatattagatttgagtaacggtttgaatttgggctattatttggatttgggtcctggtagcatcgaattgatttgggcccattagcatcaaatgtatttgggctcaaataaatgggtcatgaatagcctttcagatttaggctagtatgttttttttttttaattttttgttctaaaaaaactgaggctgtttgattcagatcttgtggctagaaaattcgacagattgcaagttaaaaaatcggtcgactgagttgtattgtaattctcctcaagtaatgatagacctatttcaaacatatgaatttgcaattttttcctcaactaactaatggaggcatgaaagttactaatcagatttaaacaatatatcaattacctgattgtgatgttgttgcgttcatgtccatgttaatttcttcttctgataaaagctttgtgatatacctgcatatatagacacaaaattacagtgtttagaatttaaaattacagtgtctgtaacatgtaattatgaaataaattgactgtaatttcacataagtgactcatacctgaacttggtacatgttttgtcactcttgaattgctatcttcattattcccatctttgaatccttcaaatttagacattttttttctcacagtgtaaattaagtagttaaaatactttatataattctatcttctaattttgctctagattctttccagattttcttgatcacaagttgtcaaaatttgtataactaccattagcaaaatgtaaatgtacatgcaaattggatgagtgaaagtacaacagttacatacctgtgctttgaagttgcttatcttccactatattttgatagtttgatgaatttttcttcttactactgatacaatttttctctttgtcctctgtgatgattgcaaataaaatgtttttttttattttcatattaattttcctgtttggttcttactgtgatagaatcttagtttgaaataatgcactgctatatcaatcaaacatacctggatttattaaccacttttataaaaaaaatcactataatttaaaaatagtgattcatacctgtacttgatatctcatttgtcattgttaagctgctattatcatcattgtcaccttgtatacttacaaatgaagggaaatttaagttgaacattttgtttccaggtaatgacaaattagatttgaaactaagctcatcacagttgtgacatttacatattttttatttagaaattacagagttttgtttgtgtaattcctacataatttcactgtaattagtttgaatagttattaaatacaacatactgatagatttttctaaatatctgtttgattctaaattaagaactacttaaaaattaatattagttctttcattatggtattatattttttttacttttgatttatgacatcctaattcataggaagataaaatcatatggaattgaaattcaaaaattttataacggtttgtctcttatcatgcacttttctctttttctgtactttttatgcaataattgtacaaattgaacaattagaaacctctacatttgtttccagattggagatgctcctattccacattctttacaatatttgatgcttttcctttgttagttgtgatgcctggaaataattgtagaaaatgaacaacatataaaatcatacaaaatatcttttgactatgttgaaattacataaacgttacattgaaattactgtgtttattaaatgtaattcctgtaccaaatgattgtaattacatatatagttgcagaaaaagaagtctatatgaaatcaaacaaaattacatacaaatgctctaaatttaagttttggagccagttacatgaatttattactgaaattatagtgttttttctatgtaattctcatacgaattcattgtaatttgacttataagttagaaaacagatccaattaaactgttttttctttataagtaatcaactgtattgttttgggtcaaacttgctttctacaatttgcttttagatgaacttatagtacgatttgattttgatccgcctgctagtgaactaatgtaagcaaagtttgtttctcttgactcatttaatgaaatctgcttgaaagttagtttatgctacaagtgaactttttgaaaattaattttgtacagaattggagaaagaacaaataacttgtatcattgtttttctctcagaactttaaattgtaaagaattaagtaatgttcatttgtgctatatataaacacttttttgattaaaagttataccctgtttatttttttttccaaacagttaatgtatgttttgatttgtgtatctttgcagaccattttgcaatggaatacaaaattacagttcaaatcaatccaactacgcaaaataatcaatttttgaatctgaaaatattcaaatttgaaactgtatagtgttagtgaaataatcaaatcgttgaatatatattagtgaaataatcaaatcgttgaatatctattttatttctgtttactaaaatcagtttattttggaagataagttaaagtttagacttaatttgattataagatttaaaattctgcctattctccagactttaaatttaacattaatgttgtaatgttaaatgctctagatttacactgatatatcacaataggtacagcacaaatcattcttctaaatgttcagattaaataataagtcaaacagttcagattaaattattattcctggatagaattgttcctgtatctgtttttctctgtgtgaagtcctgaagtgatttgctttttcttgaagtgatgatcagatcacgtgagtttccaaagattcttcttggctgtcaagttttctcaatttggtaatgagtcacgtgaactgtgcaagacaaattgggctttatttgggatttcaattctgattctgaagatcaaatttgtttgagcagtgaatcttaaaaatttgttattgggcttaaattttattatatgatgggcctttaatttgattctccttttgttgttatacagtgggctgaaaacatcagttttgggctttttttgggccacgaactaatttgggtcctgaaagatgggcttgcgaatacactgttcctagcctgtttgtagtttttcaattatctgtataactagcaaaatgcccgtgcttcgctacagtgtattaaaactaaaaatatttgttttaaccgaagttattttcacactgctttaatacttttgctcgctagaaaaagtttcaaatgacagagagaaatatagttccgaacaaaagggagataaaaaaagacaaagccggtttgatttccacctttagacggtgcaagtcaacatggactctgaagatatgggtagatctacggagtggctcggcagcacggtcgaccagcgaacccactcagaccaatcgacgaccgatcgacgaccgtagcacggtaggtagcagccgcatctggctgtccgcttcccttccgcgacaccggtgaccatgactctatgctattattatttcaatatttcttatttttaattatagccttcatccgtcctgtgacgaacggaaagcccatccctcctggccatcggcgaaaaccatagcctctcgcccgagttggggcgaacgacaaaaagcagtggtgccggcgtatgccccctggctggtgcgcgcactcgcccgagggtgagtgcgccgccgtcgagcggccttgcctcggcgcccctccccatcatctccccctcgtcttccgcgcagcgtcgacgacggctagtggcggtggttgattacccgcgctcgtcggcgacgaccaacggcggcagttggctacggtgaatatggcagcggtggcggcgggttggcggcggccgtgggcggatccgagcgtggtggcagcggctctctccaccccctctagcctccctcctacggcagatccgcgggtggcggccgcgggcggatctagcggcggtggctccctccgcccccgctcgccttcctcccacggcagatccggcggcgttggcggcgtcggcagcgttcgcgagcggataaggagtggcggtggtggcgttggcggcgactgtggatggatccggcggcgggcgcgcgttggcaacgacgggcggtggcggagggcttcccacacggcgtcggcgacgaccggccgtggcggaaaacttcccgtgcggcgtcggcgacggccggcaatgaggtatttcgttcccttttttttcaatttttggttaaaatttttggggcttttcttcgggaatccgagaccccctttttttgtacggacgaaaaatcacccgatggatgaaacggactgtgaagaaagaaaaattacaaatattttaattagtgaagatatagaaaaaattcccatgcgttgtactgggtgaagactatcttaatcttattattattatatggtttatctaaagtgaaattaattgtaggaatttgcttggatattgtttttagtttttacacgatcatgagctacaattaggagtccgatcgtctcaagttagtatgcaaattgaagatgtttttttacaaatatagaagaagctccttctatatttctaaaagcaaacaaatttaaaacctactcaaatacaaatttgtaattcaaaaagcaaatgaacttaaaagccaacttaaacacgtatgatgtatcacagtactgataaaaacatcttcaatttaaattgaaatagtagagatagagcagtatttaaatgatattgaaaacattcatggctagtaaaacaagtatactaattaaaccatcgttgtctaaaaaaaaattaaaccatcaatgctcaccatcagccagctatttgccctccacgcgtcgttgagtctcgggacacgtcccagtcatccatggcgacaacggacggacccacacttctcgccacttcccagtcggacctatccgcccaggcgccctggtatcggtcttatcctcttttcctcgctttctccgtcatccctcgttttctcgcgccgctgcttgcctccgctgagctcatctcgctgccctcctcacccatcgcccctggccacgccttcactgccgacttcgccgccttggctacgctcgcggtcgcgctcgcctggagggccgccgcgccgtggcgggatggggtcgtcgcgcagactccaccgcaccaggtcgccgcgctacttatctccaccgcaccgtcggccatggagataaaggctgctgccaccggcgataaggcggtagaggagcaccttgtgattttttttttgtcatctccatctaggtagaggagcgggtgaggtgaagcgatgatttctttgattgggatgttttgattgaggattacttaagtacacatgtgcctttcttgggtaagggaaggatgtgggtggttgatttggagggagtttcttagatcggtttgggattgggggagagtcgctgctggatttgggtttcttgctggtttctcatgattcttcttcccccacagccacgagatagctagaagaaaatggtaggccaatgcagtctttccttctcgaatgcctcggcagcgagaggagctgtccttgaaaatttgtggttgttttacggggatctttgcctctttgtgctttcctgattcgctagctttgatgctggttcttgccttgtgatgtggtgtatccgatttggttcatttgttgcattgaaaacctcctggtctgggctggcagacgctcaggatttctcggaggcgggaggcccagcaccgcgccatgcgtttttccaccgcgggggcaaccgagacggattacacgaatacacaacacggaagtcacacgcgtagatttttatcggataacaggagacggacgatttttttagcggaagccttgcgtattttttaattagatatatatagatttatatgcttcaagtccttggcggttggatctagatcggagggacaaaaaatttgacagattgagagggttgttttctgtcgaatgagcagtagacagtccattatcacaaaactatagatttagaactaatttagtcataaaataataatgcttatagatccaacataataataatggttatagggatttaaagttgtagttttgtgataactccaattttaaatatgtagttttgtgatatttaactttaaatctgtagttttgtgataaatatgatgctaaatctgtaattttgtgatataacgccttaaatttgtagttttgcaatagtttaatcaaaataccaaaagttttgtgaaatttactcttatgcgtttcttgccaattaattactccacatgtttgccaccattaaaacacataatagcatatttgcattaagaaaaaagaagctagaatacatgttatttagcttctcctaaacctccaactcttttctttcaaacagtctagttcccacctaaatcttaggaatatgtggttgtagaataaaatgaattagaaaaaaaatactgaagctaactacgtcacatcatctataatttagtacatattaaaactcgacatgtaaccaatgctaaaatttatcatttccataatatttcaatctatatctatctatcatttctttctttaacatttaatacatatccatccatcatttctacaacatttagcatatatttatcatgtatttggcagcaaagcaggagatgtaagtgatttgtgattcaaagacataacttttatataccagcttattcactatatatcatctctgtatccatttcccacctattaacttttgtactacattattacccacccactaactatttattagtttatttttcacctactaacttttgtgttagtttatttcaccaactatcgtattttgtattacgatttgttttatttttactaggaaaggaaaaggcataatttcctatatttgtggactgaggtaatatgccattctatttgcaagtttttagtttttggcatccaattcacacgtctgtcgcaaaatatggcaaaagaggacgaatttctcccctctctctttatttcttcttttacatttttctcacaaatgtgtggacgggttttacacagcagcacgttacatacgtagatcgatgaactgatttttttttataagacaaactgcgctagacagtacaacatttcatatttgatatattttcataaaaaaaaagattacaagattaaaacattgggtaactatatataatgacgaaaaaaaataaagacacgccatcacatgctaacgactcctatcacagacacgagaaaattctagtaacaaattgaccgccgctatgtaatttcctctaaataaattttatgattttgctttgttcaagagcaatcaaatttgttttatgtgttctatacattgttatttcaatcactattacaaatcgatttttcatggcaccaccttatttgctttttctgtggcgtttatacgtggaaaccgtcagcaaaaatattatgaggggtggggggctatgaacgaaaatatgtgcaacattctgaacacataccgagggtattagaaaaccggttgcttagcagaaagcactcgcagttgtaggcattgacgacggtgtgcagcacgtgagcgaagaggaagacgagccgttgtggttgaacatggagcaatcgcgcgaagcgcttccaaaaactttattaccaccttctcccggtacagggcatcgaaggtgaaggttacgaaaacctgttttcccgatcgttggtacatcgacaagcgggatggagtagactacgagcgacggtgcagtacagaggaagaggcaaagccctagattgatttcacgtgtattgcgtggaggcgacgactcgacttatatagagatatcaggacacttgatcaggacgcctgcacgatctccactctgcgtaaccgaaacgaataagtcgcatgcaacttatccggactccacgccatttcacgtactggaatattcaaagtgtttcaaaaaacaaatctaaatttcccacaacaaaacaaaaccgtaaaaggagaatgcatctacgcaagggtgatgacaccgcagatgaaccaattttgacaaaccattcaacgcgtacgtcgtgcacgcatgcacacgcaccgccatgctattgccatgccaggcgaggggagcgagcatgttccccctcttttctccacctcatatgtctcaagtggctaggagagcatactcccttataaggagatctctctctcctaaaataggtaagatgaacagggccggccctgactttttggtggctcagtgtggaaaaaaaaatgaaggctcccattcaccataaaaatacaagataatatttaaaaactcattgtcattaacgaatttcacactaacaagtttaaaataccaaaaagaaatatctctagatcatttaaaacaatttcttctaacagttcagatgcaaaatcagtgatgatagtgtcaataacaatctcatctaacagcatcttctcaatgcacaaagtagtctatcaggcttggtactatagtatacatattttggaggcccctaatttttggaggcccagtgcggtcgcactgcccgcactgccccagggccggccctggatgaactaaactccctatgcatgctatccccatgaggtgggcttttgtgattttctaaagaattaatctttgaataagctaagaccatctattaattccgactagagttcacccataatcggaaagctgaagttaagacacggggattttaccaacatgagttttgctgtcattctcgaaggtcaaattaagaatttccttttaaaaaatttcaaattaagaaacattaaacaaaaaaataaatgggtaaagcttttatatatgcattcctaacgatttaaaaaccaatgctagaaaataaataatagtggaaaaatctcaaactcagttccaaatttaagtttcaaaattcaaattgtgggcgtgactgctaagccaagaagcaaacggtgaaatatgctaaatgaagacaagataattcacagttaaatggtttgtgttaataagaactgtcaattgtatgacttgcaaaactagaatatccattagccgttcctcgccatagaagctttcgacctgcaaaactagagtaagcaagagagaaacgtgctaacagtttaaagaaaatcttcacttgggagatggatatctaatagactgcagaaagtcagtcttagcagaagaatacaaaaaactcccatgtctttctggtcaaagaaagtatagccatgtccagatcatttccttcaaaaaaaatcaactacacatttaaaaatgacgtacgaggattggaagaaagtctgcgcatggtcagtctccgttaagctgataccccacaactctacataatgcatgttatggtgaaggacctgattggcattgcgttgttgacgccttgaggcacctcctttcagtcactgctcctcagctagcaaacaaatggtaaaacagtcgttagagtaatccaaagatgaagacaaaccagtgtagtattgcttgtggaagtacttctacctcttgctgatggccattatggtggccatggcgacatatgccgcagggtttaacctgcatgagatatgatgactagatccataaaagtctttacagtgttggaacctcgacagttacaatctgtaagtttgggcagtcaaaatgtataagtaaacgcatcccatctgaaaagaaaggacagctacagaaagcagctagacacaccctggagtgtataccaaactttacatacatgtatatctcacgttcaccattagttggaaagctgaatttaagactatgggcatttcaccaaacaagagttttgctggcattttagaagttcaaattaagaaacacttcaattcgtctcctgcatatcttacacattagcatatatgctgaaatagagcactggaatgaagacaagatagttcacaattatggcctctgttaatgagaattgtggcttgcctcgcaattaaaaagaacatccagtagctgttgctagccaaagagactgtcaagtttcaacctgaaagtccctcaaaaaaaagtttcaatcagcaaaattagactaagcaagagaaacgtggaaacagtttaatcaaatcttgacatgggattgggatatatatgaactccataaagtcagtctttcagaagaaaacaaacactcgtcttttgggtcaataattacatagatgtccagatcacttggccatataaacaattcaagccgctcatagacagatttatgggaagctcaaacaaagaggaaacaaggtgagatcaaatcaacgtcaatgaatcaactaaactttaaaacgacgaggacgtctgcccaaggccagtctccatgaagctggtacaacacaactctatataatgtatgcatgttgaagcaccttcttggcattgagtcattgacaccttgaggcacctcctttctatcactgctccccagctagcaaatggcgaatggacactctacagaggatcaagagaaagtggaagaaaaaccactggagttactcttgcggaagtacctcttactgctggctattatggcagccacagtgacatatgccacaggtttcaatccacccgggggtgtctggcaggataccgaggccgggcacctcgccggtgactccattatccgggatacctactacccccggtaccttgttttcttctactgcaatgcggctgcgttcgttttgtccattatagtcatcatcctcatcttgagccttgcaatcgcacaagagaagaaaaacttttggatccccatgcttccactgcgggtggccatggtgctggatctgcttggccttgtgggggcctatgcagctgggaccagccgggccgtgctaaaacccaggaatgcttgggtgttggccgtcatttttgtctatatggtgatacaacttgtgctgacttcattgagcagctgcacaggtgatgctcttaactcttgcttgacagaaaccataaactgcctaatatggcagaggctaaatatgtaacccgtttccatttccttttaaagaaaagaaaccatagactgttcctaacataaccaggataatcacaaccaggtgatggcaaaaaggaggaagccaaggagcaactgcaaacagctgatggcaaagaggagaaaatcaataagctctcccaatcaggtcataagaaagaggaggaaaaagagcggcgccgcaagctcctactacttctcgctacatttgtgatgagcgtcacttacctggctgggttgagtgcacctggtggctactgggacagcagcaaggagggacacaatgcaggcgacctggtcatgcgagagcaccatgctatccgcctgaaggcattctttgtctttaatgctgctgcatttgtcatgtccctgctcatcattatgctgctcctagacaagcaactagtcatcccactactccaggaccaggatcaaagcatgacctcccgagtaaggacccgctttctcaaagcgtacatcattattgctcttgtcggtcttgtgggggcctacgccaccggcagcagcaggaatagtgacactaccatctatgttggctgtctggttttcgctgttcttgcatgcattctttttctcaaggtgattatatcccctcacccacaagggtcagcatcagattcaaatggaaggtatggatgcatgaacatgtttctgcttccaaatattattaatatctgtatttccatcttaaatttgcatgctaatgaatcgctaggccaagcaatggagtaaagaagaacgcaagcaatggtggagtacagaccaatacaagcaatgcagatattctggagaaggctcaatctcttgttgtcctgctttccactcttgtaacaaccgtcacataccaagcaggactgatcccaccaggtggtgtttggcaggagaattggaaggagcatgaggctggcaatccaatactcttatctattcaaccagaacgttacaaggtattcttttactgcaactcaatagcctttgcagtatccttggtcatcatcatcttggtccagtacaagcctatcctcaagcaccacatactagagcttgccatgataatggatctgtttggcctcattggtgcatactctgctgggagctgccgagatgtaaccacatccatttatgtcattgccttagctggagttgttctagtctatgtggttattcatgttatattcatcacacttgatgaggacatgggaaagaaagatggggacaaggacaagaaggatgagggaaagaggcgcaagaggttgctcctttttgctgttttgtgtacgacccttacttatcaagctgggttgaccccgccaggcgggttttggctgaaggacgatgagtttgggcaccatgcaggtgagcctgtcctatcttacaactatccacgccattataaggcattcttgtactgcaactcaatgagcttcatgtcatcgattgccgtcattatactcctcgtgaacccgaatctgtataagccagccatacgaagctatgctctctctgtttgcaccgcagtaggcatgtttgctctcatgtgtgcctacgctgcaggaagcactcagcacctgaaaacatccatctatatctttgggttggtggctttggtcctcttcattatgattgtagtcctaatatgttttgtcaaaaaggaaatgagccagctaactcacaagatgaggaagaaagagtcgtacagaagtcccctccagcacaagatgaggatgtcatagaacaagaaactcaaacattgaagccgagcgagacaatgtctgccgatgaaataaaagaagacgacagaacaacgaagtccgcggacatagaaaatgcgggtgaagccaaaaataatacatccaacgagactaatgagaaagaaaaacaggaaagagcagccacagagtctaacgagaaagaggatgaatcaaaaaaacatgccaaacgtaaatactttatgctgctaggagtcttggctgcaagtgtgacttaccaggctggcctcaacccacctgggggtgtgtggcaaggtaacagcaatgggcgtgcagcaggtaacccggttatgcatgacaacaaaaggtaccgttacctcatcttcttctacagcaactctgcttcctttgtggcatccgttgttgttatcatcctgttgctaaaggagaaactgctaagggaggactggttgtttaaggtgatgaacataacgattgtgttgaacttgctcggcctcctacttgcctacatggcgggttccagaatgaggttggagtcttctggatatttcatcgcattagttatagctgcactaggcattgctgcaatccacaagatttggtcacgcaatagagaatctaagtaaaaaggaaaaggaaaaggtcaacttcgcttgttgtttacaaagaagaaaagtcaagttagggagtttagatgttctatgtgtgttttgtaacactatccatccatgagttctttgtttactgggatgcattctttacattccaatgcattagctggctaaagcaagatgcaatcatgctactagtccattcatatctcctctggaacagcccaaaagttaaaccagtgttacaaatattgaggttaagtcctgtataattattaaattggtccttcataaagtgtttttagggcttcaattaactctgtattgtttgaaagcccttgcccaattttcagagtccaaaacaaatattcaaacgtatggaaacattttatgtgggtttcaaataatccagtctgcttttgtgatattttttggacttcactccttcctttttcttttgtgattcctcggaagttgcacatgcaacacagtggctggaatttttccttgcaaaaaataaaaagcaggggctggaattgctttggttggacaaaaaagactttgaggatgaaatggttaggtcttatgtgccattctgtgagcctcttccaccaaatataattctctattcaaaactatcaccattaatttatgcagagatttgttctcaaggatgcatgccattaaaattaaattgaaatgtcgaagggcaaagagggagaggctggcgactagcctgtgtgggagattttagatggctctactggctcaggtgaagggattaccatgatggtgagatatattatatgactctacaggcattaaaaaaaaatctactttgcgctcgattcagaggtagtacaatagtatggatgagggaacaaactaaaactatatgataatatggatgcacgagcggccagggcctagtggaaaacatgaagaactttgccgggcatccatgttgaacctcacaaatcacaaattttgctgttttatttgaagacagttgaatgtatcagttaaggtgggatggaacaaagcaaacaaatggtgctgaaatgcaatgcacatggagtagaataaaaaaagtcaacaacgtcatgtgtttaaatacggaggtatgagttatttttatccaaaaatgatctataagagatatctgcattgtcccaacatattctataagaaacaccattttgttacagggtcaaatgaaactgtaacagtatagtactacagtttgtggaattcgttagatagtaatcagcttaccatcagcatttgctgggctattttgtcacaatcaaaacgactcaatttcctcctgtaagggtatatatatacaaatgagtgagcagtagtataactaagcaggaggaaggaagcacacggattaggcgagtagctgacctcacctcacctgtgattgctgtagtgcatcgcagccagcccagccagggcggccagaggaaacagccggccggagcaggaggagcgggtgcccggccgcagcgcgtacgctgcccgcttacccgccatcggagcgcgaggggatgaatcgaagagggcaagggggaccttgttggcgatggttcctggtggacagctgctcccgccgccgccgcccgccggcatttgtggtggcgccaagatagggtgatgggggaaacggcggggcggcggcaagcgggaggggagcgagagacggagagagctcggtttgcgggcggcgcacctttgccaccggccggcggcggcggcggccgtcagtgggtgggtggtcgcaccgcctcccgttgcagatcgggctcacatgtcagcccaaaagtgagcgtaaattcggcccaaaagtacgggtcaatttggtgaattttttttatttttaattttttttattaaaagttttacaaaaataatttttcattttgaaaattgacagaagtggtcacctaccgccctctgggagggcgatttttaaaaatcgccatcccagagggcggcgaaagtgacgtggcagacggaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattatttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccttgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacatcgtggtggtgtgcaccgtgcaagtcgtcgtcgtagaactggctagtaggaccagtcctaccgacgtgagacgaagaggccccagtaccgaagatcccggctgcaaatcctgctggacaaggaccatcagtttcatacatgtatttaatagtattaataaaaagtaaagtaccgtgtgggcgaaggatcgacgctccgtgagaggaagagctggcgaacgtgcccgaagaggtggcgaacgcccctgcggagctcgcggaagcgccggtcgtgcctgcgaacgcgctcgaaggcagacgaggtccagcgacgaggaaacgtgcagttaaaacatggtgacatattcgtgcaaaagctgaaacaaaaatgaactaatgtctggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacatgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaatgaagtatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcaacgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccggtaagtccccatcgtgggaccgtcctctggccactgcgcgctgcgtccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctataaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcgaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgtccaatgcttcaccgcctccttcatctcatccttatgagcataccttgcaccctcaattacctcgttctccttatactcctagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctcctcctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtaaactatctgaaatgtgaccttatttgacattgtgcctgatgaaaacaataactgcgttaacctcgcatttctgtactacgccctaagttacattctctacaatattgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttccttttcttttccctcctttttctctattgggccgtcggcccagtccactccacccgtcgcccgcgctcggcctccccttgtgggccggcccgttctccttcctcctctctccgggacgctgacaggtggggcccacctgtcaggtcgtccccttcctccagccacccgcctccgacggcagccgccgccgaatccgccacgtcgccgcctcctccgctcttcccgcgcccacgccgcgccgctcccgcgtctcccccccccacgtcgccgcctcgcccccgcgtctcccgccctcgcgcgcctcgcaaatgtgcgggattcggatttgaatccccctctctctctctcttcctccccactcccccacatcgccggccaaatcggccacctccccggccacgtccgccccctcccgcacctataaatcgctccccgcgtcttcctctctcgtttttcgcactcgccgcgctctcccgtgccgtctaccgccctcgcgccgtcgcacccgagctccgccgcttgccgccgccttcggccgcgagccgccgccgctagagtcgccgccgcgccaaaccgccgccgccgttagcttcgccgctgcaagagctttcccggccgccgcctcgcgtcgccggaatcccaccggagcacctctcccctcgcgagccggtgagtttttcccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctcccccgtgagcgccgccgccctccgcgcgtccgccgtcgtcttcggctgccgccgccgccttcgcgccggctgccgccgtctccccgcgccgccggtcaccgccggcggtcgtgcgccgtcgtcgcctcgccatggccggccggcttgagccgtgccaagccagcggccacgcccctctcccgccctgtgccgctgcccggtggggcccaccagccggtggaccacccctccctctccccttgtgccgctgccagtggggcccgcttgccagccgccccctctccctctcttagtgccgctgaccagtggggcccgcctgtcggcgccaccccctccccttgctgacgtcagccctgggtattattgcgcaataaattaattaaggacttttctttattagtaaaaacacactttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagctcaactagtacacaaaaagggattacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggctgggcctgttgcaacgtggtgtagcgttggacagtgtttggttaatattgattaattactacaactgtcttactgctttcaactactgcttttaaatgctagctttatgcaaaagaacctctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatttcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccaggtttgaccgtaggacaagccaactggaaacctaagagccctctgaacccctttttcatctgcatatgcctttttgcacttggattttgttttggaaaaatttggagttttgcctctttggtttgcgggaaaaatcttggtcgttctttcggatcagatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcagatggagacaaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccaactggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagcccagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaatagtgagcagcacagcctcaaccctactccgagttcactaaagattccagctcaatcagttcagccagctctgccagaacagcccaagaggtggggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggctaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcatttcattccggtgcacactacctactcagggaagaaattagcagaactctatctggcaagaattatgtgtttacatggtgtacctaagaagattgtgtctgatcgaggaagccaattcacttcaaagttctggcagaaattacaagaagaattgggaacccgattgaatttcagcactgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcagtggagtgcatcgcttccaaaccaaaggaaagttggcaccacgctttgtgggaccatatcggattttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacc

SEQ ID NO: 64052 - DNA, 1504 bp, Oryza sativa
acaccaactattacgtcgacttctgcccgccgacgagcggcatgacggctggcgacgacaacggtgtgcgtgacgggcggcgactcctgtggctaagctgccggatttgtgcaaccgcacggcggtggtcctcctcccgcctctcgcctgcttcggcgcccacctgcccgtccgctcaccgggaagaagagagagagaggagagggaagaagagaggagtgaggatgaggaagaatagagaagggagagggaagaaaggagtgaggctgacatgtgaggctcccgtgggccccaccatttttaaattattattttttggtgtaactgatatttggccccacggtttttattattttttggatagaattgtcacaagcgccacgtcaaatgacacgtgggatgaagaactagtcaaaccagccacgtaagcaccacgtcagcaaaaaccacctttcaaaccgccgagggacctcgtatgtatcggttttgacagtttaggaccggttgtttctggttttggagttcacggatgaaaatcggattcggtgtaaagttaagggacctcggatgaacttattcctttggtccgtaggttcaaaagtttggcccaagtatggtacgtaaataaattcggcccaaagcggaaatggtgggcgtagatttcacaacagatcacgcaggcgcaacccgccgcacaacgccggcgagcgcgcgaggcggactcactcggtcactcctcgcttcgatctgtgtaagtatctgcttcgatcatgctacagtttctttcccgctgcggattttgatttttgacacgcggttgcagggaggcgggtgggtggtggccgggtttggtgcggagcaggccgcggcggtggctggcggaggcagagcgcgcggtacgtgctcgatgaaatgctcagcgggaatccgtgcccattattgctagaagaaaaatcgcccccttcggaggtgctcgacgagtgttcgacgaaaggtgtacaaggacgcggcagccttgtaacggcagtgttgtgatttttctgcagcccagtttgctcggcaggactgcgctgctgatgcgggcgctgctcagtttgtgccaggtgcgtctcctctcctacttcgattttcttgcttgttgaattgctgatgcccatgatgatttcatttgttcaatagaattgatgctcacatagcttgaaggaaatatgtgaatatatatatagtacaaatatttgaaatgtgcctactcgtgaaagcaaaaataggatttttttttggaaataatacgattttaaaggaaaatcgcaaaaatataggtcggttagacgaaatcgcaagtttggcaccctatcgaatatccgtggttcgacagggtacctatcgaacaaccgcagttcgacagggtgccggcagttcgacaggtgataaaataatttttaaaaagaggaaaaacactgtagcacactgtagctgagaccctatcgaactgggctgcaggaat

SEQ ID NO: 64053 - DNA, 29679 bp, Oryza sativa
agcatcaagatacgagatattccagcaatgtttccttgtagaacctgacattaagcgctcacaacagcaatttcgctccaaaaaccggtaacgtgacaaaggcacgtcctgactaaataaataatacaagttctgaaagacaactgaaacatgcaaaatgatatcgagtgatctgaacatatgaaaactataagctctgaatacaatttaaatttttaaaaaaggaatatattcaggatgctgatgtttccagatggacaaaacgagatcatagagaaaagttttacatttgaatgtacaaagcaaaactagcctaatatatccaaatcctggatacaccaagcagaagaactagccaaatatatagcgatccgggaactgatgatgcatctgcattatcttaggttttgatgtaactgtccagattccgaaaaatgcaatgtcatcaaaccttttcaccaagaaatgatcttgttgacagaaacccttcgaatgtttattacaatgccactggcaatgaatggaaaaaggaacagtgaaaactgaaaaggggctactttgcagtgataggttatgcattttgcttaactcttacaatttgttgtaaagctgccagccaatatccaaccttaatgacaaaccagtcgcaatgtcctgtttcattcttacagttgcttcagagacattcagtatatagattgattgatgctaatatattggcgccgatatattctctcatttagcatttggttactagctttttaccatgagaatagtgaggaagactggaggaattaccaatctttgatttaaaggagaataaggactttaactcattaccccgagtcgatcgccttttaatatcacggtagaaattgcaactgatgttgtttgaggaatgcgaggaacacatgcaaattagttcattcctatggtgacagataaactgtcagtacatacaggtacaacaatgctgttatcctagttttcctatgaatgaatgcatcaatagctattcagcttatcatttgacctgcattaaggactgtaggtttctgctgggaagaaaaagtctagatggttaatcttaaactcaattgtcacttttccatgtatcgttagatttggcttctaatttagttatctagtttccaatcgtttctatttgtgtatcttccaaatggacatagtcacataggcatgttcaaacatacatcaagagcacaatagcaaatgaactgacacacctggtgttttgcaccttggatccttatctctgtcattccactgaatcatacacatagatggctgatatttttcaagctgatttgcacagatattggattggcatcctgatattctgcaggtatttcatcaaacatcataatcaaaatttccccagtagcacttctgaacaccacctgtgcatttccatagggtcacttcattgaactctgacagctcctcatgggcctcctttcatcagaaaataactgggtgattcctggtaggcattccacctcaaatatcagcttgagcccagacatcacttgctgccacaataatagcactgtgcatcagcatcaggatcgtgaaataaggcaatgtagcagtctagcactgcctgcaaatgagttttcactaacaacgaggtcacagaatcttgctatgaatgagctatgcccatattgaagaactgctttccatgccccaatgaaacgctagttaaagagccagtgtgtcaacattacctgcagtaatagaaagaaaattagtaagaggaaaagccctgaaagtacacaaacgcataaacatcatcaacccacaagaacatggcatttggcaccttaatacctgacttaaggcatcagtgcagatgaaatgccatcactagctggcaataatgaatccgctgaattgctttgctgccacacaagttttccaaaatatatattactttctggttttgacagaatatcccatttctcccttcatatacctgccgagaaatgacttatctatgcacaatgtttcgcccctctccactaggtggatatgtccttttttttcccgtaaaagaaaagattaggtgggctaatattagttaatattggccactcccagaaaaaaaaagtatattcccctatttccctattacctaggtaaataaattccattccaaatagtagcctacaaattgtcaactgagaaataactacctctctcacagttcagatttgaaccaggtcatattttgtttggtttgctaccctatcagattttggggttggatttggtgttaccaaaatttgataatagaagtatttgaggcatgtttggtctgttattttaccaaaatctgctaacagaaatggcagcaaacctcacaggctcagaatgctccctagaaaacaattctacacgatgactctatacaagaatgaaacgcaaatctgctttacaggttgtttaaatgtcacaatagtggcacaatgaatcatgctattacacaggtggagctcctgattgcgtagcagaaggttgatccgaagctcctgtttcaatctgatcccacatcttaaggcatggcatccatttctttcccttctctttcactaacaatgcgacctcatcaaatgacagcaatacatgaatgacgatgtagataaacacggcgatgacaagtgcaaaaatgtatgcagatgtcttgaacttcctgcagctgccggctgcatatgccccaaggagaccaagcaagtctaataccattgctgtcttcatggcaaggagtgatctcttgtacttgcttattgtgttgttcagaaggaggatgaccatgaccgttgaggccatgaatgctgttgcattgcaatagaagaataccttgtaccttataggatgggtaaccttgaggattgggtctcccgcataatggttgccttggtcactaggccaaagcccacctggagggagtagcccagcttggtatgtgacagtgactgcaagagttccaatcagcatcaaatctttgcgccatttgtgttctgttcgtttcttatcagtgcttccagttggaccagtcagagtcatggatctttgctggctctcaaaaccagaacggcgcttcttcagtaagtccactttttgttctgcaacttgtagaaccaggatttgaatcatgacatatgcaaatactgcagcgacgacaagaatgacgtagatagatgtcgacactctcctgcagcttccagcagcaaaagcacccatgagactaatcaaatcaaccagcacgcaagcgcgcaaagcataggacttcagacccttgtcacacagcctcttgttaacaagcaacagaatcactgccagagatgccatgaaagcagtggcgttgaagtagaagaaaatcctgtaacggcctggaaactcatcatggagcactggatcgcctgctcggtgacgatcgttgtcactccagaagccacctggtgggcttagaccagattgatatgtgatggaagccgctagaatcgcaagcatcatcagaaacttgcgccgcttctccaaatctttttcttcattttgcagctccaccgaatcacttcgtccatcatcactccccccttcagttcttctgaaacaaaatctcgtaaaacgatggaataagtttggcacatgttcaatttttgtcttcagttgagtcttgagagccatggacagcagaacatgaagcgtgaaataagtgaaaacaacaaggaccaagatgaacacatacactgacgttgagaactttctgctactcccagcagcataggcccccataagaccaaaaaggtctaatgccatggctgtttgcaatatgtgacgcttcatggcaccaacagtaatcagttgactctgaagtaagatgatgatcaccaaagatgccacaaacgcggtagcattgcaatagaagaatgccttgtagcgcttgggattgatggcctccaagattgggtcaccagcagtatgtccattattatcttgccaaaagccacctggtggatttagcccagcttggtatgtgacagtggcagcaaggataccaagcaacagaagatatgtgcgcaacttctcaacatcatccttagcagtatcggaagtgcctgaccttctgttgttcactggattttgtgctctgggagtagagcgcgattcttcagtaggattcctagtcccccgcatgatgaaagaacccagcttctgaagtaaatgggtcttcttttttcccacccattccatggaactctttatgcaaggtattggcaccatatgctcgatccactgaatacagaggtagaggaaaacagcaccaacaagggcaaagacatatatagatgtatggacttccctgcaactcccagcagcataggcacccataagcccaaagaggctcaccaacacacacaaccgcagagcatttgacttgacaacatgatccactgctgtattgctgagcagcatgatgatgatgacaagtgatccagcaaatgcagtggcattgcagaccaagaacgccttgaaccggcgcgggtagtgatctcgcagcaccgggtcaccggcaagatggctaggcttgttgtcatcaggccagaatccacctggtgggtttagccccgcagtgtatgtcaccgttgcagccaatgtggcaagaaccagcaagaagctgcgattctgttccagacgtttcgtcttttcagaatccccagtttctcccgtcttatcggttcctccatctccatgtatactccccagaatctccttccagtgtttccgaatcgtgtagaatatttcacacagccattgaggtgccagatgccggaagaatacgacatggagagtgatatatgcaaagatgccaacaagcaaagcccagatgtagacggaggtcctcacctccctgcagctgccggcagcgtaggcacccatgaggccgagcaagccgagcaccatggcgaactggagggaccggagccaaatggcgtcgcggctcagctccttgacgaggagcagtatgaggacgatgagggacgccccgaacgccgtggtgttgcagtagaagaagacgaggtacctcctcgggtagctgtacctgagcaccacgtcgccggcgtggtagccgtgctggtcctgctgccagaagccgccggggggccctagcccggcttggaaggtgatggccgctgctaggatggcaagcagcaccaggtacttcctcagcttccacaggagatcggcctcggagcccgcgtcgcacggattctgctcggtttggccttgctgcgtcgcttgtgccgaattagcagtagcagcagaagcgttggcaggagcatggccattgctcctgccattgcttgggttctctacagagctcatggagttgagctcaaagattccaagaaaatcttgggttttcctctgaagattgtagcattggatggcttgaagtcgtgcagatggagagatgaacttaactactgatggtttgcaagaagatggagatgagctgctatatgagcaggggtttgggtctttggatacacctccactagatagaagagtgaggtacaacaaacgataaaaaatgaaaaaggaacaaatccaagtcaacggctgtgattagttcagcgcaaagtttggattttggttgaaattggagatgatgtgactgaaaagttgtgtgtgtatgacaggttgatgtgatggaaaaggactgaagtttggatccgaactttggatctaaacacagccaacattgggttctcacttctcagccgtggaccagctcaaactggcagaaattattaatgtgtttggataatgagttaggctgtgtttagttcagcgcaaagtttggattttggttgaaattggagatgatgtgactgaaaagttgtgtgtgtatgacaggttgatgtgatggaaaagtactgaagtttggatccaaactttggatctaaacacagcgttaggagaggtgggattgggaaatggaaatgaatggatggattggatgaaatggagtgagaaaaatgtatggctaggattgaagcttaccctttaaggggtgggaaatcatatcccaaacccattatccagacatggcctattagtatgttgttatgtcattagccgtcgattaaatcacagtaattttactcagtgcagtctcatataaattgaagtcagtttggtggatcatgcaaacaggtctgaatctaatgtgtgcattagttcaaattcagaaaaaaaattctacatttcaacccagtctcaggagataatttggcaaattatgcacttcaacacggaaaattttccaaacaaaagagcaatataagagtcagtcaagtctacatactttattcaggaggcagtgtcttcgttgcttcttagtgactggactcctagttcgtctgctttctgccccctctttcttcctcctttccaattccccttttcactaaacttttaagaatatactaaaagttttcttttcatcattcagatttcttaattgtgactagtgagacttgatcagtactcagtagtatactttagttccaatactgcaacagctatgtgaacaaggaggcttctctttgttttaccagttgacttgacttggggacttttccttgatttctgtcgtgggggccatttcttcagcacacagacgattctttctaacaaccttttggtttttggcaccactagatgaaacaattatgacacggtttgaaggcccatttctgtctaaacaataattaatctgctcccatctaccattggttaggcaactagcttatctccatgagtaacaggaaagcagtttactataacaagtgtcttacagaaatacaacaaacacgccactctgatccgttgctcgattctttaattatttcagtataggtctttagagtgcaatccaagtcatgccgattttttgtatgtgccaaatacatttgcacgagttgccaatccccccttctctttagtccaaagaaaccccaagttgcattattgcataataagttaatactaattgcaatacgagattagaatagggacagtgacctgtttgttttatagtcagggctaacaacccacagttgccactagaaagcaaccttgcgtcgaagactttggcacctaagtcttccacctaaggcctaacatgaaaaataaaagcataaattggtttaaacctttttgaatccaattcttttgctaatctatgaccacgaaagaaccagagaaccctcccaaagttaccaaatgatataaaacaagtcctagtatataccaccaaggcaacgaagcatcacagcagcacaagacgcaattcagcaaagagacgagcagctgggggtgggtggggaggcacgcatagcatacctggcgccttcttgaactgtgaaatgcatcagccaggccagcagcactctgcaggtcccagcgcttgcgccacgacggcccatggtggtcggcgtggcacctcggggctgggccgagaaagccacgccatcgccatgagcgtggggaaaaggcgccggcccatccccttgcacgcatttcgtcgaacacctaccgggtggaccgggggcaccgggcattttcgtcgagcacggagacccccggcgctcccctcggcaagcgcgcagctctcgccgagctgagcagcagccgcgccgcgccgcgcgctcggctcaatgccgcccgccaccgcgcctccgtacggtcgaccgcctcccaccgccaccgtgcgtgtgcgccgcgccgcgcgcgagatattagcgtcacatgacggcagcagttttgcgtcgcgagattagtagtattgatagcatgcatagcagcagtgtgccgcggcccgccgccctggcaaacaactgaatttctttaaaataagaggaaataactggcagtttgaatagctggaaatcgcgaatctcaaataagaggcaataagaaattgaatttgcaaacgaattcagatcaacaacataaacaaccgttgaaatcacttctttaagaaatcgatttaaattatatggatcgatatgtatttaagtaaagttgttagtaaaaaaaatgggtactaggattttaggccaccactgtcttctctttttctctatggctcttcttttctccaacaaaattaacttttggatactcatggcacactttttaaactgcaaaacgatgcgtttcgtgcgaaaactttctatatgaaagttgttctaaaatatcagattaatccatttttcaagtttataataattaaaacctaattaatcacacgttattaccacatcgttttgcataaaaaacttaatcttcatcttcatctgaagatctcttcaggacattcaaacactctttttgcctcaacattgctcctttcaacctctcgacccaccctacctacgcctgccacctttctctcaaaagatcacacccaatggcgtccatagctacgagaacgagttatcccttcttcttgccctctctcaattctcctcctcttcgctctttatttattttaatctttcgtggatctaggaatggcaaaagtcaggtatggcttgagcagatccaggtagctgaggtactgaggaggtgggaggacagaagcgaggctgagctcaacaatggcgaactcatttgttgttgtatctttgacccatgttcttccccagtttatggctcaatttgtgaggtgtgtgaattttgaactggcgttagagacggtttacttatcacgactgctgttgatgtctccaaatacatctccacatgcgaccgctgtcttgtttgtaaaaatgcaacatttctatgtttgttcgttaggaggcagttggttttctcgcatatgcaaacaccattaactatatgtaaaatttgttttttagtgcaaaggaataagtaaaactaagagtttgaaaggatttgctaaaatttcaggaattgtccaaaaatataacctaacttttcgttaatatgataaccatttacatttatggttatgaagataattattaacaccattaccatagaagttgatggttatgaatctttttccgaagaaatacatccaacctgtggaaataggtgaatggtgaaaacttttttgtgctatcactattacagtatagattttcctggatgttgccccccttttatttccatacggtaagtggaaccgcatgggaaaataaagggaccggcaccgggttgttatctgcacgggaaaatgcattttcccttgcatgcgtcttaatccgaccgcacgggataatcctcgttatcccgtacggtcaacttaagaggaccgcacggaaaaaaacgattttcgtatacgggctttttaagtggaccgcacaggaaaatacctcccttctttccctcccacccacttcaaatttttgacatcctctctcttccttttttccccttttatcctccctcaaccactcccctctctctctctaccttatctcttcccggcttcccacctcctccccaccttaactcctaccggcttcccctcctcctccccctcccctccttcgtcaaagcgggcgtcggcggtggccccttccgtgcacgcagcgaggcagaggcgtcgtcagccattcgttgtgcatgtcgtcaaggcagcggcggcgagcggggcggtggcgagtggggcggcggcaagcgggcagaacctcctcctggtcattgtcctcgtcatgcacgtcgtcgctcggctccctcgacgatgacgctgtcgtcgcgtgcgtcgtcaaggcagcggcggcgagcgggcggcccccgcccagatccggcggcggcgggcgagcttgacggtgatgacggtggcagactcagcggcggctgggggcgtgcggtccggcaggcggcgacgattttcacgttttttttatttttggtttttttttgctccgtgtgggcggtataatttgaccacacgggataacgtgcggttgggccaccgcacgtgaaaatattcatttttctagacccctggtttcagacgggaaaacctccacacggaaaaaatcaatttgaccgcacggaaaaatctatcctgtagtagtgtatatatagatattctgaaattgagtacccgtatatccgtatatgctatcgttctgatttcttttatttacgtgccaaacatatttgaaagagttgccccatcccttttcttaatttattccaattttagaaatcctaattgcattattgaataataagctaataccaattgcacacgagactaatagagggacaaatagcagaaggccaacgacccaaagtagcaactaacctttgcatcaaagactttgccacctaagtcttccattatatccctaaggcggctaggctctaacacgaaatgaaaacaccaattgcttaaagcttttgattctcattttttttctataatttatgaccacacagagaatttttttcgataatttatgaccacacataggaaaacaagtaatttcccacaatttgccaaatgaaagtatttcttttcctgtacaagcaggcaaccttcacagatcaaattaaacgcagttaatctagacggtctagaccatggtctagacgaacactgtgttaacagcgtcttgatcatgacggtggatgatccacaacgcgctcgtccaggcagcggaagagggtctacatcagttgcggcggatctagggcgagccggcctgttcatggcgatggatcctggttgagctcgttcactgcggcggcgagttgatctagatgagcgtgtccactatgccactatggtgagaggcagatccagacaagctagtccacggtggtggtgatggttctagggtgggctaggctgctaggttttatgttgttttttaaggttttgaaatgattatcgcaagtggtcctattaaggaaccacatgtgataatcattttaatcattttcaattatcggtaggactgtcaacaagccaagctcgatacaagctcgagctgagcctataaaatattcagctcgagctcgactaccgagcttcatttttaattagaacaatgtatattttaaaagataatcttttaaaaataattaatttatggtttatcatattcatagaagaggaaaaagaataaaataaatatatgatgcaaatacaaggcatacaaataacatatttaatctattaatttattaaatagcaaccagaaatcatatattactaggctcattagaagctcgacctcgactcgacaaagctcgatcgcgagctttgggacaggctcgggctcgactcatttggagctcaagccgagctcgaatcaagcctaggacgagtcaagctcgagcagttcgcgagccttgagcttttttgacagccctaattgacgatagattctcagcatgtgggaatacaatgttttcctaggtgttttgttagaggcgaggatgccacccgcctctacaaataaattttatccacccacagaaacattttccctagtagtacttggaggcaacacatactagcattcaatttggttgaaagtcctctcctggttccctttgaattttagtttttaaattttagcgattttagttaaatgatacgtagtcacgtcccgatagttacaaattttcatctgggaagaataataggtggcatggcatataggagcagaatttaggtctgcgtggttgcattgtgtctccctcattgagcgccttcagctagatacagggctgtacctaattaatacagatatgaaataaaataccctctccttatttatatgaaaatttgcatgtgtaaatcgattaagtacatgtttgagattagtataaactgaattgaactggtaactctcatcctcaaaacaaccttattcaaagtttaattagttagaaggacttagcactttaaatcttcagccaccccaccacaaactagccatgattactgtcattttggagtttccattccattacctttgtcttttctttgttaatgacaacttttatggattgctggtggcttacgtcagcacaattggggtcatccatattctcacatccatgaactttagtatggctgtcacgcatcagtggcgcggggaatgaaaggtgagaagaaaatataaactatgacgacgcagttaacctacaaccaacgtatcttatgcagcggctataaatcatcggccgggagaccctgacagcatcaactcatccttccattacattttacagtttctaagtttcttacaccgtgcaaattatggagcgcaacgacaatccactgcacgccggctctggccaggccacgacgctcgagggttccgaggggcgggaacccatcatccgtgccgggtttgctcgaaccgacactgataatggcggttctgatgtgctattctgtggtagtgaaatggaccacaacaatctgcagcccgcgggctctggccaggccatgacgacggaagcagacaataaccgtgcgtggcagctgcagaagtacctcatgctgctcactatcctagtggcgaccgtgacttacatagcggggctcaatccaccggggggcgtttggctagagaccaaggatgggcacctcaccggcaatcccatcctgccggacacccaacccacccgacactacgtgttctactacttcaatgcgacggctttcgtggtgtcgctcgtgctaatccccttcctcctccagccctgcgtgaaagcggcggcgcagctgaaggcggtgcgtgtggccatggtgtttgatctggtcctcctcatggtggcctacatcgccgggagctgcccggataggccaaccaccatcttcgcctcgctattgtcggtggttgtttttggatgcgtcgtggttcactggctggtggctccttcttccaagggccagctctggcttgacaaaccaaacaaggtcttgatgctactcgccatcttcgtggtgacggtcacgtatgtggcggggatgaggccgccgggagggacttgggaacatgcccaggaggcagggcgaagcgatgccggtgaacccatctggctagagcgccaccgagggcgcttcatggccttcctcgtctcgaacaccatcgctctcgtcgcatcgcttgccgtcgtcatgctggtcttgagcagcaggctgcggagaaacatgtcgtgccttgcacttcacgtgttcatcatcaccatggctcttctcgggctcttgggggcctacgtctcgggcagctgcacggagtggatcttcaccgtgcaagtcggctgcgtagctggtgctatagctgttatcctcccctgcatttcttgtcttcccattgttgagtgtcttttcggtggattcaagagccaacaccactcgttggcaggagcacccggtcgcagagtgacaatacaaccattggtgccaattgttccagtgggagaaggtgaaccagtaatggcaggaacaccaggtctcccccgaatgacacctacggaatcaacaatggttgtgcatagacagcatagtagtgaagcccatgcgaatccattaaacaatggccgctctatgatacttctactagccacactcacggcaacagtgacataccaggccggcctagagccgcctggtggagtttggcgggacaatgagggtggccacaatggcggtgacctgatactcctcgctactcatgctatccggtacaaggtcttcttctattgcaactcggctgcctttgtggcatccatcattgttgtgatcatattgcagagcaaggatctagtcaaccgatatgcgctccatgccgctataatactggaccttatgggactcatgggtgcctacgctgctggaagctggagagatattggtgcctccctatctatcttcgtcttggttgctgccatcattgtattgttagtagtgacctacattgtgagttgcaagtctctgactcgagggaacaatggaaatgtgtcgttagcggagcagaaaagaaaaagggaattgcagaagaggcaaaagctgttgctcaatcttgcagtactggccatcaccatcacctaccaagctgggctaactccaccgggcggcttctggatcgaacatgccgatgaagaacaccataatggagatccggtccttggtgacaaccaccgtggctggtacacggccttcttcttctgcaacacgacgagcttcatggcgtccgttgtcaccatcgtttccctggtgagccaaagcctctctgagattgatatggcgtactgcaaggcgctctactgctgcgtatttgttgtcttggctggattgacgggtgcctttgcctgcggcacctctcgaaggatgcaagaatccatgtacgtccttggctcggccagcctagggttaactcttgccatcctgtacattcaccgttcccatccaatggtcagaaatggggatggtagtaaccatgccgacgatgatactgagcttgttggcgatgtggtcactaatggccagcacatcacaacacacaagatgtgcaagtacctcatgctgatcagcatcctggcagccaccatcacctaccaggctggccttacaccaccgggcgacgtgtggcccgccgctgacgacggggaggggcacgccgcgggcgacccgatcctccgcgacagcgaccggtggcactaccttgcattcttatacagcaactccgtctccttcgcggcgtccgtccttgtcatcgtgctactactgagggtggtggtggtgcggaagctgagctctttcttgccactgatcacggtggtgcacgcggtggccgtggttgatttgctcgcccttctggcggcctacgcgacggggagcagcagggaccgggggacctccgtctacgtcgtcacggtggccgccacggtgctggtctacgttgcgatatatgctggtctgagttcacgccattgtggcagggaacaggatggcaatggaggggtcggctctcgtccgtcgtcgcaagctgctcgtgtttgacgatttgcatatatgctagatgcatgctggctcggctcgtttagtgctctacgttttccaattatgtgtgcttagatgttgtgctacttgtaagaaataaccatccagccatctgatggaaagtcacatgatatgtattgttgtgcttgctggaaatgtgtgagagtttgtatctcgatgttaactattattagttggagtcttccataggtgattgttagtttgtctcccaaataaatgaaatcagttttcatggaacatgttttagtagcaaatttgtatcaaatcggcggcttcggccacggcggcagcggcgtcctggtttccgggctggaaccttggcgatctctctcctctacctctcttcatacctctagctacctctcctagttctagaagcttccagaacttgtattccctagtttcttcttctctttttcaccccaaaacaatggttgcttgtatggtggatccttgctattgaattggaagaattgggttcctaacaatctggtatcagagtcgttgattcgtgggatttctatcatggagtcgattggagtgcacttcagcaacgcccccatgcgagtggttgcttgatttgggcaagggtggtgctcatgacacccatgttcgatggaatgccaagccagcctgaggtgttcaatgatgatgaaaggatatcagagactgttcccatcaaatccaccatgaagaaggagggaatatccatggacaaagctttagaccggcttcttgagaagtttgagttgatggaggccaaccgtaggcaagaggagaagttcaatcaaatactacataagttgcaagagatagaggcttgtaggagcaaggctgctgttggtatttgatatggttacagatagaatccacaagcgcatggatataccgatgcacttcccctacggagtattccaagggtatcgaatccaagggaatgtgtgtgatcagagcttcctccggttcatccaaagacaccaagaaaacgataggccaggatagagaggatttactagtgagaaatagtgtccagggaatcctaacgcaatacttcaggcactagcaacccgctgttcccagatgttgctctactacgtacccagacagggaggacttcagtgatctcgagggctgtcaccacctctacacacacctcaaacgtactgtgggatacgcagcaattactggataataattacctaaacaccacgtctaagcaattaatatctactttagtgtttataactcaccaaagcaatcaatatattttagttgattatagtgaacaataatcccgtacgctaattaggaactaaccaagagataattctcacaaggtaaatctaaattactccagaagaatattatattgaattcagagtaataaacagaataaaagaaataggagaagattactgacaactccggaattcttctgactccttctactccactctcttcctattctagtatacatatagtacaatagagcctcttataattcagctcaagcttggaagtgtgtgtgtgtaaagtgagggagtgatgtctttatataggggtaggtatgatcgttggcgaaggggaaatgtccaaaatgccccgcaaccgccatcaggagatgatcaggaccgtccacgccaaaccccagcctggatggctgagattgtggttcggctgaaccagatggttcggccgaacctgggctgggcccatctggcctggctcttggcccatcttctcccatggacctcctctatccatttctcggagttttgggtttatttactggtatttggatgaagttcacaacccctccttgtatggatagatgattctcctcattgtagtctgattttcctcccaacatcggggtttattgtctgcatacaaatatataccaacacttgtggaatatgtgagattaagcacctatctctatgttggatgttttattatctgatctttatgcagatgttggcggtatagaatcgacatttaacagccgccaacaaaaccccccacacttagccctttgctcgtccctgagtaaaggttagtgtagaatgaatttcttcaagatatgaatcaagcatataaatcattcacaaccatacctgtacctgtgaattttatctgtggctatcttaccatcttgagtaattgataaatggaatgatcttgattccagtccttcttgattctctgccagactcaagggatttttatgaattttcgcaaactagctcttttcctcatattgactttctctcttgtctctcgaagatgtatattttctttggatcctcaccaaggcaaaatgtgccagaacttatccctattctaaggctaatatgtggagtttggtagggataaatcgggacatacctgcattatatatattgcaaagccaaagatatggactcaagaggatcatcagtcatactcctagatcaagggtctttatttgtggtggaaaatggaaaagtaaaatattttgtggaatgatgaattgaagaaatgattctccctttttcctatactttctctccaattgattctcttggcatgattgtggaagggacatggctatattttatatttttttctgcttttctcaatgtttgagagcaagctttatttccgtcttctcttttttatatatatatagccatgcctttccctccttttctcattttcttttggccaagagcttttccaggagaagaaagcatagttcaacacaggagtttatttgaatggatatttttgtggaaagccaacttccagtgtagaagcttagcttaattttatatgtggaaatgaaagtggaattgaccccttgatcataagagtatgaaggatatctaacaccagtcgcacaaatttgacaaagctcaatataatgtcaagcagtcatatgcattataaggttgatcattaatgtacttgcatatggccttggtaggtataaggtaaagtcatttggaggattgagcctttagaaacaattttattttgaaaacaaattcccaagagtcatgacaagagttgcaagaattcctttcatcttaatcatctcacataaaagaatcacttagatgtataaggttccctaatcatggttggttgttcacaagcacaagttcaactgggaataatgaatatacaagatcaatcacatgaagaatttcgttagttggaaattttatctttcacttatgcttgaatcaattgtttctgaattttcagctctagtactataccatggtggagatatacagatacaagacgtgttcacctacttacctgtgaaaattgagagggattggggctagctttggttcggccgaaccactctggtgcccaatttccctgcaattttctgcagagttcagtgcttccaggtgttcagatatttcaacaattttcagggcgtatgcacgtcagaagctgggatatctcccccacacttattcaaaacctgaattttattaaacataaaacaaaaacaaactttggcaaacattggggttaacaccaatgagccacattatttatagctagtgcttacatgattggaaaagataaaaccaagcacctactactattttattcatgggaaaggaaacatctaattagcataatacttattttcctttcccatatctatgaatgcacgcttgatcttagcgcacaaaccgcgactaagggtatcaaaactattcctaagttcagcgagttctacccctagctccgcattatgatccctaagctctatgttctccttgcggagtttcttcacttgagcggcgagcttgtggatcgagggctccggcgatttcacctcatcctcttggaattggccgggagcccttacaattggagggggcgtcaaataacacttcaccttcataggtggagggctacgggattcctctgccccctccttctccaatgccgtcaaaggccggagtaaacccttaccatacccatcgccgggagttcgtactccctgaatgcggaaacgctccccctttggggtggatggagtaacggtgggtgtggtatacttgtggagcacctcatcccctgccttggtgaagagggtacccacatagcgctcggcgggaggcggtgcggccttcccgtcatcttggaaaaggcatcgtgccttcaacaaaccgagctctcccgtagtcggccgtcgtgcaggcgaatccccccggatttttgttcttgtaacatggcaaggggagagggatcacgctaccaaacggggggccgatcggggccgagaagggttcggccgaacccctggttcggccgaactagggagctcgtcgatcggctccaaaattgcaggggagcctggcacagctgcaaggggttgagcccatacagcgttcaccccttccatggtgtagtgttctaccgggatcaattgattcgccggtgtcggctctccggtgaggtcgtatgtggaattggataaagagccggtgaatggaatcaaggatttgctagccattggtgatttggagatgatggagcaagggaattgggttgagatggagagaaaggttgcaaaaatgtgagagagaggaggaagaacaggggctctggtgctagtacgactgatctacctctgaactcgcatctaaacagactcaggacgagcgggggagactaccattcaaatccggggccgaaccatgaggttcggccgaaccctagtgagtccggcaggcccccaattttctgcctagtcccactaaaacttattctaagcacaaaaatgacaactatatagggttttaagcatgcaatggatgagatcatcatggttcataatcaattaattcaataacgtccacttcttcatctaaagtttcatttagctcaaggaaaatctttaggcgttgaccgtttaccttaaatatgtttcctgattcattgtggagtgtgattgccccgtgcgaagaggtgtcgatgacgtcgaacggtccttcccatttgctgcgcagttttccgtggccgaagagcttaaccctagatttgaacatcagtactttgtctcttggcttgaatttcttgatctttattcttttgtcatgccagcgcttcgtcctttctttgtatatctttgcgttgtggtaagccttttctctccattcctcaagttcagcgatctgcatttttctccattctcctgctccctcaaaatccatgttccaattcctaatggcccagtatgctctgtgctcaagttctatagggagtcgacatggcttcccgtaaactatctgatatgggtacattccaatgggtgtcttgtatgctgtccagtatgcccacagtgcgtccggtaatctatccttccatcctgttcccattttgttgaccgtcttttgcagaatattcttgatttgtttgtttgatgtttctgcttgtccactggtctgtggatggtaaggagtggccacattgtgtttggctcccatttctcgtaggaggtctcggaaggttttgtcatgaaataagaacctccgtcacttatgaccattctgggggtaccaaatctagggaagatgatttatgtgaacatcttcttggcatgcctcacatccgcggcgctgcacggcatagcctcaacccacttggagacatagtcaactgccaccagaatgtactcacagccgcgagacttagggaaaggtcccatgaagtctataccccaaacatcgaatatctcgacttgcaaattgtatgtgaggggcattgcatcgcgagcagtgattcctccttgcctctggcagctggtgcatcttctaacgaattctcttgagtcttcgtacattgttggccagaagaaaccactttgccaaatcttggcctgggtgcggaatgcaccgtaatggccaccatagggtgaggcatggcatcgttctatgatcttgagtccttcagttggcacacatcttcgtagcaggccatcggagcagacccgatataggtatggctcatcccatatgtcacggcgactttcatactttagttttcgttgattttcccctggtggtatgtacttggatactatgtagttcactatgttggcataccatggattggagtcgctaaccgtcatcagcatgtcatctcttaagaaatcattgatcggctgttcctacatgttagtgatctgcagcctggacaaatgatctgctatagaattttctactccctttttatctttaatttctaagtcaaattcttggagcagcaaaatccatcttaagagacgaggtttagcatctttcttagtgagcaggtattttaaagcagtatgatgagtataaattatcaccttggctcctactaagtaagatctaaacttatcgatagcaagaacaaccgcgagcagctctttttcagtagttgcgttattcaactgggctccggttagagttttgctagcgtaacagattgcatgatgctttttatctttggtttggccgaagaccgcaccaacagcgaagtcacttgcatcacacatgatctcgaagggcagagtccaatcaggaggttgaatgattagagcagagacgagtgcctttttgagaatttcaaaagattttaggcacgcgtcatcaaactcaaagggcgcatccttggctagcagattggtcagaggtctggcgattgtagagaagtccttaatgaaccttctataaaagccggcatgacccaagaagctgcggattcctttgatgttcacaggaggaggaagttgatctataacatcgattttagcacgatcaacttcgattcctcgttcggacactcgatgcccaagaactattccttcatggaccataaaatgacacttttcccaattaagcaccaggtctttttcttggcatcgttgtaagactttgtctagattctgcagacaatgaccgaaagtctttccataaactgagaagtcatccatgaagacttccatgatatcttcgatcatgtccgagaaaatagacatcatgcacctttggaacgatgcaggagcactacacagtccgaaggacatcctacagtatgcataggtgccatacggacatgtgaacgtaatcttactctagtcctcctgatggataggaatttgatgatacccggaatacccatcaaggaaacataaaaaggaatgatttgccagccgttccaacatttcatcaatgaagggtagcgggaaatgatccttttttgtagccttgttaagtttcctgtaatcgatgcacatcctccatgcggaattagttcattttgagcatttgtaacgatcgtcattcctcccttcttcggcacaacctggagggagtactctcggggtcaataggaatatgatgggtgcaaagtgcgagattaatccccctaaggtcctggagcgagtagccaagaacagaatgatgcttttccaacacggtaagaaggcgttgagtctcgtcttcagagagcttgtcactgattatgacaggggcttctttgtcattgtgttggaaagcatatcgtaggcctgggggtagaggtttaagctcgagcggaggtcgaggtggtggttccataattggtaggtcgagagtctcaccgggatctgcttcttccttgatgaagtcggggacctcatcttccagaagggcctcgggagactcatgaggaggaactgcagtaacctcttctgctgactcaatttctaggagagtgtcggtcaaggtgatccttgcctgcgagaatggaattgagaattcattctctccccgtgttattttgaggttactaatcggggtgtgttgatgagaagttgctcaatgggcagcccgactaggatatcaaagtattggatttcaaagacgtggaaatccaagatcgcctccctgtcttcaaagcagacaggcacatcttgcacaatcccaaatccttcgatgatatttccgttcggatgcttgaagaatttggttgtcggggtcactaccttatcgcttaaataagcgaatgcaaaagattcagagacgaggttggccccgactgttggactgtagagaatacctacgtcgttcccttccagatggcaaggaatgattcggggagcggtatttatccgaattactttggatgaaagctctgcctcccttagccattcgtcgctcattatggatgtcaactcccggacagtttcttgcaggaacccaagttccataggatcaggaggtgacaaaggaacgggtggttttctcttgctaaaatagttcagggtattgccgtagtcttcgtcaaaaccttccctgaacataattgtggcacaatccggaatctgaatttcttcattctcgacggacggctgctcaggaaccttctcattaatcgagctagtagaagtagatggttcagcaagtggctcgatcgttagaggcacctctatcttggacacggatgcctccagctggggttcattggactgtgtcatgaaggaagtgttttctagaatgtgatccaaaatcgtttttccttctgacggcgttttatgcatgaacgatcctccagcggttatgtccagatagaatgcagactcatccaaacccgtatggaaatgttagagaagcacatactcgggtaaggacagggttggtccggactgcactaagttagtgaatctggaccaagctgcaccgattgattcgtttttgatttgcttgaaaccgagaatttctactcgaagggcagtaatacgagtaactgggaagaaggcaagacaaaatctgtctcgcatcttttcccagctaccgtttacacatccaacggtggaggtgtaccattgctttgctctctcttgaagagagaacggaaacaatttccaccgcacggtttcttgtctcatgccacgaatcttaaggcatgagcagacttgttcaaagtctcgcagatgatggtaaggattctctagatcaaaaccagaaaaaggattttccttaaccatactaattagttcgggacgaatttcatagccagttgtataaatgggctccgatgaaggaggtggctcatagaattcgccccgaggagcagacagctcaaaaagaggttgctccatggtcgagaagagttgacaggaatacttctctaggatagcgggggtgaaggtagaataaaaaaatgaaaaaggatatgaggatgaactgggttcggaaatgatcagcaaccgttccccggcaacggcgccagaaatgcttgttggtatttggtatggttacagatagaatccgtaagcgcacgaatataccaatgtagcacttcccctacggagtattccaacggtatcgaatccaagggaacgtgtgtgatcagagcttcctctggttcatctaaggacaccaagcaaatgataggccaggatagagaggatttactagtgagaaatagtgtccagggaatcctaacgcaatacttcaggcactgtcaacccgctgttcccagatgtcgctctactacgtacccggacagggaggacttcagtgatctcgagggctgtcaccacctttacacccacctcaaatgtattatgggatacgcaacaattactggataataattacctaaacaccacgtctaagcaattaatatctactttagtgtttataactcaccaaagcaatcactatattttagttgattatagtgaacaataatcccgtacgctaattaggaactaaccaagagataattctcacaaggtaaatctaaattgctcaagaagaatattatattgaattcagagtaataaacagaataaaagaaataggagaagattaccgacaactccggaattcttccgactccttctactctactctcttcctattctagtatacaatataatacaatagagcctcttataattcagctcaagcttggaagtgtgtgtgtgaagtgagggagtgatgtctttatataggggtatgtatgacggttggtgaaggggaaatggctgaaatgccccacaaccgccattaggagatgattaggaccgtccatgccaaaccccagcctggatggctgagattgtggttcggccgaacctgggctaggcccatctagcctggctcttggcccatcttctcccctggacctccactatccatttctcggagttttgggttgatttactggtatttggatgaagttcacaacccctccttgtatggatacatgattctcctcactgtagtctgattttcctcccaacatcggggtttattgtctgcatacaaatatataccaacacttgtggaatttgtgagattaatcacatatctctatgttggatgttttattatctgatctttatacagatgttggcggtataaaatcgacatttaacagctgcctacagccgccgaggagatgattgcagccatcagggcaaccaccgctgtcctcaaggctacatcacctacaacacccatggcatcacctcctctagcacctaccaagtgtttgacggaatgccccaacaacaacatcacttgggtggcggcgaattcaaatcacattggtgagatgcttgctccaacagctgcctgggagctaggagacaggaaggacatggaccaagctccctacattgccaccaaggacctccccaaggtcacgcccaccaagtgttcgacgctatgttctagcttcgacaacaagcccgatctcactgtggctgtggtggttacttgtgccacctctgtcaagtcattgatggagttggtagctactgacagcaccaccagcggcacccacatcgacacccctgatagtaccaaggcgatgcccaccaactgtttgatgtttggtatgatggtcaacactggtaccatccagactggggttgtgttcccactctttcttgacaagctggacatcgtcacagtgctaagttagcccacgctagtcagggcacaaaggttgggttttgttttcttccttaaaatgctggcgcccggtgggtgttcgatgaaatgtactagagatgacaagttgctgatggagtatttcaacaaaaatccatggccaccaccttggttaggtggagtgtttagagtatgtgggctgaggcctttaccatggccgggattcaatttttgtaggacagtggaacatctagtgccaccatggccacctcccactaagtaagtgtctttctatggtaatttccaatattgtggtgcttcccactgtgatgatgattttagcattacattgggctggattaaaaccttggcctccaccccatgaagatgacctcacatacattttggtgaatcaaagagaagtggagttatggaggacaattttggttgatcacaataaggaaggattattgatgatcattgagttgtatgtcctagacttaaatgactgctgcttaagttggagtcacttgattcttgcaagtgtgcttgttgtggagctgagcagtactaggcagtgtggttatgagatcatttccttcaaaagcaaccatgttgacaagctgaaattatttggcatgtcaattaatgttttggaacagtgtgaacaccttgaaggggacttgatcagattaatcatcaaagaaaagctgatgccatggaattctggtatggggatctgcttgtgttgtctattggtaatacaacttccagttggcaagctaaaatggaatgtctctgtcatttcattgttccatcttttgattactaaagtcaacgagtttccaagagggatcacaacaggaggtaaatcaacattatggacatcttctgaatgcacttgtgttgggctgcacagaagatacccagtgttattgcctttctggattagcagagcagaaaaatgggttatgagacatattggcatgacaatattagttcctgaatcatggcagcaagcaagttacaaggtcctatatggtgcagagaagttgttaaatttgaatgctgaagataaaagttacacgagggtgaagagctttgaggaaggtgctagttcagttcaatataaggtatgtccttttgggctagttcctgcatcggtggtacttgatgatgtggcgtatactacttcaggaaccacttggcattacaaatgcttgactgataaaatgagaatgccgagagctgaagtgaatcataaaccaatgtggactcgatatttgagcaagcaggggtgtcactctttgcagcataccaaaatgttgagccttaatgttggcaagaagatcaatacattgctcctgctatatgtcacacaagaaagatttaaagggattgagaagttatcagccaggggagccaggggatatatcttattggcttgggacaagccaaatttaaagaagaggggattgtcatgtattgttgggttgatcatgagcttcgtcgactattctccaatccagcccaacaaggcccaactagagaggcaacaaagcagcaccaacaaggtgctaggaagccatcgaacagaacaggcatcggcggcttcggccacggcggcggcggcgtcctagttccgggctggaaccttggcgatctctctctacctctcttcatacctccagctacctatgctagttctagaagcttccagaacttgtattccctagtttcttcttctctttttcaccccaaaacaatggttgcttgtatggtggatccttgctattgaattggaagaattgggttcctaacaatctgtcacatccatcttactttactttcagccttctctagctcttactttccaggagaagattattggtttgtgtgccttatgacagaaggcggagacatgtaaaccatttttattatctaaaaatgcttctaaaaatcgatggtagtgctgggatattgttgcctcttgccattgagaaggattatatctcagttgtacaactactcgctgaaaaggacatcagacctggtattcctggttagagaagcaaaacggctttgttcgatcattaggagaaaggatcccccactcctgacccctatttctcctgattccgacagttcactttcggcgaggtcccgcaggagggatcgccaattcgccatgagaagagagctgatggcccatcctctcgtacttatttcgtcgaacatctttcgtgcattccggtggccggggcatttcatcgagcaccaaagcccccgggactcgatccccacggcaagcgcagctcccgtcgagctgagcagcagccgcgcgctctgctcaatgccgccaccgcgtttccgtacatcttcccacccggccaccaccgctgccacatgatgtttgcgcctcgagatcataccgctaaatgacaacaacagtttgcagtttcgtgcgggttgtggccggccgcgtggcacaatggtgcaaaactggctggtattctatctatttctaattgggaaaatacttatcgtgttgtgctagagttatgagttaatgactacacctattagaggaaggtcaatagtagcgctagctaccggtgacaaaaataccatgtcagcatgttgcagctaataatcaaaactagcccatacagtaagtgagctacactccatctctacatagcttccaatcactatgccggaccatgctagctgtgacgggcctaaaccatcacctctgacggattcagcccctcgacagagattagtggtcagtgatgactctcttcacctttgacgggtaaagggccgtcagtggtgaccagcccctatgacgggccacgtatagaacccgtcacaggtaactattatctcaaacggcccattagtttgtgagccgtcagtgatgtctataatccagcaaaaaaaaagaaaaatagattgcaacccgtcacaggtgtaaaaaaaaccctagcaagaaaattggagcacattgtcaccgcatcaccatcgccaaaacctcaaattgacaatatagcaatcactgacagttcatcatcctccatcaccgcatcaccatctcatatagcaatcattcacaaaaggggatggcaagaatttatcatacaacaatatcatatcattcacaaaaggggcacactggccgacagttcgtcgtcctccatgacgaaccagcgacgtgagatgcaggtggaggcgccaaacaaaaatcaagaaacaagaaaccaccattagagcccacattctcaaaccaaacacctcaaatcaacaacaataacaacaacaacaacaacaacaataacaacaacaagatttaagtaaaaaaataacaacaagaagaaacctcaccagggtggccggtggatagggatggaggaggtggtacctagcattcagatctgcgcatccccggcctcgtggaggtcggatccggcgggtagcgcggttggtggtggaggtgagggaggcgtcagtggcgttggcggccgggaggcagggggaggcgtcggtggaggtggaggcctatgtggcggccggctagcgcgggcggaggcggaggcgtggttggag

SEQ ID NO: 64054 - DNA, 2850 bp, Oryza sativa
gcctcccctcccgcccctgcacagagaaagagaggagagatagagaagaaatggaagagatagaggagaagtggaggagagggagccagccttatctcctcctgtgggccccgcaagtgtatgattcggatatatatatatatatatatatatatatatatatatatatatatatatatatatatatatatagtggcagaagtcatctcaaacaggctaggacttcaagccgtttgaggtgagtaaacctcacctctgacgggccgtccagctgcgacccgtcacaggtaactagtcacctgtgacggtcatcagtgaccatttcgtttatccgtcacaggtatcccgtcagagatatgagaatctggtgtagtgaatgatagttttcctatcccttctttctatacagttaaggccaaaagctcaaacctcgtgcttccacgtcatcatcaaattatgaaccgttgaatgaatgcattagattgcttctcagacgttggatgaaatgcaacatagaacccaacccattagtcaccaggtgagtctcttcgcctcctcagtatcaaatgtagcacatatgaacacattggcccctctctatacacatttacatgtatccaacccgtcaatccgtataaaagagctttacggctgaacgctccttcagttgacatgtgctacctaaattatctacaaattttagatagggctgctaaaaagaatttctccaagaaatctatttgtttcttctgtttcttcttaagattgtacttcctatctaacaaattgatgttaaccaagtcctgcagcaacgcacggggtatcctctagtttttttaatcactgtttccctgttcagtcacgatattggattttggccccccacgtaaaacattattttattgatacctgtgttgctcgcgcgtgaaaaactgtgctttattctctttccttatttctcttatttctctctcttccacctaggaattaaatgacgtggcatattttggagcctgccgagtcatccatcctattgtaactgctcttaggatttaaatcttgatattattgaatgtagatttagtggacttcaacaaaataattagtgggatcagatatacgctactggtttcactctatttgaaagtgggttaagggacacacttaggtgtgtgagcgtggcgtgcctgtgtggtgatgtgtgcgatgatgataataataataataataataataataataataataataataataataataataataataataataataataataataatagcacatgtgaatgcatgcatggtggtggtgtgcgtgtgcgtcatctgtgtataaaaaatatataataataataataataatacttatatagcacgtgataaaaaacaatctatctgttttaaaatataataatctagatttatatcactgattagtactctgaatcttaatcttgacagactcaagatatatatatggttttaatttatttaaatttgtattataatgttgttatattttagaacagagagagtataatatactatacattcttgaaatgaccttcacaatcccatcatctcttgaagcttttaccacgaaacttgattgacatggtatgtttcatggaaatacatccaacctgtggaactaggtgaagattgaagagcgaaaaatttcgtagtgttcgtaacctgaaactgagtacccccgtatgccacatgtcggaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgcatgtatatgctagttatatgtgatacttataatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatatttcatatgctacttatatatgactattcgaatttttaaaaggtttaaatcatgcatgtggcatttacatatgttaattagagtttttagcatttaatttaatataattcctacactaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatacgtaagcgaaaatcatatgcagtgctataatctttagtcccggttcttaaccctaaccgggtttaaaaagaatttcgaaatagcgggaaaagatatttacttccggttggtaataccaaccgggactaaagatcatctttagtcccggttgttctcaacaaccgggagtaaatatct

SEQ ID NO: 64055 - DNA, 1335 bp, Oryza sativa
  unsure (1)..(1335): unsure at all n locations
attcctgcaccccaattcagtgttttttttttagaaaatgggataaacccggcctctacatccaatcggatgtacacagccaagaacaattcagtgtatagcctgaacgaaatgaaattcaatcagggcaacagatcatacattctccaaattcacaaaaagaaaattccacgacccaagtgacatcgcaaacgctagtatagtagagcaaaattgcttaacactggaaaaataatatgtgtctatatatacaacggacatggtcagctacaaacaatagctgaccaaaatcgcctaaaacaagaatcatagctagcaagaaccaacaaatgcgactcagaggtcggttgaactggttgacaacaaatattcaacaaatgcaatcacctaatgcttctagtggattttcaaaaatacaagaataaatggcaattcttcaacttaaacagaatcaataggccttgtttctggcttttctccatctacaataaccttggacttcagcaaatgagagttttgcctggatgttgaaggagctctcttaccaccactggcagattctttcagccctaggtaagtgtagactgacatgcctccaagagcaattatagctccgcaaagactggtgaatccaggatcagagttaaataccaagtaactagagagcattatgacaatagtcttgaattggcctagcacaacatgagcaagagcagaggttgcgctgcatcacacaaaatccagtgaaatagttaagttcattccacaggtttcgcaaactaggataagtgataaaaactacatttttccaataaatggacggaacaatgtcctatatttttcgggatcaaatttgggtgagttttgcaaagctgctgatgttaacctgacataggcattctgttgtcagttgacattctatatgtcaacatactgcctaagtgcctatcagctataatcatcagttgtaacatgaagttacaaacagataattagaggcatactgcaaatccttgcagttcaattttatgagtctatttgacatgaagaatgtgatgctaccatgtctaatgatctaggcaataggcatgcatgaacattttttcatttgaaatataagatattgttggctagctgcaaatagcaccagcaagcgagttaaaaagtttcagagcataaagccataaactactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64056 - DNA, 707 bp, Oryza sativa
ctccaataatattacatgctaagactaaaatagtcatctatgctaagtgtttcgtgcgtatatgctaagtctaattaagactacaatagtcaattgctacttgtcgccccaattccgtagtcaataattatacatactaataagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatattgcatttcacgttaacgttcgtcctcgttcgttcgctcgttcatgttccctagctcgttcacgttcgttcgctcgttctcattcacgttcgttcgcttgttctcattcacgttcgttccctcgttctcgcttgtcttcgatcgatcgttctcgttctcgctctcgttcgttcgatcgttctcgttctcgttcacgttctcgcggcaacgtacgttgacgtgttcgttctcgctctcgttcgttcgatcgttctcattct

SEQ ID NO: 64057 - DNA, 4457 bp, Oryza sativa
  unsure (1)..(4457): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagacttgacactagttatccttatcatagcggctgtaatttctctggtattgggcattgcaacagaggtgactcctataaccatcctcctttcttatatttcttatgcactgtatgttatctaactattggttaaatattattttcccttctgatcttgaaatccaatttcattaatgtccacaaacgatggtttagttgagcaccctcactgccagcaaaacttttgatcagtgttttctttagttctaagttctgtcttaaaaaaattcattagggcatcaaagaaggatggtacgacggtgcaagcattgcatttgcggtctttcttgtcatacttgttactggtatgctattcttcgcctgttcatctctatgctaattgatcttctctaagcagttcaatagttgagatattaataggtgaatacaccatcattatactttacttagatgcaaaccattgttaaaggttctttaactttttctgaagtttgagtcatgctttaatttgtaatgataaaagactagatgttttttgtgttattctttggcaaagtgattgcagtttatcattagctcttttaaatagaacaccacttctatttttgtcatgtactttttttgaacagtaacaaataatactcaattactgcaataatggagttatgatagacgtccccaaataaattattacacataaggcttgtacagaacttgttatgaagattcaaacaatccaagtctaaatatctcaggcacccttagttacattatgcacaatacaacgaaaaggcagctagagagtgtagatgctttccctgacaacaggcccagtaacccttcttcacaaatcattacctattgcttgtttggttgagccacttccatatgtcagctagagagtgcaggtgctttctctgacaacagggcaacaggctcagtaacccttgttcgcgaatctgctacacgacattattacctattgcttgtttggttgagccgcttccatatatcagtatcagacgaccctctgatgttcccaactcgcctatcctgattctgttaactgaagcctgcacgctattccaacgcctatgcttgaagagtctcagctctagccacaatagcttgcttcacaacattcttttgctgtccgatatttcattaagaacacactgtatgcaattttctcaacagatctaatcaaattgttctcaaagcatgctcagtttttagtttccacgttgtttgtcatttactaatgtttctgcagcatgttttgtttttcccccatatccttcatttttcaatgttcaacatttttttccttctgcttagcaaacccatgcaagacactctagttggaataatttagttgctttactaaacactcattttgttttgtattagctgtgagtgactacaaacagtcccttcagttccagcaccttaatgaagagaagcaaaatatacaagtggaggtgcgccatatgaatatacccatttctcagataattagcaacaatattttagtcctctaatgggttgtatttgtgttacacttgtcaggttattagaggtggtagaaggatggaagtgtcaatatttgatattgtagttggtgatgtagtggctctaaaaattggtgaccaggtaagattatgtaaatccatgcattctgatttgatttatgttctatgctgtttgtatttctgagattataatgaaactaaatacaccttttaggtcccggctgatggtgttttggttagtggtcattctcttgccattgatgaatccagtatgactggggaaagcaagatcgtaagcaaccttttcgacccctattgtcctatataggactgacttccccatcatatgtaaaccctgtttcttttattaggttgtcaaggaccataaatcacctttcttaatgggaggatgcaaagtagctgatggttatggtaccatgttggtaagtaaccatatcttgattcaatggcctcactcttccactttttttcttatgaaaattgcatgcctgttaacaaaaagaggcaatttgaggcccatctgtcacctctgatcatcgatttaagtactgctgtttagtccagtaaattaattcacaagctagagtaaaccaattcggtggactttttaacagaccctagtgaaatgatatgaaatttcacccctacttacacgactgaagtgcaaaaatatcaacgtcattactttgtctcatgtatgttagtgccttataccctcaagaattaagtttgtgacgttttttttctaacatttgtaatgtggtgtggaagtcttttgtatatgaaattttgcagtttcttttgtaggtaactgcagtcggtctaaacactgagtggggcttattgatggccagcatctcagaagacaacaatgaagaaactccactacaggtttttctccaatccctgtgctatgacctgaatgggaattgtgggctggtttggttttgcactaccaacaatttggcaacttcaatatgtacctattatgtgttcgcattgaagccaatatttgtcaaatccatatagttgaggcacctctatcctatccaaaatttggtagggtcaaaacttgcccaagatttggcactaccaaataaccaaaacatgatagggtagagaaccaaacttgcccggcatttgaacagttgcccatgccatcatttacatcttatgattcattcatgttcttctcttttctgtggaaggtacggttgaatggagtggcaactttcataggtattgtggggctttctgtgcgcaatggtctatagcgcctgggttgcaaggtaagcaaagtgaatggctatctatgcatcttcttgatgtaaatttagtatagctttggtgattaacccatacaagcaaaaatcaaattgtcggcatgacactttttaccactaaacttatgcgttttgaattgtactggaacctggagtgcaatatggcatatcattacactgcttggtaaagcaataaagtgctcactctgcaatgattatcatctgaataacttaaatataaactggactatacatgaaacagatgaaaagagacactactgcacttgtaacaaggtttagtctctttgcatcctccccccatccccgaccaacccccaccatgatgtatgatccccaccacaatacatgcacacacgcacaatgatgtatatgatccctatattgagaaatatataagatactataattaggaatcgccatcatgattgtgtatatatgtaatatatgatgtttgttgcccatgtatccactatgtacttagaacttctcctttgctcccagatattttacagggcatactacaaatccagatggctctattcaatttgttaaggggcaaacaagtgtgaaatctacaatttttgggacaataaagatactaactatcgcggtatgtagtggtttagtgttcagtgtatctgaagacccttctgttatcccattcttatattacaaagtaccatgtaggtgactattgttgtcgttgctgtacctgagggactaccacttgccgtaactctaacgtgagttgatataggttgatgttttcattcatgtttaactttatttgaatcattcaacctcttgttttattttatcaggctggcctattcgatgcaaaaaatgatggcagacaaagctctggtatatatttctcggttttgtttatgttgtacccttttggttattacatggttccactcatgtgattttcaggtgcggaggctttcagcttgtgaaacaatgggttcagctacaaccatttgtagtgacaagactggtacactaacactcaatcaggttagttgtttttgcatagtaatggatatacaatttactctaatactcagttgtaaattaccatggtacctttgtgattatttgactctgaattttggttgcttaagatgaccgttgtccgatctgttgttggggggataaagctgaaatctccagctgatattgagaatttgtcgcctgttgtttcctctcttatacttgaaggaatcgcacagaattcttcaggcagcgtttttgagccagaggtgatgccacgtgtttattactactgcagtttacatacctgaacattgttcattattctaaattaggctattcagtagctggtagatttggtagattctagttatctatttggtaggtatttaacatcctggtctgatttttttatgagttgcattctcttgaag

SEQ ID NO: 64058 - DNA, 712 bp, Oryza sativa
attcctgcagcccttcttcctgtgtcgtcaatatgtacatgtacttcgatagcgatgaaatggcaatgggccttatctcaaatatggctccctagaatttgatgattacatgctttatttttgttggttgattggcaaaaggttcatttctttttcaatttaatgttatgtatattcattgcatctccactattgcagtttagtttttttccaaacatcttcttttacttgtctaatgtctatgataatatgatataatatcggttcagaacattttttttcgtgattttagaatgtaacaaaaaggatcttatgtatcagaagttctcctatttgttaacagacattcttgttgatttgtttgaacaaaaggtcttgcactgaaatgagaaaaccattctttacatagaaatactgcatggcaggttgagcatgctctgattactcagtaatctgaaaaacactatgcttggtttatggatctagtttagctagagtacaaatattttcatgatttgcaagtgccttctatttggcatgtaacacgctgcaaccttataatattgtttgcattcaggatgattcagatattcatgtgcactggaaaggggctgctgaaattgttcttgccttatgtacaaattggcttgatgtaaatggcattagtcatgaaatgacacctgataaggtattaaccacataggaaaccctt

SEQ ID NO: 64059 - DNA, 1838 bp, Oryza sativa
tccaagtgacaaacttctcctagtaaaagcactgaaaaagaaaggcaatgttgttgctgttactggagatggaacgaatgatgctcctgcattgcatgaggtacatacataattgggaattttgttttgaacaaataaaaggataaacataatggttttatttcaatcagatgaagacaatcgatcatgcatgttgatgcacatttctaattttgatctcttattcctcctaatttaggcagacattggtcttgctatgggtatccaaggaacagaagtagctaaagaaagctcagatataattattctggatgacaattttgcttcagttgtaaaggttagggaagttggagcttaataatcttacacaattaatttaacaaatgccttaacatttatccatatgtaacgttctaggtggtccgctggggtcgttcggtttatgcaaatatccaaaagtttattcaattccagcttactgtaaatgttgcggctcttataatcaatgtggttgctgctatttcttcaggaaatgttcctctaaacgccgttcaggtttgcaacaacacaatgctcttagaattttctttgagaggaaaatactcttagagttactgctatgtactatgccatattagtataactttgtttattgatagtttaaaactcaaattgttagccatgcctgaattgccatgactagttcggccactgctctctgtagtaaggccgcaaaaagatattgcgagataaactctgttgctttaaactcttggttgttttgggttggtctgtttgctttgggagttgcgaagatggattctttgagaactttgtttctttcaatcttaatgcaatgatgcacaagttttatgtgcattccctcaaaataaaactagtttgtccacttgctgctgtgtctgaatcattacattggctaatggaaataactatggagtatgtgcttgttactttagtggcaatgtggcactgtacggagtttacttcagtatattatcattttttgctactattggggactgtatcctgcttgctcactgtaccattctttaatcacatgagggcttcacttggaatctggaatttggcggtgtcttgttgaaagcatacctaggatgcaaaaccagttaggacatgaatacgttttctagtgtattctgatatgttaaatcttaaatcaatcaagtttgttgaagggacatttagaagatgtcctgtaaataaagatggggttgaaaaaataattttaccatgggctaaggggaaattgttagtgaaaatgaaattaagatacttaactgtattgatttgcacgtcggcacatggctgaatgttttacttccgtttgttgttgatttagcttctttgggtcaatctcattatggacacacttggtgcacttgcattggctactgaaccacccacagaccaacttatgaagcggccacctgttggaccgaagttagtacacctgaaacccacccgtgctcactataattcttgattgtcttaaatttgtcaaggaataacaaaattctaacatgctttcacatttaacacagagaaccccttgtgactaacattatgtggagaaacttgttcattcccgtaggacggacttgtcatataatgcttctgccttgctaatccaattattttttacttggctagttgctgagaatttttttttctaaccacaggctgtctttcaagttactgttcttctgacactcaactttagaggccgggatcttctgcatttgactcaagatactcttgatcatgccaataaagtgaaaaatacatttatatttaat

SEQ ID NO: 64060 - DNA, 3460 bp, Oryza sativa
  unsure (1)..(3460): unsure at all n locations
gggaaagattggtacccactatattttagccagctgtggtaaacatttgaaacatatctgttctctagcaactatgtttgcttctatgttttgtttccttcgctgctgtttatcagaacaccggcagtaacattatttctttttagttttaccaatttaatcaccttcctttggcccaatttacagataacgaaggatcaactccacctccacctccacctccacctgtgtgattgtgcatgtccaagtgaccaaaattatcagctctgaaattagtggtggtgcacatagatgcttgtataattttgaaggttgacttctaaccatgctacctcttaggctgactgtatactgaggttgaagccaatccgacagatgtttcatcctctcttactcatgaattgggcctgacgccgatgtaaacaaagattaggaacttagacatacacttcactagttggctagggatgagtgtgggctgacccgtggatactcttttacccacactagttcaactaaatgaactaaatttcacttttagaatcacaaaaaatgaaatgtagttcgtttatttggactagagtgggtcaattagtacctatgggttggcccgtggccagtcttggccgcattcatgcatcatagtacgctactgagcacatcttctttcaaagtattacacggagatgtctaaaaatttgagctaaatgactgggaggtttattagtgttactgcttttgatttttgagagctgctcatatttttcaggatcaacatacattttgtacttgaatgctgtacttttatttaggtatgttctggcgcaaattatataatcctttataggcctgttttgactttgatagtagcttgtttgttggaggatttaagctaatctggctagtaaccatcatggcaaactgaccatccagctgatagcttcattacacatacctggtaagtacatatggcacatgataaaaactaggatgttccatagcaaattagtcctatgttttgcctctaatactgatgtatggagtatttctcttgactgaacaaagtgcaattgctagtcgtacaatgtttgcctagagttctatcactagcttgccatttcggtaacttttctagtaacatgcccatctttcagtatatctccttgctttggatctatgtagggttgatgattataaggctgcgtttgagcgcaggagaaagagagaaagatagttttgttttccgcgcgcacacttcccgaactactaaacggtgtgttttttgtaaaaaaatttctatagaaaagttattttaaaaaatcatattaatccatttttgaagtttaaaataattaatactcaattaatcatgtgctaatggctcatcttgttttacgtatcttcccaatctcctcaatcccctccttctcaaacacaccctaatgctttaaggagtcaaatatgacctttcaccaaaaaaaagaaaagaaaagatagcaaggcaatgcatgctatgcttggaaaaaaagggagaatagctaatatagtccctaaagtttcgctcctgggtcattttagtccttaatctttcatattatccaaacaagtcctttaaatttgtcatgtgggctaatatagttcttggtcccaccagaatcgccatatggacatgccatgtcaccttcccatacaaaatctatatgatttgtccaatttaccctttgcataggaagataaaaaaacaaaaggaaaaaagttacaaaaattgttgcgtttttttagagaaaaaatttcgctcagaaggtttgaaataanaantgtgtggtggctatgggctgtgctaattcacctttatattttttttatgatatatgtaagggtagattggacaattcatcatagattttgcatgaatgatgatatagcatattcatatgatgatgttgggtggacccaaagactattctaggccttatgatagagtttaaggatttctttggaccatttataaggttagggactaaacagatcctacagagaaactttagggactaaagtagctattcttaaaaaaaaaaaacaccccctttttcatttgtttacggaggagtaatctaagcatgtcgccgagccacacaataagtaggccacatgcccgtgctcccacccaaatcatggtgcttagtttgcgtgctccctgcattgccctttcccctttacattacatgcaagcagccatgaaaatattacttgtagtactagttacatgacttggtcgctttccattaccgggatcgagatcgtactgatcagcagtactcctgttgctaatagcgaggcagattagcatcggtcgtatcgacgtattgcatctaactcggggtgcttagattaattaagcacaatcgtactacgtactgctccagtagatggttggttcttggatctcgcactggatggagcatatgcgtatgcgtgtctcccggtgtacggacatgatatctcctggtgaagtggtgatagagctagcagtagctctaaacatccggatcaaatgatcaaaatatgggtttttgagacgttctcatgcattgaaaatatgataagccatagaaaaattatggataaaacttttaatcatgtattacgaatctttaaaacctgaacaaacctcctatctgattttcacaataataagatatgttttatctgattttagatcactaatgttgtgcttagatccaggggtgaaaagttttgacgtgtgacatcgaatatacgggcacacatttgaagtattaaacatagactaataacaaaacaaattacagattccgcatgtaaattgcaagacgaatttattaagcataattaattcgtcattagcaaatgtttactatagcaccacattgttagatcatggagcaattaggcttaaaagatttgtctcacaatttacacacaatatgtataattagtttttttcctatatttaatacactatacatttgttcaaatatttgatattcgatatgacatggcgaaaaattttgctaaatagaccctaacatgcgtacggagattttactcctactactctttataagttcagaaagcattaaaatcaccttataatgtatgagtaacatatatcgctacacgtgcttgtcagagccgctccatacaccagcattaatttctagagtatttttcttcaagtatattaattggccgggaacgcgcatgcttgcaagacacgcagattttttttatgttgcaactaataacgaacatcgatcataaatgcaagtcaagttttggattttctcctcgcaaaataggaaaaatgttttggctttcttggatccaccacacaccgaattttaatttggtttcaaaacaaattactccctccgtttcaaaatatttgacaccgttgactttttaacacatgtttgac

SEQ ID NO: 64061 - DNA, 7603 bp, Oryza sativa
attgttggtctcgtctgagcttgaagctgtccatggcgagtggcctaaaatactctggctatacgtacatacgtgcatggccatggagtggtgttggttgcttgcaacgagagacggtttagtttagtaattaattactcctagtttagcttaattagcttactttaatctagtttttttactacagggggttatttgaataacaaactgtaaatgtagttcattattatatcattaccccctagctagctagctgactggatgttcagctaattcaggtaccaattgaatggtcatcactcatcactcgattgatcatgccattacttactttgacaaggaatattgtgcttgcattgcataatatatactgtatgtgcaaaagttgagcaatattatttctttccttacttcattttgagacctcctttcgggaattttacagggatttagttcaatttctcaaaaaataatttctccatcccaagcgtgtggctctagcttagagcttaaactaaaaaaaaagccaactaagacaccatttgatttaggttattgagtggattattctagtagattatctacttattttatatatggaatgttttaaatattttaaaaattaacttaacaaataacttaaaaacaaatgaccttggcaatgtattagaagataacttttttgagaaaacgaatttttcgaaacgtgtactattgcttagatcgcttattttaagttaatttgaagtaaataatctgaaaaaatcgaaaattgattattattttttaataattcagtaaataatctaaaatacctccctttctctcactctgcaaattcatgaatgttgcatgcttattagttaaatactagtagatgcatggtgcgaaatgagcgtaactcaactagttagatttcttttggtggaatcaatccatccggattcaggtcctagatttgaccggatgctcgcttttacgactatttattttttcagtggtaaccgacgtacatacccgtcggcagcgggacgtccgtaataacttcgttaatatcaagagatatcgacacagtcgtccggagatgctaatagggaatgcagggtcagctgattgagagggagatagagagcaggtaatggctggaggggaaaggagagtgtgcactgtgcagagcttccaaagggtgaccccccccttggtgtacctggctggtccttttgatacctaaaaagggatgcatatatgcatgaggcagagagcaatccatgcagaggagaggagaggaggcatgcagcagtggcagaacatactactccagatctggggaggaaagctgcatggttaatgccactcagatctgaaaattttgtgtgtgtggggccgggccattgcaatttgcaagaggggattcaatgatactgtccatggtgaactaacagtactgctgctgtccctgcatttctccctggacaataagctagcgggtggcagaaaagatgagcggcaggcttccaaccccatcatatatgtccctaaaaatgctgccatttaagtccacatggtccatctgatcatgattatataaaagttgttttagttaaattgcaaggtgtatttttattttttaatagaagtttttattgctaattaaactgtggctaatagtttgtcgtcaaatatattctcaatagtttcatatgcacacataagaaggttaattagagatgcacttgatagtacagtggtaagtaatgtgtgatttcaacctcaagatctcgggttcaatcttcaaccagctataaacttcatgtctcggaattaacacgatattctcttttctcatatttttataaagataaaatattgattctcctatcttctaagcctctcatcatttggtagtttatcaaccacagtcacagataaaatttaaacttgaaacttaatttctgaagttgatttttggatatatattttttaattgtggtctattttttagaattggcttttaaatttctgatattaatataggtataaagttattgtcaataaaaattgctttgtctttttctttttcacggtttatctataaatgtgtgtaagaacatggagtacaacagttcagacgaccatcacctacattatgtcttcacatttatggcctacgtgggcgcgtagttgaggtttaatgtgcttcagttcagcttgatcaaacagcacacgtagtattaattggacgcccactcgcgtatgcacgcacgcatgtactctccataaaaaaaagtaaatataatacaagacatgatgtatcctatgaatttagataaatagttatctcgttctataaaaaacaaatataatacgatatatcattatgaatttagataaacagctaatctagatttataattaatattactataatgtatcagacaatatcatatcttataccagattttttttatggggcggaagagtgccccccacccaattaatatggtatttttgtacattttctgcgaagaggcatatgcaagagggcagctagctagcaacaatttttgccgtggctaataagtaaagccatttccctttgcggcctccctttttttacttccttttcttgcatgcccactatagactacaccatcaaccttttactagttctacattcttacacacctagcaccaataataatgatgctggttttaccttttcatttttattttcaaagagaaaatgaagcaaacatgcacttgagagctagctttgctctcattgtactttagttaggacaaataagaagtataaaccatgcactttctaggtatcttaggtttattacatcttattgtgtgcaagttattgtgtccaagcaccacctaatgacatggctacatcataatggaaatattgtaatgcctagggccctcccacgacgatgcatgtttgaagcaaatgtattgtattaataattccctatcttctaaagaaaagaaatacgaaagcaaatactcagaataccaactatattgcagccttgccgtgacagaccaaactgctcctggcaggctagcatagcaggccatgctagacatggttgaaaaggaaaaggaataagttcacattaggtctcttatcttgacgtcgagtttgaatcacatgcttgaattgtaacaccagatgtaacgtttacctcaacttataaaatcggatcactcgaggtcctaggacagtattttgtcaggttttagctaacatggtgagttgaatacagtcaacccagccgagttagcatgggacccacatgtcagtggctaagtcttcttccatctctcttcacctatcctccccatcttctccaaagcgacaaccgatacagtaaagggtagcacgtggcgggaagaagggcatcggccgatgggagaggagctagggggctccgcttgttcgtccctgagctcgatttaatgatagccgaccttctcaccttcttccgcttcatcaagttacgggcggagcacgtgaaagccgttaggcttcttgtttggggagtccatgggcggggccatctaccttctcattcacctctgcacatcgtcggaggagtgggccggccagcacgtcctggtggtgccccatgtgcgagttcttcaccttcgttgcatggttcgcgccgacactccccatcatgcccattttcgacctcaccgagaagtccgccaaggcaccgaccaagtgccttagctgtatgcaacccaatgtactacaacaactggccatggattgggtctttggtgcagaccgcagggcacccccttggagaatatggggaaaagagaggggagatgggaagagaggaagaggaaagcgccggccgtttacatgtggggtttgttgttggctccgccaggttaaacatggtcaattatccatgttaaccgcaatctaggtacaatactgctctagaacctcaattacaccagttttacaagttgaggagcacgttataactgatattgtcgttcaagaacaccattcaaacttaacgtcatgaggagccaagaaatgaacttagaaaaaaaagaacacaacgcccaaatattttcctcgtaggccgaacaatctagcccaaccagggcccaaatatattccttcatgggccgaaaaatataggcccagcatccactggccacagcccaaccaggcaggttgacccgtacacacacgacgtccaccaacaccaaagccgccgcttgttttctcgccctcctcctctcgtcttctcctccaccttgcttgtacccgcatccacctcctcaccctttttctctctcatcaatctctctctctccacatccatccaaccctacccacacccacgcgaccaaaccctcggcgcggcggcggcggcggcgaggaggcgaggaggaggcgtagcagccgccgcgttggcaagcgccaggtgcgggcggatcggatccggggggcggagcggaggtgtggtggtgggggggagctatggcgtacgtggaccacgccttctccatctccgacgaggacgacctcgtcggcggcgccgtggggggcccccgcggcgcgcccgtcaaggagatcgccttcgcggccgcgctcctcgcgttcggcgcgctcggcgccatcggtggcgtcctcatggccgccaacaacgtcggcggcgaccgcgcgcacggtgagcgccctcctcttaattcgcgcgtctagggcctgggcttccatacaatttccccccaattgatgctgtggtagtagagatcttgcgggattctagcttggggggtgtggtttggcttcagtgcattgggttgtgaggatgaaattaagggggttattgtttgactgcgcaatcatccattttggtaatttctcagaggaaatttattattattagtaatttacttctggtattctcatttgattttgacttggtcaaccacatgcattttactacagctgggtggcaattgggggaaataatgtactttatgtatgcattgcaatttggtgacagttcgtagaacatacatttattttaatgctactagtttgttgtcaattacattcattcatgtatcaagtttttgtaatatactggcattttatatccaaaagctccagatagcaatcactggaagcaacagggcttgactgctggagtagtgtttaagattcgaatgggttctctagtttgacaactttataggctaaaaaaacttttaacatttttaagtgggtgggcacaaagtgattcagtcatcaagttttatgtttggtaacataacatttgtttagcatacaataggtagggttccccttgcatagaagatagaacctttgctgttgaaactttattctttctttacctgaagccatttcccttttgttggaacaggaatcttcttcatgattctgggtattgtgatgttcatccctgggttctactacacaagaattgcctactatgcttacaaagggtacaagggcttctcgttttcgaacatcccgccgatctaaagaaagaggtgtatcatacgccgacttggttcatctcatcacgtccaatggcgaacaccatttctcattttcatcttgtctatttcttcttctgctgcccccctttgtaggatgaacttctagacatgtacatataaaatgctactcccataatgtatcattatggtgtggtgagctgaaaggttgtccattgtgtgattatgttgggttactatgacacatgtctgataagaactttatgatgttgtgttgctctcatgctgtctgctgtttgtgttaagataactgaagttaccgcactgtcatgacagtttggtccccttatcagataagaacaccattgtgtgaataaacgttccgttagctttggtgtttcgctcatttactgttgatttaccttcagttgttttgtatctgtcaactgctgttctggaactgtggtctgttgtgcctgatgtgttttactgcaaaaagttgcaccttactcgtctttggaattcagtggattcttctcttgtgtcgatctctgataatctcaaatccacaaatgaaaccgtagaatgatccgagtaatgttgacacagaaaagtggcaggacaacctcaaatcaacagacaatggcaggtgaaagacgatctaaacaatgccttgctttagttactactattacgaaaatagaaaatagggttaacgcttagagatttcagtttttttaacgaacttacagatttcaagtttgaactttaataatggtttaacgcgagaataaagaattgtttcattcgcttgatgaactatggagccgtgtacagtactcgtccatgctaagggtgagttcgaatatcgagaagattggaaagatatgcaaaaaaaagataagctattagaatatgattaattaagtattaactactttaaagtgtaaaaatagattaatatgattttttaaaaaaaaattgcaaaaaacgcatcgatgtgctatctcactcatcattgtccatggaacgaacgcaccctaactccctaagtgtccatccgatcaacaagaaatatttttaagatgggcatattttatatggagtacccattgtccattagagttttacagaaatcatccgcctagattagtccctcagttgcacaagttttttcgatccgcagtgactgacagcaaaaacaagcaatcgattgaaacaccaaagcgagcgaattaatgaaaaaccggacagatctatgggatacagatacaatatttccgcttgaaatttggatggatctagaaaggaaacacccaatcgtgttagcggcctgcgtctctctcggcacttctgcaaagggtggctcgcccatggaatagatcggcagagcacccgttcgtctgagagccgtccaaaacatacaaatcaccatacaaaaaaacagcaagaactgaagaaaagaaggcgatgttttcgattgggggatgatttgggtttgtggccaggtattgtggcttggaactaaagaagatggatctccaaacaatcttctcctggcttaggcatcgatctgggctccaagcggcagacagggcaccattgaaacggcgcctgctgttgactcataatatagagccctattattctcaccaccaaatcatttgcatcccaaacacgattcaaaaactatatcaacgatgcgatgaattgaaatcttcaaacaaacaaaatggaagcaaaagcaaatcaatcgttcaacgagaaaaaaaaaagagagaaaaacacggaagcaattaccactcggagaggaaatcaagaaggaaaaccaagcgaccgagatctgaatgcgcttgtgctgcggcggcggcgagagacaggtgggactgatgggtttagggttctgaagcgccccgtgttttatagacgccttcctcgatgtccagcctataagagtatgacacgtgtcccgtgcaaatctgtctcttcctgggccgaggcccaagcccaacaacaaattggttggatactgattatttgtatatttatttattatttatttttgtgtaaa

SEQ ID NO: 64062 - DNA, 1501 bp, Oryza sativa
tgatgttgtaaataaataatattatatttgtctataaacttagtcaaacataaagttgtttgattttcactaaagttaaaatgacttataatctaaaacggatggggtactaccaatgttgtgtatggagaattactaactgcagtactataagataggtggaggaagaaattattcgtaatttatttgataggattgggaaggaaaaaaaatcatcggatttgctcttcagtcggaatattcgaagccgttcagaaacaggttttttttaaagaaaaaggccatcggaatatttgaacttcactaaagagattgaattggcagttcagaaaagaaaacgatattgaaattagagaaaatttgggaagtagtcaagtagaagaggttttacagttaggggagcgaggagagatctgtactgtacggttgaattttaggtctgatgcatggtcagcaaatgactgaattcattcttctaatgacttctatacgtgatcaacaattgagcatcatagatgctccctttcttcacctgcttggcagattacttttcagttactccctccgtttcagattataagatgttttggctttagtcaaagtcaaactactataaatttaactaactctatagaaaaaaaatagtaatatttacaacaccagcatagtttcattaaatctataattgaataattttttataatatatttgtcttgggttaaaaatattactactttttctataaaattagtcaaacttaaaatagtttgactttaaccaaacgttttaaaatagtttgactttgaccaaagttaaaacgttttataacctgaaacggagggagtacataatttacactttggagttaattttgtaccacatgagagttatttacagatttacagacattgtttgatgatattgcttgctgaacaactagtggttgtgggcctagctagctagtatgctattcacatcctatctcaattgtgtataattgagctaaaaaaaattgttgcgtatacgaaaaattcgtagctgggcccatccaatggaatctgtctaagctaaggcccatccaatggaatttgtctagggaaaaattcctgaacttggccacttcagttgttcagttcttcaggataataatgagctatggtccggtgaacttatcatacaacttctgtaaaaaatgtagaatttcatttagcaatttgtacattgcaactcctttggttcagatgactgatctactttcacagtaatttttttttatacgattacttttgccaactcggattttatgaacctccatttcagtgggcagttaaataaatcaatctcgtaccgaatacgacacatcttgtatgattatgtccagattcattgtatcaggatgtgccacatcttataagatgttggtttattttggaatgaatggagtactacataataaatgctatagtatcctctaggatacaaagtagctatccaagaatta

SEQ ID NO: 64063 - DNA, 4266 bp, Oryza sativa
gataatgattatataattaggagggtgtaagccttgctcttggtggtaccataatgaatcaatggatccaattctcgttaatcattgaccccttttggtagtctgacctgttaggttaggatagtgacgtcagcagcaggcccatgacgggacgaatcgttgaaatcatcatgacaacttggtggtgatgctaagcattccctctgatccttgtggctaaagttgatctcgtctgtttttgtttgtccatcctgtttaaatgcacttagcttagttcggtatacccaacttcccatgatgcaccgaaagatctctttgaatgaacccagcaattaacgccggcatactatgattctattagggatgaaaacggataagatataggtatactatatcttgaaccatactccatccgtcccagaaaaataaatctagaactagatgtgacatattctagtacaatattctagtacaataaatctggatgtgtcacatccagtactaggttggttttttatgggacggttaagtatatttttagcggatatggatataaggcagattttttcggatgtcagaaatggtgtggactcaatttagaaacagattaaatctgttggacgttacattattgcaatcaatataacatcgagttagcaatgggacaacaataaaatgatcaataaatgacctatcgtaataattatatacttaagtgctaaataatatgtatacaatgtatacataatataaaaatacagcaatgcaagtgtgaaatgagatgatgaaagccccaaactaaaaaatctaggttaattgatgaatcagatcattggatagtctggctcatgtcacatgcaatggatagagtgattacatagattgataattctggattattcaacaaacggcttattagataatctgatagatatatcggataattcacatccgttgaattttagagataccacgtttgcatccatatccacattatactatctgtatttgcaactatatccgttagatttcttaaaacccgtaccaatacgaaagtcctaaggggcgatcgatcgctccaagcgatcagtccccctccccacatcgatcaccccctcctccatgtggtttccttttttgcaccgcattacttcactattttagtaaatttatacacctaaagtttgtacacatcaagttttcacatctaaagtttatgcacctaaagtttagagacccaaagtttacaagtcaagtttatatatccgattcaaatttgaatttgaattcaaatattttttatatatagtatttctatacatctaaaaattatacacctaaagtttatagacccaaagtttataagtcaaaagtttacatacccgatttaagtttgaatttgaattcaaatattagtttatagacctaaagtttataagtcaaaagtttatgtacccgtttcaaatttgaatttgaattcaaatatttttttatatagtatttctatacataattttttctaactttgtttttttttaaaaaagttatatggtgtagtaggaagagaagaaggggaggaggaagggggagagagagtgtatagaggatcgatcgcccattaaccacacccgtaccaatatcctttgtttcggatggattcaaagtggatgggatccgttttcaccactacatgctatcgtatttacgtattattcgacaataattgatctgttaaggtcaaactaaactaatctgtcagagagtaaaccaaaattaacctgagcaacatgaaagagagagcttcctttcaccctcgggcagtataatcacataataagggatttcttaattgacatagcaaatattgttttgtttgcttcccaggacacacgagatatatatgagtaagtgataagtactgtcattaattaactattgcattctccaatcaccattatattgacccaatgcgctttcaacaagtatatatactgtcatggcggctggctaattgacgtggggccatttgatttgcaggcctcaggtttgaaggataaggattgctcttaacttgtccccttccaagtgatgctctcactaaaagcatgggttttatgtgcttcaagcttcctctttttttgaaggacaagattgtgacttggcatggatgtcattgtcgaatcaatggttttattaggtttttgacgctttggtttgttggaaaattgccaggtgcttgacggctaaggcaatgaaattcggtgtctcctagctcctgtcatgttcctttgctttatagttcttctttctctccctctctctttctttctgtgaggatagctctccttcttctcgtggagtttaattgatatcaagtgatatagcagtgatggacgcatgtttaaaatatagatgggacggtagagctagccctaattaggtgatggcacaacacacacaaatcttagtcgctggttcacggcattggcgcaacaatgcacggcacgaacatcgagaaagttaacaacgaggattggtagtcgaacaaacgtatatgacttatatgtagagagataaaagaaaatgagaaatgctgttagacaacaaggggaaccactttcaatagttcgggggtataaaacgagatgaaaaattatttaggggtttaagtgcttcgtcaaaatagttcaagtgagtaaaatggatttttttaatatatttacctatttactgtagactgtattatgcactaaagaaatagaaagaaaatagaattttatgtacggccaaaatcagaaacgatcaaaatggtattacttatacacgaattttcataaatgtttttgttcctacttaaaatacttgatttatctgattattcaatagtagactaatgactaatgttggaaataggactaaaataaggtttcggggtgtgggacgacacagatcgtagttgggccggccgacccaccctgcctaatgggtgtgttcgtcactgagtgataggttaattatattataatactcttgtaggatgtttgttaaattgttactaccaaaattagaatcatgtttcgataaattcgagttacaggtggatcgatgggctaagtatatccttttgtatcacaaattcatatcaatcctcaacacaaaatatctaaaccacctttgagcaacacactttttttctagctactttgttcaaaagttttgaaaaggaagtgcctttcgtgaaggcatgcacaacaagcacaagacatttgggtgcaatgcaaagttgcaaacgtacatggatatacataacggcatccaaagctgcaatctcttcctttttcgtgtgcccaaacaactcttcccagggacaaaaagccaaaacgccaaatgaaaaacgaatccaggagcccaccccacgagagctccacgtcagcgctggccccacacaccctcccaatccagcccagccgagacccacgtcatcatgggccccacacgacccctcccctgcactgaatgcctcgcagcgtgcagaacactcgcactactcgcgttccataaaaaaaaataatgtactcctaatactaggaaaccgaaaagtatcgattcgtattaataaaatatgtcatattcgatactagtttatttttttatgaaacggagaaaatactacacatggcggttcctttgttcactttcttaactctatctttctttttttacatgttttttaaaccactaaacatgcttactaaatagtatatttttatagaaattttctttataaaagttacttcaaaaatcatattaatttattttcttaattttttaatactactctatcagtcccggtttagttgtcgctggggtgtagagttatttcccagaaagaaggtcgtttagctgtggggcagctagcatgctagccactagcatgagtacttctattaattttcttccctatacttgttgccgacatatcgaaatgacagacgccgtactagttttgtgttaattcttaagcattgaaatgattaatgtaggggtatgtaggttatttttccaataccatattttgtcatctcctttctagaacggctagtaaaattggacggagccaataatacttaattaattatgtgctaatgaataatactttttagaaagatgaataattttgtactcacaagtcacaagtacaaatatcccctgctattctgctcgattttttctcctctcctttctcgcaaacgccttttcttctct

SEQ ID NO: 64064 - DNA, 12380 bp, Oryza sativa
acttatatattggccgaagttatgttgttttggtatgtatcctggtcaggttttgtgactatttacttttctttcattgtagaaatcttagcaacaacaatattggtggaactataccagaagatctacctgttacactgcagcatttgtatgtgctattcttcctcttctggaatttttttagctcttgtgattgagtgatgagatgccttatgttccttgctggtgcagttttatgtctgataaccagctcactggaagcattcggacgtcactatcaatgcttcagagtttaacagacatgtatgactattgtcctatttctgttcctaagcagagaggttgctgtactattttttttctgatctgtctttttgtaggtctctaaatgataatcatctcgacgggaaactgccagatgcttttggttcccttactggccttgtaaatttgtaagatacctcattttcctctccttttcattttgcttattcttactcttcatgtgcacttgctcatgcacctgagagtatatcatatcttcattttccccaagacccgagagggttggcaggcaaggggtgaactgttaactcgttcataacatctagcatttgaccacagtgatatttcatccaataacttcagtggttcattaccaccttctctgggaagcctgtcatcattgactacattgtaagtctacaagtattttcttatatagttttttccctatcatttttacttattttcatgccttgttattttacaggcacatgcaagacaacaaactatccggaacccttgatgtcttgcaggatctccccctcaaagatttgtattcccacactctctattgtgtcatcatattactgattcacttttattagtacaccattatgtataaattggacaatcagcaattgtattctcagttatgtgttgatttataaaattgatctgcttaacagacattttcttctggtctactttagagatgtcatagtataaattatgattatcctgcactttgtcattattttgaagtaacatgcaacaatatgttagcagacacaaagttctctattattcaacagtcacattgaatttgataaggttgtagaaacttgacatcctttcacaaagtacatggcagtcatacatttgtttgcagaagtataatgtaccatgtagtcatgaccagaaccgggacttttaggttttaacaaagctgtactagttagaaaaaagaacaggtgatgtaagtgatttagcttttatcttatcatagacattcacaagtcaaacagtaatttaaatccaatttgttatgtatgtctaatccagatcatcctttttcttagaatgctgttatgcatacaaatatgaaatatctacacttgtttctgataatatatttacctgaaacagaaatatagagaataatttgttttctggaccggttcctccaaagttgctgaatgtgccaaacttcaagtgagaatcctttttcttacatatttcaaatttattgatgcaattcacatagtacttggtattcctacataaaaattctctctactatatacttttgccatatgtaattatatgtaaggtaacttattgagtaattcattgtttttgtctacagaaaggatgggaacccatttaataccagcatagctccttctgcatcaccctcttcaacacctacaggctctacaccaacacaaacaccatcgtcaccttcatcttctggaactccttcgccatctagttcgccctctaattcttctggtggatctactgctcgagacagcagctctccatcatctaggaaacataagtcttcaaccctcaggattgttggatatgttcttctagctattgtcctgtttatagttacagtgctgctggtaatattttgcctgtccaagtaccaagagagacagtcaagacgtgattatacaacaagtcaggtggggagggttcatcagagggttgaagagcggaaagttaagcaagcttcagtgcagtcaaggaatgatgccaaaaaaggtcaacaattaatttatatattctgtaatatatttctgattatattttatttgttttatatcacagcatattgatgttctattaacaggatcaacagaggttcctgaacggaggcaggttcgtgaaataaatttggcggtaccaggtatagatgcttgtaaatctgatctatcaggtcttttagtactgtaatactattcacatttttaagttcagatgtataaaataactattcaattgctggcagctgctctcgagaagcctcctgaaaagagaaaagaacatgtaattaacttgcagcgatcagaaacagaaatttttgcttctacacctccgccgccgccgcctccaccaccaccacctcctcctcctcctccgacaccaccaccgccaccgccgcggccgccgccgccgccgccaccaccaccacctgttgaaaaagtgattgtaaatcccattgttaagccagagaaaagagttagtactccacctaggacaggtccctcgacatctgcaacatccttttctgttgcatcacttcagcaatatacaaatagttttgaagagggaaatttgataagagagagtaggttgggaaaagtatatctggcagaacttcctgaaggcagggtatgtttacaaaatactgcttcatttaaatggaattttatgattattgaaatgctatactaatcttcctttatcctatgcagtccttggaagttatgaagattgataacccccatgatagaatacccgtagatgaatttctagaactggttgcaagtgtatcagatattaggcatcccaacatcctcgagcttgttggatactgtgcagaatatggtccgaggttactggtttataatcatttcagtagaaaaacactgcatgatgtactacatgaagggaaggaattggatggtgcactatcatggaatgctggcctccaagttgctcttggtgcagcaaaggccttagagtaagttaccaagctgtatcggggttcaatataattaccatgaacttgtgcttatttaatttagtttttcatggggtagctttggtacttatattcttctttcagctatctacatgagagctgtgaacctccagtagtgcaccagaattttgagccagccaatgtgctccttggtaatggattctcagtaggtgtcgctgaatgtggacgggcagaattgacgctgtcaggttctgttacacaggtaacatctagggttgtacaccaacctggtggttgtgatacttgggcttttccgtcgcaagcagttctgatacatttcctaaaattcctgaagtccaattaagaagagtaaatttcagaaaactacatatactttgatcaaactatcacaaaactatagatttaaggcggtgcatcacaaaactacagatttaggaccgaatttatcaaagaactagagatttaagatggaagaccaccaaactacatatttagtaataaaatatcacaaactacatgttttgtagcaagttaagtactacctccgtttcaggttataagactttttagcattacccatattcatatagatgttaatgaatctaggcacacatatatgtctagattcattaacatatatatgaatgtgggcaatgttagaaagtcttataatatgaaacggaggaagtacaaaactataacatttataactcttaacatgatagtagtggtagggatttaaattgtaaaatatgtagtttcgtgataactctagtattaaagctgtagttttgtgatatttggccttaaatctgtagttttgtgataaaccgtgtgttaaatacttaaatctgtagttttgtgatacaacaccttaaatatgtagttttgtgataatttaattaaagtacctgactatctgtagtgttgtgaatactactctttataatttgactgcatacgagtaacaatccagtattcaagcacctaagcagctctcagggcatgacagctactaggtccagtgctacaacttccttccaaactagagcagccttatccacatatttactatcgcaggaaagactattgaaagaagggggttaaaattttatttatcttaagttttagattagttatgttgggccttccagctaccagcctaccatgcacatccaccacagcagtagaactcgcctcaggcctgaaattgatggttgttccctcgatttgttcataaggtgttgtcttttggttaggattattttcagttaagaagcttttagctgatgtttttaggagctggttcatttaagggctttaacaaatatcagttaagcaagcaaagaaacaagcaagttcgttcacatctctggtctggttgccccattgcatctcctaatgaagccattgctgcaaggatgtcctctctgtggttttaacttagaatggtgttcttttattccagttgtcaggtcgcatgagggcactgctgaattatgaagctcctgaaatccatgaagctgggacttttacctaccgaagtgatgtttacagttttggcgtggtaatgctagaacttctcactggccgtaaaccatatgacaggtcagtgattcaccgtaatatgcatttcttaattttagtttcataattgtgttagatcaattgtctccaaatgttgtctgaactttctagtttgcttgcttattttccgttacaatatgcagttctggtcctcgtgctgaacaacatcttgttagatgggctgattctcaatttcatgacattgagtccatatcaaagatggttgatccttctattcaaggagagtgttctgagaaagtactgtcacgttttgcagacatcatcagccgttgtattcgggtaatcaaatacttccattatcttttgagctaaactgtagtttctagtttctagcataatataagatagtacatgtgtcacttccttaagcatctctatcaggattttatgccagaattttctatagagagctgtttaattaggctaaaagcatcaactatctaaatttcctattagcccattgcataattttacttcattattgaggtcaaatgcattctgcaattttatatccaagttattatatcacaaattaatttgtttagtcattttgatacttaaatcacattcaggtaatatacttgtttatctgttcactatgctctgctctgcttgtgttgtttttcttttctgagaacagccatatgagatggatttaaaaatcatgtgattgatgaatgatctgaaatttcttatgcagccggaaccagaattcagaccatcaatgtcagagattgtccaagacctagctaggattataagtgttaccagtgaggaatcagagtaacgaagagatcaaggtggggccgtacatctaggaagccagctctcgcagctatcaaaaatattcagaggaaacacaatcatttctgtggagcatcctttcagtatttataatggacagcattgtcctttagtgtacatgttgattctggagccgcatttacctgttgaaaggtggtagtggtacagccaggggaacatgggccttctcattatgggccaagtagattcctgtacttcctagacattatcaaattgcatgtatatcttataatccattctaattttgattattttattacattaaaattagcgatgttcatatggtgttagcatatctgattgctgtatctctctcaaagctcgttcagaaatcgtttattttgtttgattaactccatgtggtttttgtgattttagaaagtatactggtgtagaggtgttgttcagaggcggatgaaccctctcgacattcatatgctttcttctgtgaaactggacatgcacattctcctcctgcagggaaaaggatctcatttaggtatgtctcatgtgttcgatttactcatattttctattgtctttcctttataatactttctatcattgcccacattcatatatatgttaataaatctatatgtatgtgtgtgtctagattcattagcatctatatgaatgtaagtaatgctagaaagtcttataagctgaaacggaggtagtattaccatatagtatttgaatggattatgggtttatggttttggttacccttaagtggtgagtgctagtaatagagacaaacgggtggaaatatattgcttaaaagatactccctccgtcccattttaagtgtagccatgattttccgtgcccaactttaatcgtccgtcttatttgattttttttttgaaaaatttaaaagcataagttacgcataaagtactattcatgttttatcatctcataacaagaaaaatactaattataaaaaaagttcaaataagacggatgatcaaagttgggcacgaaaacttatagttgcacttaaaatgggatggagggagtagatggtaaacagcagctgattactaccttgtctgttctgtgactggcagtctgtagtaacattaaatttgcttttgtagtgttagattagcactctatgcggaataatttggttatacaagagaaacagtactgtaggatgttttgcatgctgaaatttgctcttctttcaaagctagtactgatagctccaaccatctactatttcacttgcttccgtatgtgcttgagttagaaacgttttgtatcctttttcaccttttggaacagagaaaactttactgtgtcaacactggaagcatagatcccacctatgcttttggataacttcttgccgactaaaaaaaaatatttgccttttttttctagagtataacatgatcatctgctttgattggagtaatgcgctcctatactttgttgctttcacctacttttctgggatgcctactgttttgaaggggaaaaaaatctagataagtagatgcactcatcaaatcattaaaacctctacttatttagaaccataggaattgcaatttgcagaactccccatttaggacagtgacacgtacacaggtgcccggccacaagaaggttagttgccttgcacaggcacattgagctagggaacctgcacctggtttcagaaagcagttttgccgtgccatattgccatgtgggtggtgccaagttgcacagtaccgatattatgaggctggcaagagttgccgtagcagggggctctctcctctgccaagtgccttagcccctctcgctttctcccccacaaatgtcactcggataaacgagtgtctattaccattgccaaggcctcaatcttgtagtggtccatctgtgtaaggatggttatataggttagctggtccacatcaatggatcaaccgcactgtcctgtggttgccgttgatatgatgatccatggtacattgaacttttatttcatcgatgattttttattttctttcagctgtgaagactccatagtttatatagttattaccaaatatcagtgagatcaactgcattcctgaccgatgaaatgcagatcagatgtgcaggtttcatgaatggttttgggtctccccggttttcttttcttaacctgaacagaattagaattgtagtggttcatattagctctcatctcactgtcacactcatgcatatctttgccttgccaattgcagttggttgctgaatagtgggatctttactgatcctgcagaatcatggcgggcagatcatgcgtgacatcgcaggaagcaactcccaagttataacgggttgaatttgaaccaaacgtgtactctctttggcctgaaagcaacatggaagtaaccgaatgtactatgcgagtgagcttcaagtcgcagcggcacaagtggcgcatccctggttttgccatgctacagacacgcgtgcggttttctcatcgcacgcgtgacttcatcgtgcatgaatctcgtcgagacttgtcgttgttggcttgttgctggaggaaggtgacccgatgcatcgaaccggaaggacggatggatggcatctcccgtttttgtggctggtctcggttttccgggtcgtgtgggcccgtcctatcagaacagccgggtttggcattttgcagagcttctcttgctacctccgtcctaaaataagcgcaactatgagtttttgcgtccaactttaatcgaccgttttatttgaaattttttttataattagcatttttgttgctgagataataaaacataaaaattactttactcttgacttatgtttttaatttttttttaaaaaaaattcaaacaagacgaacggttaaagttgggtgcggaaaatcggttaaagttgggtgcggaaaatcatgtatgcacacggagggagtacgtttttgaccgcacgtcttcgttttgactgccgggtgccggcacgctagaaatacgctaggtggcatgtattcatcgcaattcgcaaaggtgaaagaagaaaagaagcatgccaatttgtagaattttaacaaaaaaatgagcggttattggagcgaacaatgaaaacttcaagggaattcggaggagcatgatgcctaccggaaaatcttgagaaaaattcacatccagatccagtgaaagcggatgtttccttctggtgttccttctagagaaaattccgcgtgcactaatcgaagccttaaagaaaccaccaacatgtgaaccatacgcctatctgatgtgtttatgatcgaccggaagaccgaagatggggttttctcaagcgattaataccaaaagtatccatcaattcatgtagctagttgttgatgaaatcattatcaggcctatggcaccacgattaaattgccaagaacttggtggtggagaagctaagcacggttgtccgatccagcttacggaagtgaacctttttgggtcggatccaagctctagccaaggtgttctccaaaaaaaaaaaaaactgaactgtacacaaaaaaattgagaacctttttggtttgagcagttgtttataaactgtagtaaattctaaattgtactagaacttacttttagaattgtttgttttctgcatttagctttggcactcggatcgcgagtacaagagtaagcaattgcaacataattttttttaggggcaattgtaaatttaccactagtttgaatcgttattgcaagaatgtcactaaaaaattataaaaataccaccagaactatcgttcaagtggcatactggcatatttcaaattaaaaaaaccaacggcaaatttgtaaatcttacataagtcaaaacaaacttagggcgataggagtgaaggtattgcacttgttgggcctcggttgccacctaggcccaagcccctctaaggatacacactcattgtatttgtagtgggtcccaccaataactcctctcccacttttcatccccctctctcctctctgtctttctccatcggcggaggaagctgaggtgctgggcgaagaaagcgaggtgtcgggcggagtgaccagatctagccaagcatagaagaagggaacaatgtgcttgggggcggatttggcgaccgtgccgagcagagcgatgacggcgccgggtggagcactacctctccttgtcggggtggccgccgcgggagatgacggtgctgctatgctcgccgaatccgacttggggctcatcggatccggccttgggtagcgtcagctgctcataggatccgacaccaccttaccccctttcctctcgacgcgacgttcgacaccacctcaagggacaacgaggacaagaatggcagtgatgctactcacccccctcccccctcatcccttctctttcgcggccacagtgtcaccctctttccttggctgacaagcccatcggcgtgaagcacgggtatgatgacgagggcctctcctcctgccagtcctctctatcccttccctagtgatatgggacagagagtatgagcctatatttgtaaattatgacgaggaacctgtagcttaatttggctcccggttctttgtgggggcaacaaaatagaccagataacatggagccgaatatctgagatagtcggttcgtgctaaataataactccgtgcaccgtgaaagccttcgtaacgagggagtaaagaaaaacgctaattcctttcagaagaagcgatcatcatagctccagcgtgatgacagaaacagaattcgccaaaaatgatagaagtatccgctgaatggtggtgggaggctgggagcaggtgcagatgcatcgcagcctctcttatctcggtcccaagaacacgtacagtacccaccaccgcaccgccttcctgaacgggacatatgtacggccaggggcaggtggcctactctactcgcctaggcatagggtggggactgactcccatccgacgcgcctgcaggccgtggaactggcgacagcaaagccggcctccacctggcgaaccccatccatccatccatctgctccgtctcgccctcgtcggatcgatcgagtgactgatacgcaaggctgcacgtaagtaccatactactgctgttctcaaaaaaaagtatatactactgctgcatccgttccaaaatataacaacttttagtctttaggatttatcccataatacttcctccgtttcacaatataagtcattctaatatttcttagacatataacatcaatataaatgtggaaaatactaaaatgacttacattgtgaaacgaggggagtaacttctccaccagcattctctttccaaccaatcacaaccctatgtcattcacttttcccaactatctccattactcatccaatcacaacccttcaccattcagggcctctttgaatcataggaatgaaaaaacagaggaataggaaaaacataggattctgataggaatgcaagtgtaaaacagatgattgcaaaacacaggaaaaacataggaatgactgtttaattgggccacaggaaaaatacaggaatttgaggagagataaagactcaaaggattcttttcatgaggttctacctcatgttaaatttcctccaaaacttacatgggaagagtcatttcataggaatttcataggatttcataggatccattcctttgattcaaagggctatataagaaaaattactataggaatgaaattctctaaaatacctatgaatttcctttgaatcaatggggccctcacttttacctattttcttaataacagtgtccaactctaaaacttcttatatcctgggacggagggagtacgatggatgaatggacggacggacggatcggggtcggtttgcgtgacgtgctcgatcgggtagggagccagatactcactctgttgcataaaaaaccaaacctaataccgaatataacatattatatattgtaactccagtaatgctttaaaccaataatatcgaaatatgacacattctagtattatcaatctttatatatagaaacatactctctctataaaaaaacgagtctagtcctggatgtgacatattcttatacagcgaatctagtactggatgtgacatattttagctggtcatttattagtactaggatgtgtcacatccaatactatattggttttttataagatgaaggaagtatctagattcgtagtactaaaatatatgttatattcggttctagattagttttttacgggacctagggctacaaagccaccagctgctgctgtgttcgacacggtgagtgtgtgcgtgcggttgcggccgtccatacacagtcgaccgaaccgaccggggacgtgcgcgttttttttttcccttctttctgttgttggatgagatagctgcacgtacgcagcagcagcagctactaccgtggatgcgatcggagccagggttaaaaaacgactaaccaaaatcggactttctttttactagtattagcaaatgggattttaataacaaaaagaggcaacaaactaatttatgtctggtacggtgacaatcatccatcaagttactcctactatacttttccccgcttatatactccttccattccaaaatataataaattagaagtagatgagacatatcatagtattattgacggagcgtggggctcctcaccgggagaccgcgcaggcccccctttgccggttcggccgggggccctaggtgagattctaagctcctagtctgtgtgtggaaggttcgcgagaatggaaaaaacacaagacacgggcgatgtatacaggttcgggccgctgagaagcgtaataccctactcctgtgttttggtggatctgtgtatgaagaagttacaaag

SEQ ID NO: 64065 - DNA, 1886 bp, Oryza sativa
ttcgcccctcttcatacaatatcttgcctgtaatggttaggatgaagcctggcatatatctgaccggaaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcaccttccccatatacgcggcgcaaaacccataaggggtcggggcgcctcggccctcggggccgagacgggagcggtccgacccctcggggagacaaagagaagggcggccgtatcaccctcgggcctgacccccccgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgttgaactacatcacccagagggcggtgtgaggcagctgcgatgagctcgagctggcctcggggacagagacgagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcctggaaataatggcgcaacttcctcgaagttatcaggatagcgtaaagcatcttctgggcctgaaggtatcgggtctcagcgtcccggagggcctcgctaacgaagtagacgggccgctgcacctttcggcggggccgatcttcttcgtcaggggccacatctccagggcgctctccatccgagaggccacgcggggcgcactcggcttctgtgccgacgacctcggggtcagagggcgacaggcgcggccttcccgcagtggcctcggggccatcctgggggtcgtgggcgcctggcaccgtcggacaagcaggcggagggccagctccggccgtcgggggccttgggccgccgttcggctcgggggcctctcctccctgctctctctctcttcgggcagaatcccggcggtcgcaaatcgcgcgcatcagcaagggaaaaccgaccgacaataatgagcggcccctcggcttcgcgtttgcctttaactccgacaaggagtgcggtgacgacggtgcggacgacagcgacggcgaggccggctacccgggcacgtcggagtgagcccccaggcctccgccaatcttaatagcttttccttcttcttccgaggccttcgggcccccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagcccccgagggtaggattgagcacaa

SEQ ID NO: 64066 - DNA, 13918 bp, Oryza sativa
  unsure (1)..(13918): unsure at all n locations
tcgctcttccaagtagccgaggtcagggagcgtcggcttccttctttttgtcgctcgcaggcctcctctttcgggtggccagcgaaatgccttcgacggcgaggacatgaccctcgtcgtcggaatgggccgacctcttcttcctcctcctgtcccgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggagacgacgctccccatctcgccgcacttccccatcacccgtggatgtcgaagtcgcagatccttcgaccctctcgagcgcctcctcccgcctaggactttggcgtggagggggcggtggagtacgagctcgacggcgtgggtttggctccccgtcgtcaccgctaacactcggagagaggttgtgcgcctttgcttgttcagccattgggctgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgagggccctgggtgagattctaagctcctagtctgtgtgtggaaggttcgcgagaatggaaaaaacacaagacacgggcgatgtatacaggttcgggccgctgagaagcgtaataccctactcctgtgttttggtggatctgtgtatgaagaagttacaaagtgcgagccagcccccgatcgttccgggatcgttttctcctccttcttttcctctaagtgggcaaggtcctccttttatatctcaaggggataccacatgcaccatctctctctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatatcttgcctgtaatggttaggatgaagcctggcatatatctgaccggaaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcaccttccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacaattatgcatctagatgggttttattttttttaagaaaaaagtttgattgaattatatattttcagaaattagacataaatccacatatcaggatgtacacagttacattaataacatatcgattaatcgttctatacaaattctagagtaaatatcatgtttttagaccactaatctgctgctacctagagcttaaacaaggcttagtattacctcacctaggcatatgttttaacttgatcaagatacatggcttacctcgattttcattgcatgctttttaaattattaaacattacattctgtatgaaaactttatatatatatatatatatatatatatatatatatatatatatatatatataaaatatgaatttaagttgttttaaaacgaaagataaaattattcgttaagagtataataattaaaactcaattaatcatatatgctaatgatttttttcgtgttttatcttttatgtttagtgagtactccctccgtatgctaatgatttttttcgtgttttatcttttatgtttagtgagtactcactccgtccaaaaaaacaacttagtattcgatgggatgttttatagtccaatgagtctgtttagattcgttggactataagagcaagtataatagtaggctataagccagctaaatgctgagatataggagagaagagaggagagaggagaaacgggctgtaaactaataaccggcttagacacaagaacaaaaaaaaactctgtgagagagacaagtgggccatgtatcaattgtaaagagctaactatttatatgagtaggctaagagaaggctataaagaaccttatagtcaacaggtcggctgtattattagccttgctctaaaacatcacatctaatacattggtttttaaagagagtagaaacaaaagccaaagccacctgggtcctgggaggcgttgttgcgtatatgaaccgcaaagaaaggaaccacgtcagctggtctagtggtctccctgtcctccaaaaaccaaaccctatgatcacgcgacacgccatgatctgatccagctcccagacgttactagctcgtcgtcgacgtcgtctctgcagatgtacgtgtctaattaaacacacacacacacacaaattacgctttattagcgtattaaagcctctgattaacggtgattaattagctaaggattgtagtccacacaagctcatctctcatgatcatgaccccacaccatgggaatcttttaacgggcgacgatcggagccacgagcgctccggtgcctaactccctaaaatcatttttctagttaatcgcatggtctccatcggccatcgcatgctgtcacctctcctaccctcacaaatataaaaatgccaacaaaaggttgatcagattcttttttttccttttttctttttgcgtcccatgccatgaccatgagaagatttcttactgtagcatgtgtaaaaaaatcatatactactccatcccaaatgaattgtatttatagtatttagaatttgtcttaaaataattgtcgctacagagtattaactgttctatcaatcactcctcatttaaatttttatcctatatattctacccttagttactttcctactctcacgtaatatgtcatttaatgagagacattatagttttcttctcaaatcttaatatatgctaaacaatctacaattacaattattatgatacggaaatggtactatatatatgaaccatgtatcatttaggactagtttttgtcctaccaattctttgttagtagtacttttaaacagtgtttctagatattggattggtgcccatttttactagctccatctgttaggtagtagcaaatttgtcctaccaaatttaatggtgccaaaagttgatagtgtcaaaagttgcttaaaatttgacactatcaatattttggtatggctctaaaccaaactggctgtgatttgttgtgtaactgtgctattgagattgttgttcaaatcattttatattatgtaagaaagattgatcttgacaaaagaaggatggtcagatcaatcaggtgtgtcatccttgaaaaaatgtatatataaattaggtgcatcatatgctgatatgcatgtggacctgcatcaccagaaaaggaaatgcatcattatctaaactaatcatctaataatcaggatttggtccatacatacagagcatgatgaaaagagaagctagctaatagacagatcaaatagatcgatttgacactggataacattttcataagcaataattcagtggacattccatcactcatggccccatacaaactagagatagagtgaacaggaaaacaacattattcatactaattatgtctatctctctatctcccaatccaaaagctcaaattggagattaattagaaaattccaaaccgaaagaaaccaagcaactagcttaggtagaaacttttccttcaggagaggtgaaagaatatttctcttttgaccccaaaaaaagtagaaaaaaaatctggcctctctcttcgaaggcgacgaggtttttgtggacaaggatcactctacgactccccaaccaacggctcaggtatgtccataatttcattaagcacacaagctactccctccgtttcgaaatatttgacaccgttgactttttagcatatgtttgaccgttcgtcttatttaaaaacttttgtgaaatatgtaaaattatatgcctacataaaaatatatttaacaatgaattaatgataggaaaagaattaataattacttaaattttttgaataagacgaacggtcaaacatatgctaaaaagtcaacggcgtcaaatattttaaaacggagggagtaattaactaagaattatttacctgtcgtttaacggtggccgctagctcgtcagaagaacagataatatatttcgggcatcactccaacatggttttttttttagataatcactccaacatggtatagaataatactcctagtgtcatgtgaaaagtacacctgaatggtggtttattcacaagtggtaattgttttttttgttaattgggatggttggcgacgagaaagatcggaatggaaggggattgggtggatatgttagagaaatttgtcatgtgtgtcatattttgttagatagacacaaggttcagtttgatttagggaaatgatcagatcatgttgcccgggagtacatattttaggtgttaaaagttaggaaaagtctatacgtactcactttttcttactaaatttttactaacactgacatatcatgctataagtgtatctagattttttttataactttcatctacttgaattaaacggttgagatgattgttagtacaaatttagtaagaaaaatttagtacgtgtagcggtgctctaaaagttacgtcagttagatgagggattaactcttgcgccgactgcccattggtcagcttccgtacgacaattgttctgcgtataatagaagatataattatacttattagctaaaatttaaattttaaaccttatatttagaaatttttttaggttttacttcatcgtagtttattttttaacctttacttttagattattaagaacacatataaaaaagttttattcataaattattttttatttacaaataagtcgttttgcttttttctctaatatgccaaatgatgggacttttaaatttagaacaatttgtagggcatcatattacttgtgctaattgcagctgttttccttgttgagataatgagttaaaacccgatctctactttgtaaatggattacacggccaaaagtttatacaagagtgcttaagagttaagactcaaccccttacacgaagaacatgtctcaaacaaaagttaaccaaccaaaaaaaaaatacaaagttaagtttctaatctcctcccgatgttcctgttgaagaaacactttttctttaacacaatgtcatcctccaatttaagcaacatagaccaaaactgcgcccaatgaatctccctaaaagttacctatatattttttttaaacaataaagttttaacacaccattaaaaaccacatcgttcctgtttgaccatatcgctagccaacacttgatattttaccttaggttgaacaccattatccttcccttggccaacacagctccgagagtaagctacatagaagttagaatgttacaatgtgattataatattatagttatagctcaattaaatatagttatactctaagttatatatgaaaaataattcaataaaaaactgtgacttcagctgagtttagttccaaaaaactttcatacacatacaaacttccaacttttccgtcacatcgttttaatttcaaccaaactttaaattttagcgcgaaataaacacacctgaatctttaaaaaaagaactttgtaaaaaaaaaaccatgttggagtggagtatttagtagtacaaacgagcgggaaaaggtcaaagtaaaatcctactagtcgatgggggcgaggagaggagagcgaggcacagccaccaccaaagccggtggccgcgggtcctctttaaatacaggccacactcccctcgcactctcgactcattccaatccacatcgtctcgctcccaaccaaacctcccccctcgccgtccgcgcgcgcgcccgcggtttcccccgctcgccgccggtttcccccgctcgccgccggtttccccgaagcgcgccgcgcccgcgcctgcgcccgccggtcgccatcgccatctcgccctcgcgcggagactggtgtccctgttttgctctgtagtataaagccacgcaaacccccgccaggtgttcgaccgagtgacacaagagtccagcctcttgcaacctgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccccccgccgccggttgggggttgaggtggtggatgaggaggatgacgcccggtccacggcgtcgagctcgtgcgtgtcgacggcggactccgcgtcgtccacggcggcggcggcgncggcggtggagagcgaggacgtcagaaggaggggcgggcgcgggcggcgtgccccgcgcgcggaggcggttctgnaggggtgggcgaagcggatggggttgtcgtcgggcgcggcgcgcaggcgcgccgccgcggccggggcggcgctccgcgcggtgggccgtggcgtcgccgcctcccgcgtcccgatccgcgtcgcgatggccgccgcgctctggtcggaggtcgcctcctcctcctcccgtcgccgccgccgccccggcgccggacaggccgcgctgctccggcggctggaggccagcgcgcacgtgccggcgaggctgctcctgacggtggcgtcgtggatggcgcgcgcgtcgacgccgcccgccgccgaggagggctgggccgagtgctcctgatccgccgccgccgccggccaccgcacgacgaatcttccggccgcctgagatagaaagtactaaaaatgcgaaacttgtgggcaatgattgtttgtttgcttcctccctaattaattaaattaatctcaaattcttaatcaccatcaaggacccaaaaatcttgtggtttaggaaggcctctcttgtggttaacatcaaatcacaagtctaaatccaaatggatgggactctaatttttctgtgtagtattagtatacaatgatgatagtacaatttgatttgttattaattggttattaattaaaggtgatttgatcaactagactttatgtggtcaagaatgtctccctgtattgtatagtaccaactaccaactcgatatttttttccttccaatctttgctagtcctgtcttgtgtttggtgttagttggtatctcaatgtactgggcttaccacttgtatggacagtattgttagcactaacaacagtgtgtaccccccagtcgtgttagcttgaatgggaagagccaatgatcaaggaatgctgtcctcatgtcttgccgatcgcttttgagccgatagcacgtgctacctccctcctaaaatattacaactcaatggcttatttggtttgagagaatttcaacccatgaaaataaaaaaaagtggagaaatagtaatacacgaacccattaatccatagaaatttttttgagtggatgaatatttttatatattttctctctacgacttgtaagaaaggaacattttcatttgattttcctatatcttattcatacaaatcccaaatggtacttgtagaaactaatccataaaaattaaaatcctttactttatctccaaaccgaataaaccctaaggctacgttcgttctgtcgtgttggagagaaatttttagcgtacgtgaaacgagaaagatgactaacacatgtttaattaagcattattattataaatttaaaaaataaatttattttattttcataaataacttctatatagaaacttttgtaacagacatatcatttagcattttaaaaaacatactaacaaaaatcgaaattgaagttttaagttgaaaaaaaaactaggcctaatacaaaatgagacatactccctccgttccacaatgtaagtcattctagcatttttcacattcatatcggatatctatttagattcattaacaccaatataaatgtgggaaatgctagaatgacttacattatgaaacgaaacgaatgaagtatttaacatgaggaacaagagggagtgaagcagataggaaaaaaaaaaggcctcgtggtggcctctcgtagcgatcgtacgcgagacggcgagagaggcggcttcaactgcgtacgcgcgtgagtgagcgacacggtgagcacggccacgcggcccagcaggagggagcgtcgcacctgacctggtccctccctcccgcccccggcgaccttcaactccacctaactgcaactttttagtgctatgggcttatttgattcttttactgtgggtgtgttttagttcacgctaaaattaaaagttccgttgaaattaaaacgatgtgatgaaaaagttgaaagtttatgtctgcaagaaagttttgatgtgatagaaaagttagaagtttaaagaaaaagtttacaactaaactcggcctgtgtttagttcccttcaacttccaactttcctgtcacatcaaatggagtattaaatgtagaaaaaaaaccaattgcacaatttacatgtaaattgcgagacaaatcttttaagcctaattacgccatgatttgacaatgtggtgctacagtaaatatttactaataacagattaattaggcttaatagattcatctcacactttgcaaacgaaatctataatttattttgttattagtctacgtttaatacttcaaatatgtgttcgtatatgtcaattttttttgccaaaacaactagactcggcctttagcctaccaattcatcgacaatgccaaagcaatattaaaatattagtaaagtaaaattattcagctaacatttggattggtaccaatataaaagtcaaattctcatagtatagtgaagaaacttctagaatatgatcaaataagataaataagataagataagagcactaccaaacgtttgacctcaatccaaactaatacacatattatacttttttcttagtattatgggaagaaggttaaccttaacaaagttttttttcaagcttcttgtccactttaaagattggtaactgaaaatctaattgttctaaaaaaaactgaaaatatactccagtaagaaaaaaaaccatgtaaaattctctccattacagagccacatggtaactgcggtaacatatgagacgttacattttttttttctttttgtggctgtagtgaacaatgcccaattatggtagtaacacccactttgtaagggcaacatgagaatctctcggcatcatatagcatgcaactatgtctagcataatactacctcattccctaaatgtttgacgccgttgatttttttaaacatatttgaccgttcgtcttattcaaaaacttttgtgaaatatgtaaaactatatgtatacataaaaatatatttaacaatgaatcaaatggtaggaaaagaattaataattgcttaaattttttgaataagacgaatggtcaaacatattttaaaaagtcaacggtgtcaaacatttagggatggagggagtaatatttaagcccttttcaaaatgcatgaattttactgttttagagttttatagcttcgaattttacataacttttaaccaatggatatagcccgttttaaataaaataaccataagaaaaatagacaaacatgccgacaattgtaaatatagagagacaaaataattctaaaatttaactttggtatagagtaactgactatgagtgctacatagacggtaagtgtaaatgtactgtaactgagcgtaataacaaattggatatacaagaacataaaacttggtacaaaatcatacgaacggaaaagcaaaagatagaagccaaaaatctatcggaagtaaaatagcaaaatcgttcaacttttatatgaacaaaaaggaaaaaaaaagttacatattccaaggcagaaacttaccagtactatacgaaaaaggccattaatctggccctaagcccggcccatctatccacttcgggcctccctgccatcatccaccccgacctccgcctccgcctccgcccgccgccgacgactctccgactcccactccacctccaatcgaaccccacccgccgccgccgccggaggcgtctacccctgctctcctcccccgcgcgccgccgatcgaatccgcaagccgcgatggattcccttcttgccaactacgcctcttccgacgacgaggccgacgaaaccctacccactcctcccgccgccgccgcggcccgaccgaagccgccctccggtggcggcatcttctcgtcgctcccgcagcccaagtcggcgctcctcttctcctccctcccggcgcccaaatccgggcccgtcttctccgccatcccgcctcccaagtcctcctccgggaaccctaagcgggtcgtgcagttccgcccgcctccgatccgccagcccacgggcgagagctccgacgaggaggacgacgacgccgagaagcgccgccctagcgaggccgagccgcgcccgcccgtatccgcgggcacggggcctgtctcttcgttcctcccgccgcccaagcgctccctcgggctcggcggtggcggcgccgccaggaggtcggccatagacaccgctgcgccggagaggtcgaatgttgtcgccgctggtccatcgtcctcggccgtcaacgcaattgcccccgaaaggcctgatactacctctgccgatgatgaagacgatgaatcgaatgggagcagcgatgacgatgagatgcctgtgccggaggagcagcaggagcagctcgctgttgattccgaagctggacagcagcagcagaatcagcagcaaagctatgatgctggagttgggagcagtaatggacaggaaggctacgcatgggatccaaattactacgccaattacggtgcaaactatggctgggatccgagcggcaatgtgaactatgggactgaagcgcagtatgcggcatatggaggagagcacggtggagtgtatggaaatacatacggagtagaacatggtgatggatatgggcattcgacggaaatggcatatggagggggctatgctggtgggtacgaacataatgcggctgcagcgacagcaccgccaatccagcagccaatactgccaccggaggttggtaggattggagggaagagaggtaggagcgatatgccggcagagattttagaggttaaccaggcagagctgatgaagaaccgaccgagggaggataagtccaagctcactgggatggccttcggccctagttaccaggtaccgagtcagcttgttatgatttctacttagcttgcagcattattgttatgttcgattatttttctggcaagtatcacatgtagtacataataggatgagatttctagagtagctcactctcttgccagtaactgtaatcttttatccattactatgactggttagagcacccgacactgtagttattcctacaaatggtttgttggtaccaagataattggcttattggttaagcgatacagtagtatttatttgacttgcttgtgatcagtttagaatgctgcaagctcccaagcaagtatttattggaggacataggcagaatcatgatacagtggttctttcttattgtaattttgcagttcattatgtcagccatattattgattgctgataacctctgtaaggacataatttgataattatgttacttatggttcatacagcgtttctgttggtgggtgcctgggtggtggctttatgctatttgcatgtactattaataacatttgatctacttttatttggccagtgactgtaggctagatctggttctgtataaaaggtttaaattatagtgggtggaaagggtattaggttaacttatgtacatatggaacatatatcacagcttcccagtgtgaactataggatttcagttggaaagcaataggagtgatgttttttgcagatccaacatcccttatcagtgaccaacaatcttagttattacttcctccgtttcacaatgtaagttattctagcattttccacattcatatagttatatctagattcattaagaactatatgaatgtgggaaatgctagaatgacttacattgtgaaacggagggagtaattaacattgaaatgatggtggaaaggaaatttgtcaaaaagatggattctataagtttccaacatgattaaagttgcaattgccataaggtgtttatatgtcatcatgtccaccgttagtttgaaaagatctaaattgtgagtgagcatcatgagctcataagtgataagatatcatttttgaaaaaccaaaccatatttgcatcgctaattaagtaaggatcgttctaacccaagatttctatcttgaacgcagcccgccccttcagcaaaaggaaagccctccaagctgcacaaaagaaagcaccagattgg

SEQ ID NO: 64067 - DNA, 7276 bp, Oryza sativa
caaaaggggcaaggtccaaggcatccaatgttgcactcatctatgaaacaacctgcaatccatgggagaaggacgacaaggagcctcgcatgggggttcgatttagggaggaaatgtttgtgggttcgattttgggaggaattgtgggttcgattgcgtgaccacgaaaggatatcgaaagctcgacaacgggtggttctaccttagacggacggtatgggctctgttggattgcattgctttcaatttgatcttcccgttggacaggaattcagcaagtacagcggccaaaacttgaattctcgaaaaaaaaaggattttcgtttcaaaagattaaaaataaagtaaaccgtgatggcttcatcaggttgacaacttgatatgacgagaatgaaccacaaccttgcaggatgacagaatatcagtgcatgtcaatccatgggctgtagcctgttagaataacaaaagatcaggccgaaaactctgattgctacaatctttagcgatggatacacaagcaaaaaaaagacatgagatgaagtcttgcaagcttaagaaaaggccacaaaatcaccacgtgattaatgacatacaaactgcatcaaaacaaagcagatgcaaatgttatgcctataagatgagaaaggcagggaaatacattaaacgaccgacaaagctgtcattagagtatatatcgaagcagctgtgctcaaattaactgaaaaagtttttaatcacaatgcatgcacttccagtttgaagttgcttatgataagatgcataggaatgtaacaataaactggaaagttttttgctgactttccgtacaaaataaaccatcaaacgaacatcatcacaactccaggtagctcatcggtggaagaacagaaattctgttagatcgaatcaaccacagacaaaccccaagtcctgcaatacagcatagataaaacagggcatgtagtcagccttcacatcagttgcagtggggttggtatgacaacatttaaatcatgaacattcgagtatgagcttggagtggatagagacattgcataattaaaaggtgcattgcagattggagtggctagagacattgcataatcaaaaggtgcattgcagaccttcccttgtgaataactcctctacagtagaggcatacattactcctaaatcacattatatcagcatgttggaagttcaacaaaacattatatcagtttgactgtttgagtgcccgtttgttcttcttaaaagaagatctgccaatcattgatctaaccaggtagcaattgaactcatgcaactttgaagaggattacataaaatgctgcaactacgctattatatattgtactaaggttatttcacagatatattgtaccaaggttatttcacagtataccaaggttaagtcagaagatgctcgtttcatatggtgtgacagcaatatgcataatttcaactaatttcatttcaattatgcaaaacagacatgaacaacaaggcctatgcactgactcaaaaaatagctgtgactctcctcctcactacatttatactacaataaacagcgaagatgcatccattcacacagcaaatgcttcaatccatacactacactaaagattatcaataaatatgtttgcttcaatccatacactacactaaagattatcaataaatatgtttcaccctttcaagacaagcaaacaaagcaaagcgtgaaatgcacaaaattagtagatctctgcaggactcgatatatatttaaagttgtaacttgttgcggtggagaggcctgctgatatccaagcagtactatgtcaaaggataaatggatcacgaccaccaaaccaattcagttgtactaaaaacctaataatcaaagttactccttaaatctatcatttaccttttcctataacctatattatcctcaccgtggtggaaatggagcaacatacgatccaaaaaaattcctaatcaaagttactccttaaaaaacaaaaaattcctaatcatttgttttttcctatgaaacaaatttaattctatgaaaaactaattaaacttactcctgaaaagctagtatcacttttttccctataataatccagatccctctcctgcaccgtgattgaaatgcattaaaaaaaaatccccaaccactcgtgatagattttaagaatagaaacatttcctcatatctccatagctaacatttccaatctaaccatcccaacggcaccgaacgaaacaatcggggaaaatcccagatcagatcaggggaggcaaggagacgggggaaccctcacctgacctcggatctagtggtgggcggcgccggcggcgccctgcctctcgagctcctcgaggtgggcgaggtggcggcgctccttggggaggttgatgaggtaggagaaggccatgaggccgtagatgacgtggaagagcggctccggcgagctggtctcgatgtacttgtcgatgtagcggtcgacggcctggtcgctgctcttcttcacgttctcccagctcagccgcggcttcaggtaccccggcacctcccgcaccttcatcccccggatctcgctgatcagggctcgcagcgccatggatggatctctccgatctcgatctctcctcttccccttcctcgcaacgtcagggctcgcggctagggtttggtggcttccgagacgggaggaggaggaggaagggtgggtgggtggtcaagggatggatttgttcgctacggggtgggatgggttgggctgggctaggctgggccgacctgggcttgtgtgacagacatgtgtagaggctcactgtttcggaaaaggaaaatgtataccgaaggtccctcaacttgtcattgagttataaaatcgtccctcgaccttaaaaccggatacaacgcatctctcaacttacaaatccagtgcaagttccctcggtggtttttgactccgattttattcgacgtgtcagctgactcagatggtcggtaggatgtcctccttccttcaggcgaggaatgcattgacctcaagcataggatggcgaggtcgggctcggcctcctcctcaggcagcattgaaaatattgctgaagaccgaatttcaacgcagaaatatcataaccgccaaattcggtctcagtctcggtctcggtcctaaccgaaatttagcaacattttcattaatgaaatttttcggttctaatatttttgcgttgaaattcggtcttcacctttcaaaaaccgaaatgaccgaaagaccgaagaccgagaccacaaatttcggtctaaccaaatgcccacccctacttgtcgaagctcttgctaccggcaaggagaggagtagggtgcggggactagggttacgacggctgtggggtggcttcactgatgaagataaaactagcatgtggagagagatgggaaagaaagaagatgggagaacggaggaagaagatggaactaaaatgtgggtcccacgtctagtcgtctaggggtattttggtctgtatgataaccgaaaatgtgacggtgatggtatgattttaattttgtgcgaattcgaatgacatgaatacgactagatgaattaaaataaaatttacctgagtgggcatatttccaatcaacccaaaaataaaattgcaaacacgcggattgcgagcgcgcgcacgagctaggaaagggagggagttggggagcttagctcgcgcgcggcgcggtggatcgcatgcgcgggcgggctaaaattagcgggagagggaggagttgatcggaaaaagggaggccgcgtcgcattgcgtcgtcgtcgtcgtcgttgtcgtccgtagcgggagggagggagagagtacgtgcgggcgtccggaggtctcagcgcacgcccgcggccgggccgtcgcgccgatcgcgatggggtcgtggcggcgcaaggcctacggcgccctcaaggactccaccaaggtcggcctcgccaaggtcaacagcgacttcaaggtccgtcaccttcactacattttttttatctcctccattaatttctctcctgttcttgtcgacttgtccatgttcttgcagctttcttttccttccttccttcctttctttctcgttgttgttgctgctgttgttgtagggaattttgttcatatggtcttgcaatcttgctttttctgttagcttagctgcatttgtccatgcaaatgctgcattgtctcaggatgaaggcaaatgcataatttgtataccctctgtcctaaaaataatcaatttctagaatgaatttggacaaacatttatctatattcatcctttatttctagaatgaatttggacaaacatttatctatatacatccttgtatgttattgggtttttttttttttgacaaagagggtagtatgttacctgatatttgctgggttaattgtttcaatggcaggagttggatattgcaattgtgaaggccaccaaccatgtagaatgccctcccaaggacaggcacgttagaagtgagtactcgatcatcttctcctccataatttagttggctaccttaatgccaaaatgtatctctttcagcaggtaatataatcttagaatccattttttttctaatcacattgttgcagaaatattcgtggcgacctccattaaccgccctcgagcggacgttcaatactgcatctatgccttgtcaaggagattgtccaagacaaagaattggacagttgggtcttgctcttacagtcctctttgattatattccttatctcgataatgtgcttgttgatggacattttttggttataggttgcattgaagacattgatagtggtacataggctcttgagagaaggtgatcctacattcaaagaagagttcctggcctactcatacaagggaagcgttttgcagagagcaaacttcaaggacgattcaagccaattaggtgattccctatcttgcatagtgatcaatgcaacagagagtcatgtgtatatatttttcccaaatcaaactctaattggaggatagaaatgatgcatcaactcacctagctagccttgatttttgccagcttgggattgctctgcgtgggttcgcgcctacgcgctcttcctagaagaacggctcgagtgtttcaggatcttgaaattcgacatcgaaaccgagcgtctgatgagatctcctgagtgttccagcaaggttaacattatctttctcacattatcaaaacgaagtccatgtagtgaatgagatgttttgcctcatgatgattaaactttcgttaatcctaacaagtgcaggcacacagtagaactagaaccctgccttgcattgaacttctggagcagttgcctgccttgcagcagctacttttcaggctaattggctgccaggtttcataaccaaaatgttttactagcacatccttgtaaagttgttggatgttgtcagtagcttcatccatatttttttgccattgcagcctgaaggtgcagcaggcacgaactaccttatccaatatgcattagccctggtaatttaattcgcaagaaatcttgcataggttactgatccctttatccaacacattatttgttcttaaatatcatatggtggtttcacatgtgctataggttttgaaggagagcttcaagatctactgtgcaatcaatgatggtatcatcaatcttgttgatatggtaaagtaattctttatgatttttttaaacagtcatatgctgttatcgatgttttatataaaagaagaaggtgccccatttttagaagaattctttacaatatcatcctagataggttatcgctttcagtgtcgctgaattgtaaatataaatttctggttcttattgttatgatgcagttctttgatatgccaaagtatgatgctatcaaggctcttgttgtctataaacgagctggccagcaggtatatatctcaattttataatctggtattttctttcatgaaaatggttgaccctcatgcttgtccaatgcacaggctgaagatctttctgacttctacgattcctgcaaacaacttgagcttgccaggacattccagtttcctactctaaggcaggttagttcatcatcttgatctcaaaagattatcttaggtctaaatcagagcaacaagatagcgaaacattttcatgaatttggccacatccctcatgatcttggatttctaatgctcattccttgcacattatattctgcagccaccatcatcattcattgcaacaatggaagagtacatccgagaagcaccccgtccctcgattaacagcgtggtgagtgcggttcttcatgagaaacaagtacttaagaactagtgcaattctattagtactattatgtttgtgtagttcttgtgtttcttttgggaaaaaaactgtaggagaggctcctacagtgaataaatataataataatataaagttataaatacatgtttatacaagtgaaaatacttagaaactgtctagccattctgaaatttgtgggtggtagttttcttttgccctatggataaccaaggcaaactctgctctaaacttatctttgcaaactttgagaaagggatttagattttttttttcgtaattcttgttgcaaaagcaggagaatggtgagaggaagctagtgacctacgaccaagaagctacagaggagtctgaaaaaccagcagaagaggagaaagatgagcctgcagagtctgaacaagaacaagagcctaaacaagaaccaaagccaccagaaaccactggagatctactagtacttttctgcactattttctctaatccatttatgtgctaatccaagtgtccacttccctaaatcttatttctttgtgtctgtttttgttttatatcttgcagaacttggatgcagaggtgagtccattggttgcagaactggaagaaaacaacgcatgggccctagcaattgtgggaacaggtatatttagctgtattaatctcaaataacaaaacattggccacttaaatttagctgtaaatttgcggacttgctgccaaagtttaaatgagccaaaaaagaagtcatcaatgttttttttgtgtgtttttttggtcttttgcttgcaggtgatcaaactaaggcatcaacttccctggacttgtttttctggcaacacatctgggtgggagcttgcactggtcactgcttcaagcagcaccagccaaacagttcaaaccaaat

SEQ ID NO: 64068 - DNA, 1253 bp, Oryza sativa
aataataattcctaaattttttaaataagacgagtgatcaaacagtacaagcaaaaatgcaaaatcctttatattatgggacggaggaagtataacatttgctctgttgctcatttctaaaacttctgaaaaacgaccaaaaaaaattacaaacttgcatctgatctgatccaacaggctggaggctttgacaagctgctactcgacagcctctacgaagacgagacgaggcggcggcagatcgccggagtcacctacaccggtagcattggaggaggagcacccaaccctttcgacaccaacgatccatttgctacgtcgagcagcttcttgcccccatccaatgtccagtttgcaatgctgaaccagcagcagcatcagtactaccagtctcaacaccagcaacaatactaccagcctcatcatttccaggatcatcaacatcaccataacatgtattttcagacacattatcaacaaaatcagatataccaacaacagcagcagcagcagcatcagtaccctgcacctcaggctggatcttccaatccgtttggtgaccctttcggtgacctcgtaccaatggcaatggctgtctctcaaaaacatggacattcaagtttgatatgaatttgccatattcatgttgttaatgatcccaggcaattttaacatagatgggttaacttagtcaccttctcacttgacttgagtagagcatcttgtacaacttgatcttcttcgtgctaacttgagaattatgatgctgtatttgccatctcgctctcttgcaatatccacatttactcgaaccattgtagatttgtgatgctaatctagtgttgatcccaaatacaatggtataacctgaataataacaccggtataatcccaacaaattctactattaaaatttgctgctctattaaaaatatattagagtgaactgcatccttatatgtgcattaggttacgccaaaatccaaggcaaatccaaatgcattaggttggcatccgcatctgacaggcaatacagatactacatggcaaatcttgatgcgacaaaccatccattcccaatagcatttcgatatcaagaataataatcagaatgatatgcggcacaaaaatatttgacataaacctacatgatcatgtaattcaatcaaaactcatgaatagccaccacagatcttagtagccataccatcaattcgttccataacacaaaaaacagcagcaacagcacaaaa

SEQ ID NO: 64069 - DNA, 2403 bp, Oryza sativa
ccataccatcaatttgttccataacacaaaaaacagcagcaacagcacaaaagtagtctttctttgctttgtcttccaacacaacaagagataaaaaaagaagctaacactttagatagatagcaagaagccaagaaccctagctcccgagtacctaggcggtgaggaggacggcgccgccggcggccttgatcttcttctcggcgaccttggagatgagcttggccttgacgacgatgggcctctctggggggagcatccccttgccgagcaccttggtgtagccgaactgcgtgacgtcgatgacgggggccttgccggcgccggcgccggcctcggcgggcaccatggaccagaggcgctcgacgttgacggcggggcagtggaacctgttgctgagcctgtggaagtagcgcatcccgaccttgccgaagtagcccgggtggtacttgtcgaacaggatgcggtggtggtgcatcccgccggcgttcccgcgccctcccgggtgcttccggtgcttcccgatccgcccgtgcccggccgacacgtgcccgcgcttcttccggttcttcttgaacctcgtcgtcatggcggcggcgaagggcggcgacggcggcggcgggtgggtggggaggaagaagggggaggtgggagagtgagtggggtgtttatagtgttcggtgaaggggtatcggccgttggatcgtgaggaggggtgatcttgaccgttggatggatgcgggaggggctcgattagggtttttgagggtgaggtgggctgggccctccctctcgctttgtgctcacttgagatgggctgttgaaatgggctagtaaaggagcttttaaataaattcggagtgataaagaaataaaccatttgatctacttagttattattatcgattggagttttaaaacatcaagatttaatcacatcgttttttttaaaactcaggtaatttattagatcaaagaacaattacatcgctcactagccactttacatgcctcattgtttgccttatggcttataagccaaagccaaaatttgaatagtaaaacttgattttgatggtttttcaacatagtattttttttttagatttggcatttcaatcactaagaacatatatataaaattttactcatatatcattttcttaaattgctaataaatcgttatggtttataataaggaccgtaacaattaaagccgatggcttctcctgccatagcagatcaagccatggccatgctactctagcctcccctagggtagtgaacaagagttaccaaggtaaaagcttcagaaataaccacacatttaagcccgcagctgctgtccccgaaaaccctccccgaaaaccctccatttaatcacatcgtttgtaaaatgtttgtaaaagaaagtttgtacttataataaaccacatgcatgcccttggctacatgcttatgcagcaacaagacataccctttctacgagttactgatttacattcagaaattcagatgcgcgtgtattttcacttcagagctgaataacatgaaaacgatgcatatgctgaaaataaaaatcagatgtattcgaataattttctgccattttcaactaattagtatttacacgtacgttgattaaattggtgagtttacggtgtagaacactgtacttcccagcagaaacgaagagaaaatgatgcacatcagaaacggagtatgtgtaaacaaaactcaagagggcagattaactgtaaggttgtgctggtgtcataataatctcttcatgtctacaaagaatggatcatataataacagttccaatctgacaaaaacgcctattcctcaacagatgggaggagctaggaaactagaaagaaaagagagaaaatgtgggcgtgaagagcagctcatagcaacatacaaaaaagcacaacatgttacaatgagggctgtatcaaaactaaataaatatcgcctcagccctacctagggactcagaatttgcaagacatcgccattgccgcagcaacgttgatatgtctctggccctgaatctgtgttacgcagctaaatatcaatttcacaatttacataaaatagaagaagaaataaatcctagggaattcctaggccaaaagcaaagaatcgtgtagagctcaagtggacgtgtagctggagtgcttcagtaggttgttgagagcttctgggtaaaactttctagcaaaaaggtagcatggtctctttgttccgttccacatacagggtgtcattgtcacaactttctgcgatagtgataaatgtacatatcaatattacatgtaggagctacatttctatgttttagttaaattccttgactgcgttgcatgcagacactcaaaagcaaatatcttcagg

SEQ ID NO: 64070 - DNA, 3009 bp, Oryza sativa
agagcataccgttatgttcttcaagagtgcataggtaacatcaatagctctatacgaccttggatgccattttccttcagaccaatcaacatgtgtcactgaccaattagagattccaccaggatctaccatctgaagatgaaagtgaaagcatatgaaagaaaagcaagggaccaagaagaaagctaaatatcaattcaaaatattatttactgacattgaagagggttggcaaataatgctcatcagcaatacagttgcgtccctctgctggctgcagaacacaaaaaagcagaaaaaaattggtgtattaaataacattatgtatatatacattatttcaacgatatgaaacacgtgcttcacgatttttttttcttgacgagttaacacccttttgatttcctgtagcatatggctaaagcagttaaaacttagaaccaagtggcacaagtcttaaattcagttcatctccaaattatcatctctactaaagctttacaattgccaatagcagttccaaatttcatatctcaactaacatcctagctttgatcttcattctgacagtatcaccagggtatcattttccctctttgggataaatcctggtaccctggtacctactgtgatgcctgttactggctggttcccaatgaacaccatgaagatgcatttattttcatttatctactagatacactatagtaataggatttgtgtttagatgctaccaaaataacttagtaatcactgtacacgtgaaatgaactatagcatgatgggcatcaacaattaacaatcaatgaaggaggaacataccttgcaatacagctcgaacttattgtagtaaaggtggtctgctaaaatcagtaaagcatgccttcgtgttacagcaaaccactacaacacatacgaaaaccaacttagaaaagcataaaaagatggaagtgatatatcatcattctcacaaacaaatgtcctagtttctgaagatgttgacttaaaagaatgcctctaaaccaagaatatatgaagcgcctaacaaactttggggtagtaaacattctgaagaataataaagtagtaatgtaaaaatatgaacctgggcacccttcctgaagtccctctgttctatttcagggagcatttccacagaataccttccgcttccatgtggtccaggatcaaggaagctgatagagtgaaaaaacacaatgaaaaacgcacacaaacatgtgtgactaggggagatagaaaattgtgcggtgatcatagctctgtgttaatgcattccattctttaagtcaaaacacaccaacgttttctacaccattcttgtgatgtaacaagggtattcctttgtaaagaaatataagccaaaagattgatctagaataaaatgcatgatgaaatattcctgattttcatattcccagttattctctaggtcacagatgaaattaaagtagaaatgttataatcaatataccaaagaacttttttaaagcagaattacatgctctgaaagtagctatttcctgcacttgtatgtactatattttcctcttgtcaaatggatcaaaatatgagttcagcgctcttaccaatcaatgaagctgacgtttgttcccatcaaaaaattatatatgtaatcaaatgtatgtagtggaacacagctgtcaaacaaataaaaaggatcttaacaaagtgcaacaaaaacattttctttttgcaggcaaagttttttaaaaacaaaacctgtccgatagcaagacgaaaaattgattatcaacatcttccaatgcatttgctagcagcctcttctccgcatcaaccattgaaatcctcccccatacaacctgcacatacaaagacaatgcaatgctttagttctgcaaaacaaattataaaatactatgttggatgtaaaagaaatcacaggaatcactgatagcaaaaatttcaaaagacaaatcacagtccttttgcttatttgctgcaaaatgtactactaaaaagtaagaacttcttaggagaaccaacatggaatttcctaaacacaggaagtacaagccagattaaaaaaaaaagtgaactaagcctagctcatctgatgggtgtgggttgtgtacactaccaccacctaggctcaaatcttcttctttttgaatttagatatttctttttctttattttaacaacatagagtttctttgttaaaagcttgccttatatgcaggtcattggttgcaaatgtaatctcacttatagtcatcgaaaactaatccaagcaataacacaattttcttctttcttagtataaacaaaaggaacagttgtcaatgcataacaacatttcttattgttcataacaccttgctaagcagatgagttaagataaagcaagaaaagaaacaaacaagtacacagtgtgggggtgaacattagtaccttttcactatgaatctctcggccaacaaacaaagaactagaatgtacaggtctttcacgcgatgcatggatataaatggaatatcgatcctcatgaccctgcacacagaagttcaagcaaataaattttacaaactagatgttgatgcatctatacatagtacaaactccatcctcattacagaaagaagcacatgatgggtatatctgcgccacacctgtagaaatttctcccatagtttctcaaagggcaatgaacctggtgttaagaacatcaaggcaatctttggattcttcgagacaggcatgggcattgcaaggagatccctcataacaacagacgagacgatctcttcgtctgttcgctcccgtcgggtcacagtagggagccaatccttgaaaggagtgcagacgctcgaagcgaagaagtagcacgcggagtagcggcgcggagggtacgcgtaggccccgatgagcgcgacgcacaccagcgacagcagcacgattatccacatgggcttcttggcggcgcctcgttggcgcggagggggcatg

SEQ ID NO: 64071 - DNA, 4155 bp, Oryza sativa
  unsure (1)..(4155): unsure at all n locations
attcctgcagccccactctaccatgaactagttactattaaatgcagttttgccaaatttgcctctctttttttattctatgtgtctccaatagtggataacatttttatgctcaaattgtcctcaataaatgataatgctaggctcattgtttttgcccttagaatatttcacagacttgtcgtgcccccacgaagctgcggttattgacctctgttttggactgttcaatttcaggcatatgcatgccttgccgtggacgatggatcatcgtatgatttgaaacactacaccggatgttaacttagaacttaattaatagagaaaccaactctaatatactcatgctcaaagtgtcaaaagtcaaaacaacactcgttttatcgctaatctgtaggagttgtacacgtcagaaacaacattgttttgttctgttttggaaatagaatataaccaacaaagaaaagggagaattttaggttgaaataaataaagtatattgcaaaaggagaatccagccaaacaagtaggagtttaggagaagacaacattgacaaatttaaaactctgcacacacttacaacagggatcacaatgtaataatatattaaaatattataaggttgatccgttgatttgagttggacattattgattggccccaaatgttaataaagcttggaatttctgtggaaaccattcacatggatcgagtcaaataagtacaggctgctgggttccagacaagaaacacagtgatatgccaatgtgcactgtatctgtactggacatagcttggtctagccactgtccagcgtcagcatcttgcagttccagcatagtgcaaaagggattcaatgatggcaataaaacagcaaagattagcatgatgttnattgttgggcgagtcagcatcaatatttattagcgtggattggcttaatctgcctaccacatgagttttgtgttaataacctggctgcgtaattccagccttccaatttgacatacagaaacaaaggtctaaatgcatttagttggtgtgactaactcatacttctggcctataagtttcaatcgtacaataaagaaaaaaagagtactcaaaaagttaattacatatctcttacctgctcatcgtaccacatcataaactgccacagccagatacctaaaactaagcaacatttgcttttcaacgaacaaataaagatgaatgaccttcaacgaagacttttaaacagatggacatcgtatttattcgactataaacatgcccatgtttattacaatgatgtgaatgaagatgataaataaatgatacatagagtagaaataatggcgtgtccatcgagcacttgggatcaaaacctgacaaaacgacgacggcgcgtatagttgcaggaaaatttctacatgatctcgacctagagcctcggtagcagcaaatggaatgcttccatgttttttttatagaacatttggtgatatatccttattgtttacacagaatctacaataattattcaccgtgcttcgtcttctagattgcggaacccggcggtaaggtcatcgtacagcttctgaaatttcgcaatcaaaacttctttgccctctgcgggatcctcgaatttttgcgacctgtgacaagcaacaaataccattggtcatattgcaatctacacagcgagtgttagaaacttgaaaatagggtagaaatgcgtacactaggcggtagaatagatcgcccatgcgatgctttatgacactgtatgtaatcttctgtccatcagcaccagctgcccgctccaccgcctataaaacaataaaagcatacagattattaaaatagtacttatgctacttttgtatgggaatatcctatttgtaattatattgagtaatgagtaaacaatgagtaacttatatgacatacaacaaacagtgcctctaatcagttcagttgtcttcaattagctccactcattcacctttcaatgtaaatgataccttaagtgttgaagttccatgctgatgcccatgctaggattcaattatttaaattcaagtgacaaatcgatccagagcctatctatgccagtaatccaaaacctagaactccgtatataaatccaactcatactactatctttttgttccagaaatcagaaattctagatcaaacaggaaccagtgtctcagtttcacgccactctatgatcttgggatttggggcctctaggtgacccagattgatttaaatataagctcacgagcatcagtgacagctgatagaacacaattattggaaagttttggcatgattttctagtcagctaggattggttttctaaagaaaattggcaaattatcgaattcctggaacaagagaatttacctgggttgccaatgtgttgaaatgaataatgttgcgcatcatccaaacagatttgtagaatgggcaatacttatcatatctgtttcatgcaacagaattgatcaattagttaatatggattatgacacaggttagtagaactatcaaatgggtttaacactcacggggtgaatgcattttgtgccaaataatcttctctcagaagttttgctgtctccagtgtaatcttgtcagattctgccagtgcgtctttaccaacaagctgaatgtggggtagagtcaacaataaatatcacacaaagaacaacaaaagctcaaatcttacttatgccacagcttgtttaaaaataacgtacgtactaaggtcaagtttattatcattttcaaaatattagcaggaccattaagtgaacaaatgccaagaaactggtacaaagcacttatggtaggcaagtaatatgtgcgaacacttctgataggatgttacatttgcatgatgcagattaataagaagcattacagccaggagggatacgacagtatgagaaaaggtaacttcaataagacaggtcaaaccatcgtggaattccaggagagtaaatattcacaaggctcaaaatagtacctgcactatttcatttaaatcatcttccctctgcaacacctcacgtgcctttgttctaatatcaatgaaatctggatcttccctctcatagtgcggctcaagcgcctgcaacacaaaacattgtattgtcacataacatcaaagcaaatgcgaacgaacaggaaaatgttcaaatataacttattagcatttcattgaaaaaaatgagttagaagaccaaaaacaattagaacaaattataaccatagaaactcgtatagttctgttattctagagacctgttgtctacttcctctggccactcaactccttcctattctctccgttttatattttgtcgctttgacatttttcctagtcaaatttctttacatttgaccaagtttatagaaaaaattagcaacatttacaagttacaacatcaaattagtttaatcaaatgtaacattgaatatattttgatactatgtttgttttgtgttgaaaatgttgctatatttttctacaaacttttaagtttgactagaaaaaagtaaaaacaacttatagtgaactctttcatgtttgcccttgtcaaataaaataagtgctacagctctcacaaataaatgttccattttttcaatagtataaaactataaatgaatggcaacaaaaaaaattactttattttcttccccttaatgaaatgaaacgcaattctcttgcattttcatgaaaataaatgaatggcaacaaattcattttagtactttcttaatctttgtgcacaagtctaaatcaacttacagttggaatctgaggggagaataaactatttaagcaagttgcttgtcagaacaaaccttagaatatttcgaataagatatgagccaattcactgatgggaaatgcttcctctgggcaagctttttatctaatccccagaagacctacaaacaagaacatgtggtttaacaacactgaaacgataaacattattaatcatgacagacttagctgcttccttacctgaacaatactaagggttgcagaggtaacaggatctgaaaaatcaccaccaggtggagagacagcccctacaattgtaacacttccgtcccgttttggacttccaagacaccttacttta

SEQ ID NO: 64072 - DNA, 8664 bp, Oryza sativa
  unsure (1)..(8664): unsure at all n locations
tgataaccatataagacgaaactcaaaattcatggtaacttacagcatatagatctccacccgtgataatatctccaacacctgcagcataatgataataggagatgattttagagtgccttgcactgcatgctaaatgaaaaaggataacaaaaggtaacccccccccctcccccctgaagtatacaaaatactttacctagtttttctggcttaaaatgccacaaagcatctttgtcaagggcaggaactgagacaccacgcggaatgtacacatctccagatttaatagcaatagttttcagagggcgctgcaaacacgataggaaaaaggacatgacaagagttaacagacaaggagtgcaaggagcttaaaaaataaatgaaattactccacattcacaacttgaagtacctggatcccatcaaaaatgttcccaagaataccaggtcccaactcaaccgacaggggctgtgcaggcataacctttatgtgttaaaaacaagcaaaaacaagtacgcttgacagatcagtttaataaatgacaaaaaagcacctttcgtgttctcaaaacagggtcgttaaccatcagtccagcagtttcctcataaactgtgatacacaaataacaacatttctgatgttagatattgactatggtttcaacaggcatataattgctatcagaactcgtgtctgtatgctgttaaagatagaaactaaagagctgttccacaccttgaattgtagctgaatccccctcaagaccaataatttctccaataagattatcgtgcccaacacggaccagttcatacatggcagcacctcccattccatcagccacaaccacaggtccagagacctaaaacaacccattcgatcaataatgttcatcaacacaatgaaattaagagctaaacatgccatcatacaaaagaaaaagggcaattactagtgcgcatataactaggaagcagatcttagcataagatgacatctaaatattctaccagacagatacgatagcactgagttcataataggatctacgattccaacacataagtatgagaaaactcagtttagcattaacaaacactaaatctagcataaacctatctagaaatacatgagtgacgcaattcattgttgagtggcacggtcagttgaactatggcatttttggaatgatgtgtattgtttctaaatagatactccatccatcccaaaatataacaccgagtactgcgattctagacagatctcctactaggtgatgccaaatcttgtactaggttgttatattttagaacaaggggagtagcaaattcgatgaaattaagcagagagtgagagtgcacactattcgtccagggttcatcattcaatccataatccgggagaggaatagaagccagtgtatcttctagtggttcttaaattacaacaaacgaacaactttatttttacatccaaccacgctaatagcaatgccatccatcagtcaaattgtcaaaacacatctgagcaccgctctagtcacgagttcacagtaaaacctaaactattagcgatacccctgcaacaaaagatcatatcattatatgatggcgtggtacggactggcgatcagaacaccacaccacatgcgaatctcaagcagagccgcgcagcaacacggactctccgcaaaaccccacccgaccaagcgagctagccaccaatgccagactggatccgaaggccctatctagccacccgcccgcgacagatccccaaagcaatccgcgccatcaccaccaccaccccatcccatcctaaccaaatctcggcgccaattcagccccgatccgaccacgcccccgccgccacagagcccgcgccccgtcgggatcgcgcggaacgagcacggtgggatctacattggaagcaatgcgagcagaggagtatagcggagagggggggaggagggggggtgacggaccttgcggacgtagccgtactcgctctccttctcggagtcctcgaaggtggtgatgcggtcgccgaacgccatggccgccggcggcgaggacgagggcggcggcggtggtggtcgtcgtcgccgaccttcggatcggcggtggcggtgtcgcgatctggtcggggagggaaggggagggagcgatttgggcggggcgggggtgaggtggatcctgccttaaatagatgtcgtcgtgtttttttttgtttttctttttgtttcggatctgattatattttggtgctgctagtaattgggttcgtctcgagctctgattggaggacgcctcttcttttctgatacggttgcgagcgctgcgtctcgtgttggtttaggacgctgacatgtgggccggtgggtcatagaatctgtggccttttttaagtgcacagcattgtggcctttcgagatgtgaaaagacatctaagaacatctccagcagtaacccctactttagagctcctaaagatcaaatgggggctgccaccaattctttatgactctaaaaatagcattaactctagcagtagccccctatattttagcccctatttctttttctcttttattttagtataaattgtatgtttgtgtctaccttaacaccataataatttaaacataaataattctagcgcatgaaattcaaccatattgaaatttacaattttaaacaccatgattcaaatttgaattcaaattttttaacatgagaatgacatgtcctacaagaaaatattgaacacgacccatagttgacaaaaaatgcaacgaaacaaactatcgagcaccatgaagcgcccacaaatgttccataagaaaatttaatttccactatctcaaataacaaactagacaattatattcataataatcaaagcctataaaaagaagtgctacatactaaccgataactctactgatccatagcaacgacagttcagtgcagtgctactagtacaagcacagtgtttgagattcttctctaccaccgaagaagtctactactcctacagttctaaaaaatatataaaacaaatcaatatccagcacaaaaagtggtcaagtataatactactacttctctgctagtagtactcctaccacacagattagatcaatccagaaaactctagggggcaaagggcggcgagcagagggcggcgtgtgggctggcttggagtagtggccctccggcagtgcgcaggcggcggccctccatccggtgggccaatggggcagcgtgggggcgggcagccgttggctctcctgccggcgagcggatagcggcatacgggtggacagcggtagggacgatggctctgcagcgggaggaccatggctgtgcggggtggtgtgtggatagcaacgtgcagaccgacggcgggaggtcgtgcgacaccatgtggacggcggactcgtgagggcggcggccggagacccttgcggatgatgggcgacagaggtaggggaaattctcacctttttgtgccaatcttgccggaggtgcaggggaatcgatggccgccggcgctggagcccagatgagatccagcgtcgcggtgccgcgcaggaatgtgatgagagcacgaaagtgaattgtcgtttgggaccagaaaaatgtcaatgggggctgtgctcggagccccaggactaggggcttgggggtggatctgagggcctcctcattttgggggctgggtttagggtctctgctggatctagtttttttatgttaaccctcaaaatttgtttagggactgggtttaaggtccctgctggagatgctcataagagcttgtaatcttgatttacaataacagtgatactattagatgagtttttacatgtcaggttagtaagtagtagcggttttttcctgtataatattgtgtgaagcaattttttaaaataaattgaattgaatttgatatacaactctgaagttgtcatagacacatagttgtaagtattcagaatataatctgttgtgatgtccaaatgttagtttctgttccgtaaatacatttgtaattagcatacaatatgttcattaaaagtattgctaaatatgatatatataaatcttatagtttatatttccataaatataaaacatgttagggtcaaatactaaaatgtctgaagaaacctgaagcgaatctggttaaaggcaaacatgtggtttgtgcgaaggtgaagaaagtgcataggacagtcaatccccaagatgatgttctgcacggatggaagccgccagatcagggactgatgaagttgaacattgatggttcttttcaacctgatacagggaaaggcggcctgggtgtggtgctccgaaatagactaggagaagtcatctttgcagcttgtggttacatccaacggtgcacaggtgctctagaagcggaactgatggcgtgtcgggagggattacttatggctctccaatggacactgctaccgatcatcatagaaactgattgnnnnnnnnnnnnnnnnnnnnnnnagtccaaggagttggtccgatcggagttgatgtttttagtcaaggaggtgcacgacctcatgatgggaaacagggttgttagtcttgctaaggtgcataggaatcaaaaccgtattagtcatgttttagctaataaaggccgagtggaggaacttactcacttctggccagacaatagctgtaatgctatcgcacaactagtttgtgtcgatgctttgattgaataaagtgatccctgtttcctcgcaaaaaaaaaactaaaatgtcaaattttaccaatcaatatacgttctaattacaattgatgaaaaaatattcatgccttcccctatatagtatttagggagtgtctagatttattaaccgcccggaatttaaaattttccgtttgcttttcataggtatcacatctctccgctgttacctaaccccttgaacaaagcccattctttcaaagataaatggttgaacaatgaattgttctaacctaaacaggacaaactcacaattcatgcaaaattagaaaatccatgtaaaactattcaaatttgtacaaaaaaataaaaccatatatgacaacaaaaatgcagttaaatccacttttctcctttagaggggattgaatttcaggtggagatataagtttcggcagctaacgtggatttggtatttcagatttggcattaggtgcattatattccaccatgcatcttttgtacacacaactttttttattcaaactgatgctttaaattcagataacttgttgtttgttagtcaatatgctaccggcccgtttgatttagattatttatacggattatctatttgattatagggataaattaatttttttaaaaaaatgttaatatttttaaaaagaagttatgtaaataataaagaagaaaagaattttgagcaaccatatttttaaagtgtggagcaaataatctatttcaataatccgatgaataaattaagaagggcagcataaactatcaagtttattcagtcgtcgcaaattaccttgttcaaacgaacatttaaactcaaccttttagcagcgtcggagctagctcccgagctggtcgggtagtcgtccgagctccgcggttggcattttcgttatattctaacattaataccacacataaaatattattgattgctagctactccatctatttcaggttataagtcattttaactctgattaaagtcaaactaatttaagtttgacaaaatttatagactaatatagtaatatttacaatactaaattagttttatcaaatcagttatcgaatatattttcatataaatttgtcttaggttaaaaatgttactatttttttctacaaacttaaccaaacttaaagcagacttataacctaaaacggaacggcggaacgagtaatactcttcgtagttcaggcatcagagtaaatacttgcaagttcgattacctgcacaaacattcagcctaaatggtaaatgcctcagtatgaattgttttttatttttaattgagttaaagtgggtcaatggtagactctcctccatgcatcgagacctttttacctgtctcggtcgtatccatttcttccttgtgcaagatcctttgcgaacttcaatttcattagtttttccctaacttacaacagaagttcagaataatatgaatcaccactgcctttgttcatcttgcaaagccacaaaaggatcccttggtataagcaagcaccttcagttacctcatccaagaaattaaatgttctttccttgcagagaccacacacacacacacacacacacagatatatatatatatatatatatatatatatatatatatatatcccctatctgattcgtgttcatcacacatatggataaaaagcaccccggttcatctgaatttcgaagatcaaattaaaaatggggtgctcgtcgtcgaagaaggtggaggaggaggcggccgtgaagacgtgccatgaccggaggagcttcgtgaagaaggcgatcgcgcagaggaacctgctcgcctcctcccatgtcgcctacgcccactccctccgccgcgtctcgctcgccctcttctactgcctcgccgaggacgagcacctctacttcctccaggacacggcggcgtcgtcggcggcgccgtgccggcaccggccgtgctcgccggagaggaaggttcttgtcatgaactggctgagaccagacgccggcggcgtcggcggcggcgcgccggtgcacccggtggtggaggtggagcagcggtgggaggagaatgatgttgccgccgagaccgtcacggtggacgggttcttcggcgcggatcccggccagctcttccacccttcgtcgtacgctccggtgaatgccatgccggcctcgccgccgccgccgcagccgacaacgacatgggacttcgtctcttgggaccctttctcctcgctccatcacgatcaccaacaatacgtgagctatggcgttgaagatgacgaagagaggaggaggagaagcgatgacgaagatgacgagcagatgccggagctggaagaagaaagcgacgacgccgccgacgacgacgacggcgacggcgatgtcaagctgcaggcggaagcttcgccggcggctgtggagcggccgatggcggaggaggaggaggaagagaagacggtggatcgcgtgaagaacgaactgagggttgtggcgagcgaggagatcgagcagcagagcacgccggggttcaccgtgtacgtggaccggccaccggcgagcatggcggaggccatgagggacatccagggccacttcgtgaagatcgtcgacaccgccaaccacgtctccgtcctcctcgaggtcgtcccctaccagaggaaaggtacacgcacgccattacagcctcttgtagttaatctctcgcaaacaatgtcttcctcttcaggaaggtttttaagtactcgatgaacaatgtctcgcatctaaactaaatagttatagaataattctaaaaattttaacaaaatagattgatgtattacactttacaaatatacaagttaaaattcaacttttacgagttataacaaaaataacaaattaaactgcaaatatagttatatataaatagagaaatatcaagtgaaaaccatcaaataaatgaaaacctgtgaaaaccatatctaaatttttgtaaattcatgaaaaaattactagagatagggacatgcatgaattacattcataccaaatatcacaaatttcgggtgaatactgttatgttactattcacacgaaatttgtcttttttttctctcaaatgaagttgagtttggacttaagatttggtatgaatgtatttcattcctgtaccaatctctagtaattttttcatgaatttataaaacttttaaatatggtttccacgggttttacttatttgatagttttgaccgaatatgtcccctatataaatataggtatactcaatttgttatttttttataacttgtaaaagttaaatttaagcttatataagtgatatattacatataaatatattttgttatttttttaaaaaataaccatttaattaacagagaagaaatattagaatccattccttcctcttcttcttctccatcattgatcattgatgtcttgtagacagtccgaccagctgctccgagcgacggtgatgacgaggaaggcggcggcgaggtctcgccggagccattcgagctcttcaagagccacaaggagagcctcgataggctctacgagtgggagaagaggctctacgaggaagtcaaggtagagaccccgatatcttccaaactctgacgtcatcgtcttcgtgtagctccgagcttttcatttcgttttccatggcggtggtggtgaaggcaggggagcgggtgaggctgtcgtacgagaggaagtgcgcgctgctgcggagccaggaccccaatggcgccgagccgtccgccatcgagaggaccagggcccccatgagagacctcccgaccaagctcgacatctccatcacctccgtcgaccccgtctccaagcggatcgccgccgtccgcgacgacgagctcctcccccagctcgccc

SEQ ID NO: 64073 - DNA, 11298 bp, Oryza sativa
gagcacatgccgcgcctcctcgccgcgtgggccgccgcggtcgaggccgtcgacgtcgaggcggccaccagggccgtggatgccctcgccgccgaggcggccgccgtcgccacggccgcgcggcggcgcggcggcgaggaggagtggaacgaggaggaggggaagaagaggatctgcgtcggcctcgcggcggcgctggcggccacggcggaggccggcggcttggcctccgccgcgtacggcgagctggtggtggagatggaagagagggagcgcgcgagggagatggcgggaagggacgaagagcaaaatcaaaactgaaccaaaccattgtaattgtaaattaaatcgtccttaaccattcacagatcattattagagtcctttgaagcatagaaatcgcactcaattatttatcaccatgaattgttcagaaacgaagcattcactttcagagtaaatctgatttaccatatccctaccagatgaaattttttcgaccatttggtcacttacctgaattctccaggctctcaccaatgatggatcatgaattcagaaggcaagctcaaccagatcagaaaaaaatagttccaaattccaccacatttatacttcgtagtttcagactttcagtctcttagctagtcagttctattacaggaatagggaagagtgcatgacacttcgacacgaggactctgaaaaactcaagtccgttcacttggacacatcacgtttcaaacgtagctgagctgacatagaagtaggaccagtagtttcacttggacatgccgccgttggggtggttgtcccagccccaggcgtcaaccacctcgccgccgggcatctgcaactgctccggctgggacagcccggccgtgaaggggtcgtcgccggcgtagtccaggccggcgagcacgtcggggacgcggcacgcctgccgggggttcagcgccggcgacagcccgcccaggtggccgagcccgcacgacagcgccccccgcgccaccatgtcctccgccatcttcacctgcacttacaaacggggacgaattcagagctcagaaaccggccgaaaatgcaggacggatttgacgatggctacagtgatgagcaatgcaatgtgcagatgaagatggagatgaatgatcaccttgacccggagggcctcaacgtctgatttgaggattctgttgtccgtgacagaagttgtgaattgctggttggcatccgtcaactgcttgaaaagcgatgcgttttcgccccggagctggtcaacctgacaaacaagagcatgatttgagctatggaaatctgaaagaaccggcactagcatttcgcattttgactcagaattacagctaccaattggcacatgatttgttagtcgaatcaatctgttactgtttgaattgaacaatggcaaatgttcggcaggtacaaaacttcagatcatatcagtttacctgtgactcgagatcagctaagtgagcttgctttctcttcctcgatcgccgagcagactcccgattggacaccatcctgtaatttgaagcccccaaccgtttcatgcaagttctttgtcaaacattccttctgaaaagcaatgttcaacttctactactagcgaatatgcccataatttttcacgcagtgacagacaaaatgcttgacatagtcgcttatgttcttggaataccttctcactctcttcacgtccaacgggttcgtgctttgttcgcatggaccaccctctatatccaacagcgattcactttcagaatccgaaccacttgtgcctcccagagtttggctctccttcatgttcagattggtagctgatgtgggacttgctgctgctgattacagaaaattgaacagagagtgagcaagaacaattaaataaactgaacattgtttgtgcctcatcaataaacacaattttgatgcagtacatgacacagtaacagcactggtactgtccatggatgtccatcgctgaaatctccatgagttgaaaaatccaagttgcatgtgcttttcagtgtgcaatacagtagcaaatcattgagtacatcgaacaacaagtatttttgtgtgcaaattgttgcagtcttatgaataattgatgaaaatcgtggaagatgacgagtgtgaggccgtaccacagattgatgactgcgactcaattgtcgtggagaccgcaggatgccgtgcgttcaggttctgggactggggccatatgtgattgggaatgccccctgtgatggtgctctgcttggacaaaaatataagtaaaattaatcgagtgatcaatcatgcaaatcaagaatcaagtacgatttaagataagcaaccagggcttgtaatcatcttccttatatgaaaagaattacttatcaccagtccttaataccaacttaatcaaaccctgtcatgacaacggaaactctcatgttatgctgttaacctaaaatggtttctcctcttccatgctttagaattcatgatttcctcttatcgggctattcaaataaattcttttaaaacacaagacatcattcgttcgcgaactaaaattgtgcaagtttggtgtgcttgtgttgtgatgtgtgtcttccatataatcggggaaaaaaaactcctagtaagagtaaatttattactgtctatccatattcatagtattaggatatgtcgcattaagttgcacgtaagtatatgagtatattggattggaggtcggagggagtacttgcgtaccaactatgaaaaattactgtacaagtaaaaaaatggtagaggatgaaccaacagtcttctacttgagaaaggtagtaggagtcagctgatcagcagcaattaacgaaaatttcgcagacatgaaactctagtcaagcatatacaagcacgtttctaaaaaaacgcatatacaagcaccgtacgtgctactgcaagctatccaatacagcaagtgttcaacttaattttagcacacgaatttaatactacggcccagtttagatccaaattttatcttcaaactttcaacttttccatcgtatcaaaactttcctacacacacaaacttctaatttttccgtcacatcgttttaatttcaaccaaactttcaattttggcgtgaaaacacaccctactactactactatactacgtagtcgcagcaggcagcataataatcagtaatcaatcactcaccgagtccgcgaagccgaagccggagaggtcggcggcggagaagatgccgagcgggtggtcggcgtcggcgtcgccgcccccgcttccgccgtggatgaacgcctcgatgtccatctccgattctccgtcgtccctgctgcttccagcggctgcggcgtcggcgatcggccgggtggtggcgcgcggcggcgtcggagtcggatgcttttcgagatgccccggcgagacagatcaccgaggaggagaagggaaagagaagctttttgtgttgatcgctgcgaggaaggaaagcagctcccttttgcccctcattcccctacgtatttacgatactgctttggaagccgccgcgaaatgcgttgcggcgtcgggggtagtttgggaaaatggcggcgccggcccagtgatgggagccgactcggatccgcaccaccgaccaccggcggcaacgtgacggcgcaccacgtcagctgcccgtgatcttctgtggccacacgtttttgcacctcacatgtgatatgtcctcagtcacacagcactcgggtgcaaatttttggtcacttttaaccccgaactattgttttctttcgcgttttagggtttgcattttgtccttgttttttttgaaaaatgaattaggccctgtttagatcactcaaatttttttatcatgtgacatcgaatgtttaacacacgcataaagtattaaatatatgcttaaaaaataactaattgtatagattgcgactaattcgcgaaacaaattttttaagtctaattgctccatgatttgacaatatggtgctatagtaaatatttgctaatgacggattaattatacttaataaattcgtcttgtggtttactgattaattttgtaattagtttttttattagtgtccgaacaccctatgcgagactctatataatactcgatgtgacacgccaaaactttataccccggtatctaaataccccttagttgtttgccctcacgggtgacggtaggtttgacggtgttaactctagcgcgaaagaacatttatattctcgattgttgttgtattttgaccctatatttttcaacccgtgcaactttgccctttccctagatcgcatagaagcaatcccatgaccctttcacccgccgctcaccgcaacaagccccacagtcaccacctaccatggcgtgccttaccgccgctcaccgcactaggcgtaggaagcctcacgattgtcgcaggcctccacgcgcctggccgctgcctcctctaaggtttttgggtggtgacggactacaagtacgagattcgatggtgcttggaactctatccatttactcagggataacaatgaatcaatatttcataaatcattttctcatactccctccgtttcaaaatgtttgacaccgttaactttttagcacatgtttgaccattcgtgtacatgaaagtatatttaacaataaatcaaatgatatgaaaaggataaataattacttaaattttttgaataagacgaatggtcaaacacgtactaaaaagtcaacggtgtcaaacattttaaaatggagggagtattttaaaaatgcccgagcgttgcaacgggtgaaggatattttaatcatgttactgttatgctagaaaaatacacatgctttgttacgggcaaaggaacagttagatgctataaagtctagagttaacatgtatatagtaatgtttcatgatagataaattatttattaggctaatgataatcaggatggataaaaaaacacacactctctctcaacccttgtgtgacaaactgtgatatcattgcactgggtaatggttaggtgaatgaaatttaacctcaatgatttatcgaagcaccttcatagttatcacaaatgcatatttgtgcttggacaattaatccgctctacgcgtgtaggatgtgaatgatgtccctaacacatggtcccgatgattgtagcattggagaaatggacgtctgagcaacgcacctttacgtataagtacaaaatgaattttttgggagttcattaattattttaaactacattttttatgacacttttatattcttttttcataattgataattgctataacattgcattgatttataatcacaatgcaacagtacactgctatgctctaaccggcaaaacctgaacagcgccagccgtaccatgccgttcctttttcttttgtagaaaacctcttagtgcatgattaattgagttttattattacaaaaattaagaaaaaatatctagtattttatatcaattgtatatagaaagttttaaaaacgcgctaacaaaaaccgagatagaaggaacggagccatggtgtgaagtttcacaccatgcacatattcaattttcatgtttttaaaaaatatcggttggttcacgtgtttatactgattttttttatataatataattataagatttcagaatcactaaaagtctgttgaagaaagaggtgcagaacttttgattttttattcatcggatgtgcatggtccgtgctattggttgagagaaaaaaaattacgcgcaaatatgatttgacagagggagggaaagtagacttattctagggcctaggtaaacgtatatttatattgatttttgtgtacataatttaattatttttaattttcgaattaaaaactgattcattataagataagatttcataataaattaaaatctgttggaaaaagagaaaaaaaatcgaagtcaaatataatttgacatgagggaggcaaagtagacttattttaaagggataataggtgtaaaaatgagaggaaagtggagtcgaaccagggtggccgaaatgaaaactttcatccctcaccaagtgggcagactactacatgtgagaagtgaatacatggaaaatatatataccgtatcaaacgtggttgtggagtagataaaaaaagcccgatcgggctgttaaccggattaaatccggatttagcgtagcgcgtggtaatgacgtacgaaaaaaaacacccggaaaccttacgtattttttaattagctatatatatatatatatatatatagatttaactaaaatccatggggcccatataaccagacatcaaaggtggaggcaaacgactgattccttttaaaaaataaaggcaaaaatacaaaccctaataagagagagcaaaacaacagtttatgttaaaaataaaggacaaatttccccatcatcctccccatgcgggtacgggaagcgggggcacccgtcaagttccccactgcccgtatggcatctacaaagatagaacctccatcaacgagtggaaaactacagtattgcaatcaaataaggtggtgggcgatggcacatgtttttaaacggctaaacaatgtgttttctagaaagtttatattaaaaatactatattttaaaaattatattaatttatttttaagttttttaactcatactctatccgtaaaaaaaagcaacctaaatgagggtttaacattacctaggactacgaacttggacaaccatatgtccatgtccagattcattgttttaggtggtgtcaaatcaccaattaggttagttttttttacggaggaagtacttaattaatcacacattaatccatgtctcgttttacgtgtaggaaggattaattccaaaacccacagtaaaagactcactatcctaatgagggctaaagtaaaccgggccaattgggccctattgattgggccgtgcccaaccgtagcactagcagtaggctgcctgaaccatcatcgccgtcgtcggcgaccgcccgctcgctatcgaggtcgccggctcgcgccgccgccgccatgcgagagcttcccttcgccgcccgacgagatgtatgtacgctccgtgaacccatcctccttcactaatgcattcccctactcgattgctctgctgcatccttagccgttgcttcagatctgaaaagctaggtccatgtgcatttggcgttcgattcgttgcatccagtcatgttggggatttgtgcgagtcgtttcgaattctctcctcttctctgaatgcgtgaagctgttgttcgaaaaaaaaaacccccaatattttgctggatgaattggaagttggaattggtgtagagaactatggaggctatcacaaaaagaaactggaatacaattttttttttgtagttcattttagcacaggtggaagatgcatggcttcttggtgaatgaaaggccacataatgctgacgagcatctttcacctaatcacccttgttattctaagctaagctcgaatctgtcgctagcacattgttgtgtacacctgaagctgttcagcattatttagctacttttattctgaaattggttagatgttatctaagcttccaggctcttccacccttcatgttaaacgttttaagcctcccgaaaagcatgacgatgatcaggatcgctttcccattgtcgctccatttccccgcaaacccgtacgaggcatccttgcagcgtgcatcatggttcagtagcctcttgcagctgtagccaaccgagaaccccacatttccatatgcactgcaacaatcagagccagatgttcagtgatgatactcatgttaaaaaataatcatgagctttctgcagaatgcagtgaatttcagtggcttgcctgacgacttcaaacaatatgctgaaaacattgaaattaagtggatctgtagccatcgagtcccgttctgtgatgcaaattagcattacaaagatagccaaataagacatatgtgagaagatccagttctccaatagcccttttcttttgtttatcttctcggtcttagaatcctcaccatcatgtctgggtaaaaacgaagtgtaaccagggagatacctacataaaaattagtcaaagtatgtgttaagattacatattaagaacaattcctctcaatgataacatatactggactaactgctttgtatgtaatatactgttgagcctgtaagtggttcttgaactactatagtcctcaaccaaatctagcactgagtctggcttgtgggattgtgtgattaaaaaattcctttcttaataggtaggagtactatggtaggaagctttcctgtgtattcttaaagattatctgatgtccttatgttccattctactatatgcaacctacctattagtgaagtacaatatatttgaacgttgctgcacatattcgagagaaccactatagggctattataagtgaaggaaggcaaatgtgatgtccatgataaggtagttaaattatatagtttactgactagagcaataaatacaggaagttttcttacttatgatcattcttattttggggagaaggtttgagaagggacttacatcatgatggtgtataggactaggattgctgaagagaggtttgacagatctgtaacagattcacctgcatgcctagcattgaccgactgaaatagagcggatactatcttttgatagttgctcattccatccaaagctaccgagctccactccaaagagaggaacaatacggtttgcagaatgatcaagctcacaactgttaaagtcaaataaacactttccctggtactcataagatgtttatatccaatggcctttggatattcaagaatgtaacgacaatccttttttccggtaatcttctcaagtgaccacaccattaatctcaagcatggtgcaaataatgtatttcctgctagtatctgaggaagaattagcaatagaagaatggagttcttctgaaagataatcatattctcatttactggagtgaagccacaatttccaactgaggagatggctgtaaatactgagaatacgatgatcccaatgccttttctctttagaattttatgtgcacttggtaccaggttaaggtagaggtaaataagtagggagccgcctaagtttgttattagaagatatcccatcactacaaaacctaaaaatttaatcgtcttgggctctacatgtcctccattttccatgcggagttcagaaaatgaaactgtaacttttgtgccctgggtgctgggaccaaattttgtggaagtaatagactcaatatcaatgcaaggtgagtgatcccttgtgctgactgactcttttgtaccaaattcggctctcataaagtgaatgccaagcattgaagtgaatacctcaccaccaatcagcattaaaatagtcaaaacccagagttgagcgcttgagaaatcctccatttcaacagtagccatgcttgaaacagttgatgcagatacggaagtaaatagcacgtccaagtctttcagagtatttgacttgtctcgtggcttgaggacctttagagatccatatccagcaaaggagatcagggcaaagtaagctacatggacaaagagtggattgttttggtagatgaactggaaggagtattttatagacttctgtgcagatttggtaaaagaagagaacttgctagctgcaaatgtgcggaaagtttggagttttttgtgggatactacaagacaatgattcattttctaactatttgtgtggagctaaacagcatgtattgggtgcttccttatttgcatcaatgtactgatgtttgtccatttatatagggaaaaaaatattctcctctccaacttatacttgtgatgttcgtacatataatctctgctgtagaacaaaagcaatcagcatcaaagagttagtggtgaacttactggacaacaatgacagaagaatcaaagagtgctttggattccatatagcttatgtgaatgtaaatgaagtgctgaaggatttattctctactgcgattgtggcaaataacagtctgttctgaaaagattatacaggttagtgaaaaatgcagaacaaagaattagcaccccgaatgcaatgatatttcagtatgtgcttttcattaggctgccttctgatgaaatatatgcttttttttttgagaattacacagtacaatgctgacactcacaacgcacgcacacttatgctttctttgatctgtgagtttcagcatgttggacatgcactgctttcaagagttcgaattcagttagaaagctaatatgttctcagcaactgatcactagtgatgtacttttgcttgactaccctaaaattgtaccttgaatattgcacctcatgccatttcaggatgtgggcattattgttgttaagcctctactttaatatattgtcttgaatatatggtttcgaagcatgaaatgaaaagatatgagtaaaaatttcaatcaaactacattttaaaatctcttttcaagtaaacaatttcagtggtcaaagcggcatttgttgactttgaattgaaaaaaattgacttgtttttgataggagggaaataggggaattctagaactgaacagtcaatacatgaaatattttttgcataagttttattggcgttagatccaattagagcattaaattttacaaaattgaatcggtgagatgatttggtcataaactcataatgtactgcaagtctgttttagagagatacaatgctatatgcgagaagaggtttacctgttccattttactcagagtaatttattccatcttaatatctgtaactatgcatatacagttgcaagcggttactcttatgaaatatgggtttgaaagcctatttttgctatcctaattgatactccctctgttcttttatgtatgacgttggttagttcaattttgaaataatcaatgtcatatattaaaggacggaagtagtattagaaactactagaatcacgtctttggttactaaataatatgctaatatttgtctccctacaaacagtgttttctttccctttttcttgaaggtaaagtctgacattttgttctggaacacaaaattagcccaataagcttggtgtattgaagaagttaaagacaagatctactgaacatatttgagctattctatgattgctattaatctagttggttagtgtt

SEQ ID NO: 64074 - DNA, 4430 bp, Oryza sativa
atatattgttgcttctttcttaaaaccattgacaccaagcccttccttggtgtccatctttaagctggacccaagtcttgatctgatctggttacaatacattgttagaactgaatcctggacatcatcctggtcttagacttcagagctgaaattcttagggataaactattctcagtagttttgtcctggtaattttgaatctattttagtattatatactacatcacataatctatgaaggattcacctgtatgggttctgccatcacaagtacagtaattgttgaaaatttactcagtatgaaacatggcatatgttcttagacacctcattatttatttttagtaaaccttgtttttgtccatgaattaacattttttaggggttgcttaaatatcagagcctatattttgtcaaatatgtaattgcttaccgcattttagagtaaacacaatgaaataatctttggattttcctatttacctaattccttcttattttcttttagatgtacacgatcttttcaagtactgtactttatgtggctgatgttatgtttccttacgtgttttcatttcatatggcaatcatgtgcagtccacatgttggcacactagaatttctttacttttcttagaacaaaggacaaagcatccaatacgaccaaatcagaccttttgggggcaagaagactgatggaatagatttaagtctttaagcttcatctgttgaatggatacagaacaaattctttcaaatgctttacacagatgctctatattggcatatagtctctatggagactaggttaaatatgaccagtagatttgcatatcatttcgttttccattctgtgatgagtggatataacaacttcccgcaaaactcttatcttcattatttgcagggtagcatttacattttggatatgcactgctgatggactcatcaatcctgatgctacgatattgttgataggcctgttgttcaaaatacagtgaattattccacaaaatatttgtgttgtaaatctgtttcttagctcgacaatgaatattttctgaacaaagttactgttagggggatgtgcatgcaaaaaagtaaaatattcaaaccatcattctgtatcatcaaggtttgttcatggatgagtagctagaaagactcggtgtattagtgaacttgaattgtttgaatgcattgttcctattaagaggctcatcttcctttattagtgttttagttttgtacgccttcaaattttagacaggtagctattgctactgggtgacaactgatgttccttgcaactgaagaacaatggtagacaggaacaggtgtagatgttccttgctgcccccttattgtatcagcatcacagaaatgtgaaagataaaatagcttgtttcctatactatgcccacctgagaggcgagttaatgcgtcctggtagctcatttcctttattttacagtgtgtgactaagaagattaacatatcatgttctcgttttcatgtataggtggtaaccatacaagctgttgttgaagcatttgctagtctgcctgataattctattgccttcagaattgatgatgaccacaagtacgtctttagataatttcctctctgatgtgaattgtgatgctcaagatgcagagaaggcagattgtgccagactctcctcttcggtccattccaggctactgtttgctgctgatcgagtgaatcaaatggtgctcaacgtggtcttgatatggagtgaatggccatagaatctaattccacagatggcaagatcacatccaagcttctcgtattccaccaagaaactattcctgggagcaaattctgtgccaggtcagtatgaaagcagcctacattggcacgtgcctcccggacatttttagtaccgcactgttgctacctttttgtgtacacctgatgacttacaaccagggattaaaaactgttatttctgtcaaaagaagtacaaaaaattctacccctcttcagtttgtataagcattgggcgtagttgaaaaaagaaccccaaagtcttcaagttttggccaacaattagtcaaattttattcctgtttagtctataaaatttatattaataaattcgtatttgagagtgtttttacacgatattggttttgtggccattgaaaatatattgtaagagaaattaatggttaaagtttaatttgaagactacaccaaattaaaaaaaaacgttctataaaattggacggagggagtagcaaaatagggcaatacattagtaagaacaactgcagacttattatcttgtttgtttgataaatggtaagctttcttgcatgctcataccaatactgctgtgtaatggatggtcccaactcccaagtgatgtcactaagattcaggttttatgacctggtgttttcctgatgcatcaacatctgtgatactgccatagtgtacgtgagcaagaatggtcaaagttgcaagttgatcttacctaggcacctagtacactctacgagatatgaaaataatgtgcctgcacatgcatggaccatatggtccacatagatgcaagaatgacaattttctagaggcaaattgtggttgggatagatgaggcaatgtttttttgtgacaatctgtaacttagatggatctcatctgcaactcaaaatttgcctctagaaatcagattctggtgttatttaccagtgcttaattagaactggaagttgaaatactgaaattcggttattcattagaacaaatctgtcgtctagaccataaaacttttacctgagccaattatgcacctgatatgtaatacactctctcttactgaaatttcagaagagaacataacatcaaattcctttactaattacttctgctcgtacataatattgcaagcacgaagtttccagtgtcttgcggtgagcatataatctcaaaactttcttcatctgtttaatctgtttctttagtgtgagaatcctctccatttttttttattcaagccacagttaagaagcattctagtgattactctttatatgtttcatccgcttaattaaatgatctctttgacctctctctatatatttctttgctgctacagaattgaagagcagcctgacggtgctacatcatgcagtcgattattcgatcgactaggcagctgcgacgctgagggagaagggcaatggcgcagagtgcggcgaggccgagtagtcgttggccttgagggcttcagatccacagttgtctgcatggtcgtccattagcatctggtggcacctgcactcggagctgcagaaggctttctcccccctacaggtttgagacatgcacaatgacgtaagtggttgctctactttttctcacttttgacaattccaatgtttaacgagtactagtaatattgcaaagcaatgtgtgacatctaaaaatgtgattggtgaacttgttgttttagtgatgatcccattctacattgaatatgttttgaattgagttaaaagggagaataaaatatgatctgttatttattgaagcaacagggaaaagtcttcactttcactctttaggctagagattatcatgctaatcacaggaaaaagaagaaaacataagcacggttatgatggatccatgttatataacattgtatattgatctggtgtatgtccactagttatttctgattgactagagacttatatactatatactttttacatgtattgcaggttagctgtcttccataaacaaagcaacttcactataattaaaaagctacaaactacatactctattaatcttttaggaagacaaaaccgtaacatcctcttcaaccaaaaagctagaaataaaaaaaaatactaggtaaaacttagaaggtaaaatgtatcatgtatgatatttggcatttccaattgctttctggaaagataatgaacttcttataactatttttgaatttttttcccacctatactaaggtgctgtgtgcttcgcagttaatggcaggttcacgttaccaataaatacaaaaatataattagaattccaaaatgaatgtttaagctcctgaaaattttaagcaatatatagaatagtccataaagtagaccttgggtgccaataagtataatattgtcaaaacaatatagtactattttcatcaaaattttgatattttttatgatgcatgaaattttatttacctgtacatgtagatgtcgagcccatcaagcctcttgtcacacaggaagcaccggctcaagaagtcagccgccggcgccggctcctcgtcggcttccacaagccagccgccgccaccgtcgccgaacccaaagtacacccgcttcctcacgctgccgctggcgccatcgacgccggcgacgtgcgtg

SEQ ID NO: 64075 - DNA, 1860 bp, Oryza sativa
ccgtcagcttggtgatggagccgagcctcgcgggcggtgtgccttccgctcggttgcctgctcaagaaagctcatcgtggaaacctaactgtaggtaaatttcttgtccaagttcagttttgatgaacactagctagtaatcggtaaattgttcttgtgttctagagagagagagaggagagagagagagatgctttagttatgtagttgttcttcactctctcatctctcctctcccctttgcaattcttggagcacttgctttctcaccgattaaaagaacaccaatggtgaggtttatggagagagagaagagactagagagagagagagagaggagggaaggagaaggtggtggcaacattttaaaggagcaaatgggtgagtgggagctgggaatttgggtttgttagggattaaattatttagtggtgttgcacatgtgggagctctttctgtggaggtttttatttcttgatatttagtggagaatattccacaatatcgattatttatcttatgagaatcaaggacttgtccttctttaagtgcatccgaaaattcttaaattttgcatagattagatatgatcggttgatcgttgtctctttatgaggtaagaccgtaagagtataatccagcggtctccaccaaaactttgtaatgtatagttttattttatgattttttttaaaaaaaactaatttatatgatttgtagtagttgagtgttggtgatcaaatgtgattgatgtacaaggaaggagtactgtagctttgtctgttgagcatttggatgtttgttatggtagattgtccgtgtacacctatatataataaacatacaaacttgcttttcggcagtttcgctgaaattttgttttgttgcatgttcatggaatttttagctctgctatctttgcttgcttctcttgggatgatacgatggatattgctcatgcatacggttacctgcataaacttgtttgtttgttattcagatcatcagatgcacacacgtacacacccttaatttgcgaaattttaagcgatgaagcaacaagaaaagagttagtttgcaacatgattattaaagccagtttttctctttctattaaagcatttcgttttttattttacctgaatatttctttcttttgacaaaatggctcgtgaactttctaaaagcactagggcaaattaggaaaacatatcttggtgtgatcgatccaatgtggacggctctctctgtttctgtgtcacgatcgtcatgaaaagaatagaggaaagtttattgcacatttgcatgtcacttgcaagtgttgtcatcaagcagaaagaaaaggtaaatcctaacgctgtatatattacaaccggaacccaacgcttcaaagttgtaatcatcatgtatgtgccaattaaacagtattatacatgctccaattaaacagtttaattaaaggcactgattagaaccttaagattttttttgacagatctatgcaggtcttgaattattctctacaggaaattcatgtgttccaaacaaactctgacaattaaggtagtattcgataaatgcgagtgctcatatatttataaatcaagtatggtaaaattgtttagtgctcatgtcaatttaattctgtcatacttaactagacatattagtgagcctaattaagaaattatattgcttggtgatataaaatgtgccaccctttttttttcgtacttttagcacaactcatctgtcaatatcttcctcttttctcatgggcggcaagcacaataaatccatccaagacacgcatcatgcgttcccaatatacctgaaaaccaatggtgggctgcaggaatt

SEQ ID NO: 64076 - DNA, 4237 bp, Oryza sativa
  unsure (1)..(4237): unsure at all n locations
aaaagagacatctgtgctaggatctgaaggacttaaaaattacttgtaatgttaatcaggagaaaacaagtactattgtattacagcaactgttgattgtgatacatccatattatgggctatggcagtgtagatcgtattaacagtaagtacaagaattgcatagcatagggcaaatcttttgaaataagatatgtagctataactgtgtaagaaattaaaattctatagaatcaggttttacaaattccatattatacatgagaacatgatcaatatgtggtagtcagccaaggctgaaaattaatacagtataacatcaattgagttataaacatttccattttgttggtttgttatgcagtacacgtgcattcaggattcagcagcaaaagagtgaaccaacatgcgccttgtaccacgctccagcaaagctaagacaggaacagaataaagatgatggtatacaacatcacagaaaagttttaacaagtttcgtataaacatacattgcatttccacaggtattgattcttcgtgaccatctgcctttgttatgttaggtctcatgaactcgacaatgtaagggccggagaccaccaactgtccatcacctacaatattcccctgtttttgtggggttcacctagcatacaaactctaggatagcgttctttgagacctgaaatttgaaattgctatatacttttgtacttaatttgctcccatggtgaaatattttttttcaagataaagaaagtttttattgatcttagacgattacataaaggtgatagaatcatattgagaacacttcacctctgtataactaagatgcgcaaaccaacatggtcaataattggttgcaaatataacgtattctgacataattaagcaagctggagaatttctataagtatatatgcacacatgatgcgtttattgagaacacttcacctctgtataactaagatgcgcaaaccaacatggtcaataattggttgtaaatataacgtattctgacataattaagcaagctggagaatttctataaatatatatgcacacatgatgcgtttaaatggaacagaaacattacaagttactgaccggcatgttaaatctataaatgatatgcttcatcaaattggcaacttatcaaatgtgcaaagcaaatgattccagaaagaaacaaatatattttaccatcactttaatgatcaatgccactacttctccccttgctacgatgctaagacgatgcgatcaggccataaagaggagacaaatcaatgtcactcgttgagccaataagcacattcaaattattcttatcaccttatactagtggtaataaagaagtagcaagcaggaataaaaaatatatttcatcataatatactagtggtaataaagcgatagcaagcaggaataaaaagatatttcattataagctagcctagctactcataaactaattgaggcagaaatttatttaaaacttattttcacctctcacctttcactagtgtgctctctacatgggaagagttgtaatttgactacgtataaatcttttttccattaaatactttttacgtccgaaattctagcattatgcagtccttgtctgcaggtgatgcaccctaattaaacctaatacatgagtgatcccgatttgtctgtgaatgatatgtccgtccacaattaagcctgcacatgatatgataaccctgaaagctcaatatatcataatcttaagcgtacgcgtctctcctgatgcaattatacttaactaactccctaatagctggctaggcttgatcacaattctctctttagtgagctatatagctggcaagcctggcatcacagcccaatctgcaggtgtgcctaccctttcaaaatgaaacgacagatgctattaaattcaggcgaataatctgtctcttatatgcatggattgtgcagcacagtagtgcattatcataaaagtgacagctcctgacgattttgcatttgttcgccacaatctttctgatgcgacataaaaatgtactaatttgctctcccaaacaaacagataaaactttcttgagacaacttattccatctgaataccactcctccatccatgaatcatagtgctagggtatatccaattctatactatattgctatattttagaaagtgctaggtatatccaattctatactatattgctatattttagaaccaagggagtacttcttttgttggctaaacctggttgcagctgcactgtaactgcagagacactactgtgtggtgtacactgtacagtgcacccgtggttcagtcactgaagttcagtggagcacccaacaactaacagtggctaaatctgtggatgatacaggtatagtgcaatagtaccatgttaaatctgcttagaaagttccaaaaggatttttttgggaccttttccactgaaatgttatcttactacgcggactaggctattagcctattagcactatctattttgaattcttgcgcccacaaaagttcgttaggaatttattcttctgagagtccaaaatcatatactccttccgtttctaaatatttgacaccgttgactttttagcacatgtttgaccgttcgtcttattcaaaacttttgtgaaatacgtaaaactatgtgtatacatataagtatattaaacaatgaatcaaatgatagaaaataataattacttaaattttttgaataagacgaacggccagacatatttaaaaaaatcaacggcgtcaaatatttagaaacggagggagtatatatatatatatatattgacaataatatttacggaactcaaaactatatgttctgtctggttcctgatttcacatttggctttctcccaaaagccgggtcaatagtaatgttgatctgcctctaaaaaaaaatgttttgtctagctactgccaaaattttgactgtcttttttatatcaggttgaaagtgaggttccgctcaaactgagtactcactacctgagtcttttatatcagcagctgcctgatattctccatcagatatcggagaaacccaagaagcgaggaaaacacaaaacgcaaaatcctgcacccaagtccggtggataatttgaaatccatacctgatgctcagattggatgaagaggcgatcatgcatacattcatccgcgccaccttgtgcagcctacagcaagcagatctttctatggcttcaaggtccggacagccaatgagcagccatggcgagcgtatgctgcctctgaacccagcacagtatctgcagcgcctgggccattcgatcgagctttccgctgctatgccgcggcttaccggcgaggccccccggagaaggacggagatttcccggagacttgggccggccaccggcgtggcaatccctcgaacaccttgggtgcgtgcagccgttgctgttgggaattgggactcagacgacgacacgccagtagggaatacagcggcggcgggctactgactactagtagtgtctccggctagcgcggcggccggcgggcccggcgccgacgacacctcgccggcggccggccggccaacgcccagggcgcatgcgcgagagagaagcaatttctttaatattttccttttttttatttttttttttgcacgcagcttgcattcccgtttatgggcttcctcggcccacataatgtgaggcccatgttcaatgaggtcgtcatgttgtggacctcatctcggcccatctcaaccacttactacccaagctactcgttagagacgaactggattggaaaaggtgtcttcgaagaatattggaaggaaccatgccagatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64077 - DNA, 1085 bp, Oryza sativa
  unsure (1)..(1085): unsure at all n locations
tcctgcacccaagtccggtggataatttgaaatccatacctgatgctcagattggatgaagaggcgatcatgcatacattccaantttgccgcgggggcggggccccaaatcctccttgttggatggccaagggcccccttaagcgagggccaaatgccaagaatcctttcttatggcttcaaggtccggacagccaatgagcagccatggcgagcgtatgctgcctctgaacccagcacagtatctgcagcgcctgggccattcgatcgagctttccgctgctatgccgcggcttaccggcgaggccccccggagaaggacggagatttcccggagacttgggccggccaccggcgtggcaatccctcgaacaccttgggtgcgtgcagccgttgctgttgggaattgggactcagacgacgacacgccagtagggaatacagcggcggcgggctactgactactagtagtgtctccggctagcgcggcggccggcgggcccggcgccgacgacacctcgccggcggccggccggccaacgcgcagggcgcatgcgcgagagagaagcaatttctttaatattttccttttttttatttttttttttgcacgcagcttgcattcccgtttatgggcttcctcggcccacataatgtgaggcccatgttcaatgaggtcgtcatgttgtggacctcatctcggcccatctcaaccacttactacccaagctactcgttagagacgaactggattggaaaaggtgtcttcgaagaatattggaaggaaccatgccagatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 64078 - DNA, 894 bp, Oryza sativa
tcctgcagcccgcatttaatagtaactagttcatggtagagtgaaatattgccgcaatgcctcgtttgttcacaatatttatccgcggtacaatgtgtacataaaatttgggcaattaatacatgatgtactttacccgcacaaagtattcaattagatatatagagagataacacttcgataaaccaaaaactccgaggatttgccaatccgttctaccattaattaatcctttcatatgcgtatgacgtgggttttggtcgcgtgttattataaacaacaaatgctagatttcatcttcaactactactacgtacaagggagagtggaatgtcaaatcataaaaatccctgcaataaccacattctcctatgttgttttgtgcacaaacacaatggatcaatattgccatgtgaaagaatatctgggcagtcaataaaaaaaatgtatacactactatagcacatcagatgatctgaccaagaggagaagaagaagagagaggatcccaaccccaccacctctcctcctcctcctctctctctctccgatctgcctcgccgccgccgcggctgctcttctcctctcgcctcgcctcgtgcgcgcggcgagttcgacctcctcctcctcctctccgagcccccgcctcccctggctgcgggcggggggtttcgagggggtggacgcggcctccgtgtcggcttcggctcggatcgaattcaaaggtatcgctcgagctctcgctgctcttacggcggcgcttgatgagcaccgcggcgtagattgtgagatccatcgggagttgggattgatttccttccttttccaatcagtttaccccggatttattttattaatttgatgatacgtgatggtttagtattattgatagca

SEQ ID NO: 64079 - DNA, 823 bp, Oryza sativa
tttgaaaggaactttttaattaaagattcatgtaagcgagagtaataataagaccatttctcattctaccacaactagcctaactaaatcatccatcactttatccatcaaccattgtcgtcaataatgacgattactaatccaaagagaacagttcacataacaatcctaaaacatcccttcagaccgaaaatagcagctcgattgcagcatttaaccacttcatttgcttccacaagcaaaagcacacgaaaattcaaccgccgcatcaagtccagaagaagaagtaccgcaagatatcccctgccaatccgcacaatcaaattgaatcgatcgacccaacctaaaccccccacacgtttctcaccacccgcccaatctctagtgcacagtacagcactgcatcgaaatcaatccccaccttgacctcgcttccaccgacaaatcccatgttcaccccgaacagtacttagctcgaatcatcgcctccgcaaacagtgcaacgaccaacggccaccaaccaaaagctagtgcaacacgtacgagcaaagcatccaagcacgaagcgcgagcgcggagcacttaccatcggcggcgacggtggccgcgagcgcccgccggggcaatgccgccgcggcgatcagcagcagcagcggcagcacgagcaccgccgcgggagcccctctccggaagcagcacctccctcccgctgccatccgcatcgacgcaaactctctctctctctctcccctccagcaattaatcagcggggcctccgccgaagcagcatcagccagatcaacccgaagcgatcgcggaagaa

SEQ ID NO: 64080 - DNA, 706 bp, Oryza sativa
gtctgaagaaacctgaagcgaatctggttaaaggcaaacatgtggtttgtgcgaaggtgaagaaagtgcataggacagtcaatccccaagatgatgttctgcacggatggaagccgccagatcagggactgatgaagttgaacattgatggttcttttcaacctgatacagggaaaggcggcctgggtgtggtgctccgaaatagactaggagaagtcatctttgcagcttgtggttacatccaacggtgcacaggtgctctagaagcggaactgatggcgtgtcgggagggattacttatggctctccaatggacactgctaccgatcatcatagaaactgattggcaggagatgctgaatgtgctccagtccaaggagttggtccgatcggagttgatgtttttagtcaaggaggtgcacgacctcatgatgggaaacagggttgttagtcttgctaaggtgcataggaatcaaaaccgtattagtcatgttttagctaataaaggccgagtggaggaacttactcacttctggccagacaatagctgtaatgctatcgcacaactagtttgtgtcgatgctttgattgaataaagtgatccctgtttcctcgcaaaaaaaaaactaaaatgtcaaattctaccaatcaatatacgttttaattaccattgatgaaaaaatattcatgccttcccctatatagt

SEQ ID NO: 64081 - DNA, 706 bp, Oryza sativa
gtggtctagccccaagaatgataaggccttagaaagcacacaatttccagacgggatatcatttatgccattggtttccatagtcctcaaggtttgttctatttcatcaaactgcctatatctgcaatatcctgccaaaagtatcttgtatgttaacagttctggaataatttttctttcagccatgtcttcaaagacatactttgcatgcctgtataatccctccttaaaaataccacctataatagcattataagcacaaactttagggttaatatgtctagaaaagcactcagataaatatagaaatgcagccttcagcttcaattctctacagctgtaacgtatgaagattccaaaagtagttgcatctggcacaaaccctaagacttccaatctttggaaaaccaaccatgcctcatcagtaccaatatttgcacataaagaggcaataattctattgctgagaagcaagtcaggtagatacctccactcttctaagaaattcatcatatctccaatatccttcttcttgcaaaattcttgtgtgacagctgataaggatcccttactcatttgaatgttcaaatcctttaactgccgaattataccaatagcttgcaaaaatttgtctttcttgattaaagccttgacaacaatatcaagaatatctccttccgtgtaagaacctaatccagctccaagc

SEQ ID NO: 64082 - DNA, 13261 bp, Oryza sativa
acaaaatgactagcgagatttgtaagcaaaatgagcagcaaacgagaaaggtgacgttaaaatatatcttgatttaaataaaatcggcagcagttcaaacaaactaaatacaaagtgcccagaactgcaagtcaacagtaaaacaatctcatgagctcatcgattagagctaggcatcaattattcaaggttccaacttgttagaattcttcttcaactacaaactgcagtcttgaccggtaacatagagaacaatttggtacaatgactgttaaattggcatcatatgattcccatactgaatctgaattagatataaaaaaatccactgtgtgcagctaacaacaatccatgcttaactttctgcatattgatatctctaatacaatctgacagttatgcagaaaattaactcagcagcataagcagctatgccagccaacatagcgtcagattagctaaaaaacacagttgtcctctcttctgtctaatggaaggttattttaatcagcagataaaattcagagatgggcatactatcataagagcaggtacaatagcagactactagccagctataaacatattttaatgagataaacgataagagagaagagcagcgggctacagatctgtagccagctgcagcacggactccaagacgcaatgtatgtatgacatgtgggaccatatattaataatatagtaagcaactattgtatgaattgactattagattggctatagataaattggagctagcagtgggctatactattgaacttgctctaaactttgagtaaatcgtcaaccaatcctggattcttcattacttaaatttggtcaaaagcaactggtagtagtaaaatacaacactacagcagtaattttgagtagaagcatttgatcacctttcaatactatgctatttgctgtagcgtgcaatacttttgccaaaccactgaatccttcatttcatcatcctattataagaagcagtaaaccttgcgatatactgtacctagtgacaacatgcagaagcaattaacatgccacaacttgaattcaacatgattaattatttcttaatagaatctagatcacattatgaactacacccttctatgtttagaagaatcctatctaaagatatgactacttaatagagttcagaggaagaaaattctgtataacgcaactggctctacacgttcagtatatctgtataacgtcaattaccaaggtactacgtacaacagacttacaaatgttggatgaaaaattgaaagttcatctattgaaactgctatacaaaccattttttgttgacactgatgcataacatttttttctattgcttaagagtaaaattaggtacttcagggaagttctaaactggttggaaatcacagtatcctggataaaaatggacacgattatgcagtctgacgtttgtaccaatcaatcaatctaagataattgaaaattttgaggaagagaaaaactaagttgcttaatcgagagagcagtagcaggggatgcccatctaaattatcggattaatcatcccacgcaggcaactcacggggtattccgccggcgagaccccgactcacggggctttccgctccttcatccgccacatcgacgcctcagccgccacgagcccgcgactaatgcggtggagattgggaggagatgcggcgctttggagatgggggaggggaggaggatgcgcgacggcggcgggaggggggagtggaggaagccgcggcggcggggaagatgagggcggcgccggagggagggacggtgggagcacgcggcgtcgcggcctgcggcccagtaaaacttctcaggtgatcagtgtggcccagacaatagcccagcccaatcagaaacgggaaactattttgatctcccgagggatgtctcctctatttgcacgtgactcaaatggttatgaaaaaaattaaaaagatgtattaatatgtgatatatcactccacaaagatgtaagtttatatttaatttctacattttgcaacaaaaaataaattaaactacagctagttagcgtatattcacactcaaatttgtttttttttgcgagatgtagatgatgaatttgaacttacatatttgtgagtgataaatcacatgttaatatattttcttaaaattttacagagatatttaagagacatgtaaataacaaagtaacgtccctcaagggattaagatctgctcccatcggaaaccttccttttcgccattttatcaatcacccagccggcgcgcccagcacgcggctgcgccaccacgatgctccctctgcgtcgtcgtcgccgccgccgccgccgccaaggcgaacggcgggtggtgccgtggtggggtgtgtatagccataggagatgatcaacagcagtatgatattttttttcggcatatttggtaaaagaatcgagctctgaacaacagaaaatcttcagaaacggataatggagtaactcaaacagattgctgaaaatacaaatttccaaccactgcagttgacaccatttttagcttaatgcaattccttaattccttccaaaaaaaagcacaaaaaaaaacatctgtaacaatggccaaggtcacatggcagattttgaccttttgcaagtaaattcagagttgtgccgtgcagttatatgatttgtaaactgtagtgccattttcttttcctttggtcattgtagcgaaatttcctcacttgtttgctttcttcttatctaaacggacgctggtaatgctgctcttctaatctctactgggttacgttacgtgtgatctcgccgttgtgaagtctaggcctatcgctttcatctattgtctccgatattgtttggtactgctattcctgtagcaataaccgtggtactgcaagtcctgtggcaatagtggagtgcacaaattttctttgggatcttccattgaaatatggcagttcacctactattactgtcaagacttaggccatcacatggggatgtctgaagtctgatatgatcgcttgaactaagctcgttttttttaaggttatggaaatttttattgaatccaatcaattacttaaggtgatataattatactgagaatactcttgacaactacataactagaatgtacccaagtaagcttgtagtagaggtttatttgaaaaagaaaaacataaatacccggagtgtagctttaaacttaggctggctagccccaccatcttgtcttacggagctagtcggaagattcctttatgtttctagaggtttatttgatgatctgcatagaatgggcacaaagactgcatctatggtttaggagatctgaagtaagaaatcaatacatgattttagcatgtgttatgcccgggcatactattacatagtacgtgtaatagtgtttttggatggttgtcgtgttcgagcttacgtgcacgccgaagactcgttaaaatatctgaaagagcctatcttttggaaacaatttatcgactcaatttagccttcgtttgtcctagattacaattgcacacacctcattttcctcaagaaagagtttgattatgctgagaaaatatatttcttttctgattctctacaagggggcgagaaagaaaaaaaaatttttcttagtcaatgttatttaggtttgatcaatattacataaaaaactagcaacatctataacaccaaattagttttattatatttaacattgaataaacttgatacaatgtttgtttcatattggaaatgttactaatatttctctaaaaacttaataacaacttagagaaggttgactaagaaaaaaaattcaaaagacttataatatgaaacaaaggccgtaaccttacacgttcacatatgatcttcagccaagaaaaaaagggaaataaaaattttaaaagagcaaatttttagacctgtttcagttttatgcaggcatcttgaaatttcattcgcctcggttcgttatttttccctttggtcgttttcagagttacaagcctgaaatactgaagccggcaaacctcgtcagagaagagaaggccgcagttgaaatgaaacactgaagttgaaagtcgaagccccacatgccgtaaaaaccaagacaaaattcagaaactcctaacaaaccccggaagaaataaacgccctgtagggcctacagactccgtttgcgtttacttgcaagaatactcaactctgcaaattctgcacacctcgttggagtttacttattggcccagcaaccaacaagtgtagctcacaacttccatctctgaagaaaaagaagagaaaggataccattacagggaagaagatggcattgctaagtgtcagctcatctcatcatgccatccatccaggtgcctaactctcctccgtttcaaggaaacaatattctaacagcatgctacttacacttgaatacacgagagcaatgtaacagtgcaagtagtgtgttgcaggtagtagcaggagcatgcagtgcatctgcaccagggtgacaccatccagatcagtgggagaaatatcaagatcaagatcaagaaatgatcttcctctgggtgtttcaccgtcgtcgaggatgctcacgacatgtactctcaagactccttcctatggcaacaagtcgaagtcgaaggagaagatcaatccgagagacatgttcaccttctcctacagattcaacactgacatccccatgaccgagactccaggggtaggtttcttgcctgatgcatgtagcatgtaagatttgggagatgatcagttaacactctttgagatgatctgactcttccctgggaatttcctgatgcaggcatccatcgatgagtaccttcagaacaggcccaggattgttggagccgtgttccctgataagcgcaagagaaccaagctcagtgatgtgagttcagttgcacatcaccatttcttccccaatttccttttctcaacttcactttgtgcaaactgcaaagcatgcaaaatgttgaagctttgctctcttttttttgtctcgtcgtcagcaacaatttctctccggcgatcatggcttcatttctgcaaggatgatcagctttttctatttctgcgaggctaaaagagagttctttttttttctgcaggaagaatggagcgtgcagcttctgccgatccagttcctgttcctgtcggcgtcgccggtgatcgtgatgcggttcgtaagcaaatccggcggcaaggagtacccgccgcacgtccccgtcaaggcaaccagcctcctgctcatggaagtggtaacaattcgccgcccattttatttttctcttcctgcattttctgtcagagaaagttcagaactctgaaagctctgaaacgctgctatggcgggggagcagacggactacaagctggacgggctggacagcaacgcgatgccgtcgcacctcgccctgaccgtccgcgggtcgctgtacccgcggccggaggggaggaagagcctgaggggccacgtcgagatgagcgtcggcttcaacctgccgccggtgctcgcgctggtgccggagggcgtcatcagaggcgtcggcgagacggtgagcatttttcagcaccttcgctgcttttgtgcaagcagaaagagatggtatcatggaaactggaaagatcctctacacgactctgtcctctgattttgagtgactggtatatgggtcccacatttccaaaaggcccgcatgtaagtgacccatgtcaaaagactcatcctagctgatgggtagctgaattttttttattggagaactgtttttatccctagctgatgggtatctgaattttttattggaaagctattttgatccctcgagtggatgtttctttggttgttcaaaaactatccaaagagtaatgaaaagctttaaataatttaacaacagtcaacatatatatactgctttgcaaaatcttaacattctgtctttgattgtttatgatgatcatggtgcaggtgctgaggcagctagcactgcagatgaagcaggatttcgacaatggcctggcagccgatttcaagaggtacaggagggagaagctaactgaaaagaagactacaccctgaaagttttttcaagcatttcatttcaaaaatagaagatcttttccaagcattcactgccagtagtaatagagatggcagtcactacaccaaattgtttggagctcatctgatcatcagcaattcagcatgatggcaacataattgtattgttcatcaagcctcaagaaaagatggagagaataacttaacagatctcatttattcattgtaaactgaagcatttagaatgtacataatggcaagaataatcaatttactgagattgttaatatctcgagctattggacatgttttctgtcagatttgacttcctttcctcttaggctattgtggatgtatgtaccacgtgctattgtggatctacataccacgtagtatacagggcctagggcctttgcttcaacagctagacgaatatacaattagaagttctatactatgtatcagaaagactctagtcttccaatgatctctttcttgcccttaagtcgcgctcaaggctttgaggcaatggaggggtcctaccacgacggaaaaggacggcaagagctttcattttatggcagatgttgaaaacctgcagacaagaacgagtgtaacccggtacataagtactactactatgatcaattgccaaccacaaattggtactatgaaggcccatgtccaccaaatttcttaccgatgatgcctctatctctgcaatcccctcacaaccttggccgccaccctgtagaatgtcacagtattttgcagcatcgtcctcgtcttcaaatacctgagacaaaggatgatatgattcaagagaatgtcaagcaagtagctatgtaaacaactgaaaacccagaggaaaagcaggacacctagtcggttctcaaagaaatcatccacaaaatttaacccctctctttaactactcaccagtattccctctctgatatcttcaacaagcatgttaaacttggaaccagagtattttgatttagtcccaactcctgaaccccctccctttaagagcattccaagttccctttcaacttcactgaagaaaatagagataacatgacttgttcagaatgttcagtaacagcaaaattacacgtgtaagcgcaacagcagcaaaataactctaacctgcgactcctacgggttttcattgtccatagatggttatctcttctagccagtacatagactggtttggagtcttctctccatgggtttgtctccaacactgaaccagaagaaaaacaccagttagtaaaatttcagactgccatgcttgtaaaacagtttagcaaagcatacaaagaaaacagcatttctaaaagcataaatcttttgaacaccatttctaaccgatctttgattgaaaaatcaaagtgttaaaatataaagcttaactagggagtggggatcagtgtttctgatactactgaatgcaggatggtatgttttactacagcatacatgtcaattcagcactttgttacaatgacatgtcaacattcaaatctcgatacattgagcagagccaaaaactgtggaaacagctagagattgttactgttaattgtcacgtacacgcatgctcttaagtcttaactaggcaaacctcgaatcacacgtatatcacgaaatacggtatgtacgcgtgcacgtacaagcctcacgtcgttggtgctgatgccaaatcaaacagataaagatgaaatcttcggacacttcaagagtatggagaacgcagtttatcgagcgatctcggtaaaccccctagtaaaaactaaaacccctaaatcgatcgaagattttttttcttttactccttaataatcgatcaagaacggatacgatccacgaaaagagggtgaggatccgacaactcttaccatcgtaggcgagggagtcgagcgattccatgaggtggcgccgcatgccgtacgcgcgggaggagacgcggcgcaggaactcgccggaggtgccagggatgccgccgtccatccccatcgccctctccacctcctcctcctcctcaccaccaccatcacccccctcccgcgatggcgggggcgggggccgggacgaggccgcggcgaccaccgccctgcggtgcgagacggcgaggcggggcagcggcgggggcagggagaggagggacgaggtcaggttccccgccagcgcggtcgtcgccgccggcaccggcgcctgatgcggcggcggtgagagggatggcaagcaagctgccatttctacgttcttccctggaagcgtggagcagtggagatgagaaaatcgagagagagagagagaggaaaaaaaaagttgggagtaaaatcgggagaagagaagagtggaacgtggacacggcaactcgtggcagatctttctaccgcggtgggtaataggagtagctgagttcggcacgcttcgcagtcaggttcggtcggtcggcctcgcgccgtgtcacgttttggaccagctttttttgttggaggagaaatgggctagttagaatttggcccaacttatcagggggcacggcccatcataaaatgtacaacttcggccccacaatggaatctgggctgatacggactgaacgaaccgggccgtcctacttccccctagcccagcggaataagttcacttgaactacttccatatcaataccgaaaatcttaaccccaattatttcgatagttaggaactaggaagtcaagatatcaactactctctttttcatattataagtcattttgaatatttttcctaatcaaacttatgttaaatttactcaaatttatagaaaatttagcaatatttttgacacaaaacaaacatattataaaaaagattaaatattaaatgttagtttgaacgaaactaattttgtgttgtagatattactaaattttttcataaacttaatcatacttgaagaagttgaacttaagaaaattcaaagcgatttataatataaaacaaataaaatattaaaataattaagattaagatatctaatattacgatttacgatcgagtgatacgaatcacttttctagcctggtgccgtgatgtgctgacgatgctccatgacgacaaacatgcttcaacatgctccatttctttactactaccataccatctccctgcgtgcgttggcaaccaaaggagataccaaaccaaaaccatcacaccatcggacaccggccgacccaaaatcggaccacacgtgctgcctcctccgcgacacgcaacgtcaaaggggtcgagccgaaacgcctagaaccctcttcatcatccaaattccaagttgcccaacccaaaaaagcttctactcgcgctgcgtacgtgccagcccgcggcggacgacgtgccacccgagacggacacccgtcgcgcggccacccgcctcgccatcgccaacctctccacgcgtcctcacccatctcccccataaaaccccataaaccccagcgtgatcaccgcactgttgggttcgcgacttctcgtattctctagcacgcgaaagcgattatctgttcttgtttggaggagttcacgtacgtcacgagcaatggcgatcgtgtcgcggtcgaggaggctggcggtgacgctgctgctgctgctgtttgctgtggtggcggcggccgccgtggcgacgaaggcggaggctggcacggaggacgcggcgagcaaggaggacgagtcgtggacgggctgggccaaggagaagatcaccgaggggctcgggctgaagcaccacgtcgccgacgtcgacgaggaggaggacgccgcgcgcaaggccggccacgccgccaagtccgcccagcacaccgcctccggtacgtcgaaactcgccgcgcgccgccgcgcgcgctcgccggcggcatcttgccatgcctgatgccatcgtgtgttggagctaattaacatgtgggtgtgtgtgtgtgtgtgtgtgtgtgtgcgcgcgactgtgcagaggcagggaggcagacgagcaagaaggccggggacgcgaaggaggcggcggaggcgacggcgtcgggcgcgtcgagcaaggctgagcaggcaaaggagaagacgaaggaggcggcgaagggcgccgccggcgaggcgaccaggagagcggagcaggccaagcacaagaccaaggaggccgccgaggcggccggcgagaggggcgccgaggtgcacgagcagtcgaagcagggcaaggccaaggtcgaagagacggccaaggagaaggccggcgaggggtacgacgccgccaaggacaaggccggcaaggcgcaggagactctccggcaatccaccgacgccgccaaggacaaggccggcaaggcgcaggagactctccggcaatccaccgacgccgccagggacaaggccggcaaggcgcaggagacgctccggcaatccaccgacgccgccgcggagaaggccggggcggcgaaggacagcgcgtgggagaggaccagctcggcgaaggacgccgcggcggagaaggccgggtcggcgaaggacgcggcgtgggagaagacaagctcggcgaaggacgccgcggcggagaaggccggggcggcgaaggacgcggcgcgggagaaggcggaggcggccggcgagaaggcgaggcagtccaaggaggcggcgaaggggaaggccggcgcggcgaaggacgcggcgtgggagaaggcggaggcggcgaaggacgccgcgtgggagacggcggaggcggcgagggagaaggcgaacgaggggtacgagaaggtgaaggagaaggcgaaggagaaggtggaggaggtgaaggagcgcgtcaccggcgccgacgacgccgccgatcacggcaaggagaagaagcatcaccaccgccacgtcgacggcaagcaaaagccccgcacggtcgacgagctctgagctagccgccggcgtacggacaccgattagcccatgtcaacatagcacttttcagtgatgtttttcagtgtgtttgctgtagctctccacacgatgccgttttctgtatgctgttgcattttgtacaataatgtgatctttctgtagagaacttgtttgtattctgtagagaacttgtttgaaacaagttactgtgtttttcccactgaaacttcactcaaaactgaatcttttgctgttttccacggaaacctcactcgaaactgaatctttgatacaacactggtacagattgctacaagcattggaccttttcaaatctaattgaaaagaagcagtaacagagctgattagatcatttctaactgcctacaagcatcgaaggtttaagattcgggccagaattctgaatcttactagacactatcacgctgcagcttacctcttcagactgcagcttacctcttcagaccgaactgaagagggttctgcaatgcaatttcatcttatgtatgttcttcttcttcttcccgtgatacatacagtgatacatacagtcgatttttctggtgtcctgtagtttaagagaagcacactcggaggcgtgcttcagacgaggagtggagcttccagtgcagcggcggcagctctcgggttggtgtcctggagcttcagggttgaggtgaccagcagcgcgaagactgcaaagcacgaggggatcagacctgtcccaaacctgctcaccgtgtacagccccctcgtctcgccgcagctaatcgaatctgcaataagagagaaacataatttcaatgagtgatcatcaattgtatccacaaaccaaagcatcctgaatttaggtggttaatgcgctgaaatatgccatttttacagcggataccttcgtatgattctagaacaaacaaggcgattccacacgacatcttgtccaggaagctgagcgagccgtagacgaaggcgcagccgttcaagtcgtctcctaccagcgcgctctctagcccaattgtggtcacctgatcaggaaatcagcacacatgagcataagcagaactcgaagatcattcgtcccatcacgcaaaaatgacaattgcagttcttgttctctaaatgagaagtgcagttcttgttgttctttaccatgacgagggcgtttgcagctccgatgaccatagcgagagggtacataaggttgtgcatctgactcgggaggacgaagacggcggctccagcgatcacccagagtattgctccgatggtgaggagcgacttcaggcggcggctgttccactttatctcctgcattttacttgcaaaatacgtgagaaaaaacttaacttgttatattctagttctagtataagtgggttaactgacaggagtagacctggagaacaacagagacgaggaagctgcagcaaaatatgatggctggtatctgcatatatgcaggtcaaaaattagagaattagatgattggtatcttctaaggacagaggttaaccaaaaaggtttgaaaactcacaatcgctttggagtactcattcatcttcaagtctctagtgacgtagaacgcgatgagagactgaaaaaaaaattcttttagactaatgttcagacttgagagaaaacttagggagcgaaatgcgtatttggcaatcagtgtcacagtggaacagatatggtagagtatgcaatgtgcattttcatgttgctagtagtaattaagaatattttctattctgagtggggacgatgtcaacctgagagacatttgtgatcaatcttgcaagcatatacaacagagcgacttggtagtacaaggccttcttgaaccagtagccccaggaaatcctagccgatttcttgcagtcagatcccgactgcaaactgcaaaaccaaattcactccctttcagaaaacacccttcacggcccaaaaaaaagtctaatgcattattctacgctgaaaaaagaaaaacatacgtcggctcctttgttccagcatagaacaccactaggaagcagcatcccacaaaaattgaaacgtacgctatccaacggtactgcagataaatatacgaacaacttagtaacaagtatactattgtacatggaggtaagtctctggtctgtaaaatcatactacctccattttttaatagatgacgccgttgact

SEQ ID NO: 64083 - DNA, 1316 bp, Oryza sativa
ttacgtaaattttttgaataagacgaatggtcaaacatgtgagaaaaagtcaacggcgtcatctattaaaaaatggagggagtatcttttactgaccaagaaacccaaatctaacaactgacgaggttaggcagtcacctgaagaacaatgtctgagcatgccttcgcgctcactaaagcaaatacaaccaaagctatcgcatataaaccaagatttgccacctgcattttccatttgtagtgactggtgagcatcttcctcatgagaacaatgattgcagtggtacaagacacaggagactaaacaagtaggaattatttttgaagcacatatcaggccaccttcaatcagataaaagatggcagtaaaagaatactaccatctttggtatagaaacaatgcactttgtcatgtgcaaaaggttattataataacaagagttcagtggaagaaatttcccggagataccttaagtaaaaaaagagtattctagtaataatatgtttccatgctaaaactgtagtacttaccatagtgaacgcatttctgcagcttgctaaggctacccggcttgtggaattcagtgtcatgcagttcaccattgacctgagaggaagaaaaccatgtcactatgccaagccagagcccaaacatattgcaaattagatagaagcttctgtcaaagttcaagtgatcaaatttacatgtgtgaaacttgtgtggccgcccagccgatgttgaagacggcagcgaagaagctgtaaccaatggttctcacaaggtaggaatcggtccccaggacggtgcagagaagacatccaccgaagacagaggagaaggagatgccgactaggattgatcctccgatgtgccacagcttgaagtgcccaaatcggtcgatctgatcagataccacatacattgctcacagatcagttactgtattttgctaatcagcgcgcattcagcaatagcaaacggtttctcaatttatttagtaccatctcgcctgcaagaatcgtcattaggccatctgcaacctggccagaaagcatcacaatagctgcatccctgcaagaaattgaacacaagccatgattaataaactgagctgctgcagcaacattactttgcttcagacaaatcgaaattccacacagaccactagtgtgattgtgagctgttgtctacgtgggtttaattaattaattagcaatgattaccttggagcaagcccgatttcttgcaagaagaggagcaggtaagtgaaccagcaggcagacgtgatgtcttcagcatgtggccgacaccgtag

SEQ ID NO: 64084 - DNA, 6482 bp, Oryza sativa
aatcttcagctacgatctctgaatatgcagaggtgattgcacacattagcaacagacagggaataattccacgcctcatgagatgcatgacaaaaaggaaaaagcgacttttatttgatggcgatcatgcgtaagcttgcgttcacgccagccggcgccgccgcgcgcgcgcgggatcaccgcacgcgagcgacgcgtgccgccccgcgccgcgcgtgcagccgcgtcccctccgctcaactcgccgccgtcctgcgcccgcgctagccgcgctagggctacacgttgccgcgccgcggccgccgtcgtaaaatccccccaagaaaaacggcaatgcatatgaacccgcggcacggcgacgccggcggcaacagcagcaaaaggaatgcgagaatcgggagggaatttcagaatctcattcgcgaatttcgcacgcgtaccgagatgagagcgcgcgcgcttgctgttcgtcgaggaggggaggagagagcgcgggacgaggcgaggcggatccggcggcgaggtatatataggggacgagaccgcgagcgagacggtggtgatggtggtggtggaggtaggctagggcatgatagaggcggcgctacaggacaaggaaagacgaagaaggaaaacgccaagtccgcaaaattgaaaagtggaattgggtgatttttgcgtccttttcgttagtttcctattcttttacggcaaacaaatcgcgctttcagacttcagaccgcatactaaagatgatttaataattaatgcaccaaaatatatttttaactacttttttattttccgaattatcatacaacaaagtttccttttataaatactagcaaaaatgcccgtgcgttgcaacgggtaaaaaaaataatccaatgacaatagacatttttcaagcgtacccatatcaatgataatgtttctatggatcgttgtagctaacacaattagaaaattagagcatctttatgtaatgacccaaactcgatgatggcaatctttttaccaatgcttgctttaactaaaataattggattattcatataacaatatacatataataaaaaaatattctttcaatattattcttgcaaccaataataggttaatcaaatcctacactcaggatcaagtctacacaaaatagtcccgtgcactcttctctaaataacaattaaaaatatgtttatttttaatactattttcatataatatgttattaaaaaaagtctgataatgataattgcatacaaaaagtgcagggattagatgaggaaacaaatgatgtgtaggagatggaaaaatatcgatggatcttatccgacccaagcgtccatcaattttatctcgctttgagtcggacggtttctcggagcggttctttttataaacggcggttttttttctcgcattgagttggatggtttcctctattttttttttcgaaatgatggtttttttctcgcattaagtcggacggttttctcgaaccttattttgaaacatcggtttttttcgcgtgttgagtccgtttgttttttttggatctgttattttataaacagtgtttcatcggttagttttttcagagcggcttttttttataaacagtttttttttcttgtgtggttttttgaaaccatttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctttctaaaaagttagattagattgatagattagattagagttaaagagatatatacggataacaaggggcgactttaagtttggtcgggtcgttttttcctccttttctttttacggagtttgagttagatgtttttttttctttttttttattacggacgagaaaacctctttttcacgagtcggacttttttttttctctacgggagtcggtccttttttttctttttttacgacagaaggttttttagagatagatatttatttttaattaggtatttattcacgcgtgtttcccttcggatagaaactttttttttcgcactattctttccttttgtaggaagatggaaactcttttgtcgctcggaattttttttatttggaatcggacagaaactatttttgtgggtaatttttttataattaaaaacggaaatttctttaccggttttttttggatcggacaaactggtttttttcgcccggttttttttcacccggtttttttgacggacgatggaagcacctcttatttttttttttaagtagtagtagatttaaggtttgtttagttgaaaacttgtcaaagaccagtgccaaaaaacaaacccatgacatatggcaatatgggacaatgagttagccaagcgtgatttatcatagttatagcaacttactaaacatctactcctacctaatggcatgtttaacatgtggcatgataaactgtaacaatgaaccgtacatgcccgaaaagttgttgttaagcttaacatcaacatttctctctcatttcccctatctatgctatttcaacatttcccctccctcttctatttcaacatttcccctctctcttatatttcagcaaatttacctgattaacgacactaaaagttaactattaattgacgttgtacatgtgaagtggcccataacctagtacctgcagtgatcttagtagcacctcgtgtcgtgagttcaaatccttggggagcgaatttccccctagtcggcatgtgtttcccacactggccaagttttttttaaaaaaaattgatgttgtatatgacttgtggctatggttagattttcaactggagtgaagttgtaacaaggttgccgtactaagaagatgcgattggatcaccattcttgaacccacaaacacaagatgtgtatcatgttctaaaatatggatatccccttatattatgatatttttctcgacaataaatactagcatgttgggtaagcacaatcctcgcatggagaaatgctattcctttgctgggttctctaaccataataaaggacgccatgaacgtggccttaagattgtggatgaattagttcgaataatttatcaaaaaatgcatacatttaatttgttgtcaaactttggtaaatacataagaaatcctatcaaaattttaacaatattgttaacttgccaaaaataatatggccacttgtgtcaccaccttgtcatgagctctccctgcacatcatctaatcaaaagttgcatgctattgctcatttcatatcagcttttcgcctctggttctttgtttcaggcaacagagaagctgaagctgtgtctcgctgtttctgagtcaaaagaaataatgtgaattcaagagcaaatcattttgtcaaaaggtcaaatttgtctctcaaaagtcatggagggcttggtcatccgagaaagcaggaaataagcagcctgccttgaattccaaacgtactaaatatagattaattatcataaggccccttgtcataatcttctcggaaaatcgtgatttgtcaggtcttggtaaagctaatcagaccggcgaaagggagtgctatgcattatttccttcttcgccagtagagtagctttcgtgtgatgtaatattatctgaacttaataatactactacttataagtcaaatcgttggtaaaaacaacggtaatgacgtattgtatactctgatcaatcttaaatagagaccactgtccttagggtagtatttttagtaataatttttttcagttaagctaattttataattcatggttatttatcccgtaaactttgtaataattgggtaaagcttctctgaagtaaagtccaaaataaattgtattattaaaaagagttagttactagctaaactaggtagctaatgtcatttcattactgcgaaaacagtctacctaaatacctaatgcagaatcaattatcaggcatgtgattttgcagcaatcacgcagaggattttatcaggaatcacaaatatcgccagccgaaatcaatgttcatccagcagagaaaaaaaaatatgccaagttgtcaaacacatggaacaagttgggtagcgacaagcatccaagttttcttccttctcagatggatccaattaagggcctctctaaccagatagggtcagtgttctaacctgctgacactcattagccgcccatagtatgttcttgagagtttgacaatgaagggcatcatactgggttagcagccactgacttgtgcagttctttccctggctttgacttgcatgcgagcagagaggatcagcgtgacaatgaaaatgaaaatatcatcattgacgtcatctcctgaaaatgatcttcaaacggccaatcgatttctccataatttgccatgtgctggatgtgatgatattatctgtactatctttcctgggctgatgtttatcagcaattctctgtagctttcatgcatttgttagccactagtgcatttgatagtacctataacggcttctgcatcagtgcatcacaatgctcaaataaagaaaaatgatgagattcgcccacagcaacagagttcaaaggacatacttcctcatttatttttaatatttagcgcagttgacttttaaatatatatttaataatttatcttattaaattttgtgcaaatatatatatatatatatatatatatatataataagtcatgtttaaaataactttaacaacaaaataagtcacaataaaataaatgataactacataactttactcaaatgtatatcgaaaagttaatggtgttaaatattaaagaaagcaaagggagtatttgatacatgcctatgaaatcttcttcagacataacatccttaaatccaccaaccagattccaaaactgttctggtgcataacaaacaggcaaggattttataaagcataaacagttgaacaaaacatttattcatttgttactctagtcggctgatacgatcatacaacacagtttgacatgcctaataagccgaaagaaagatagacatgatgattaggatgaaggtggaccaccttcctatccgaaaatgtagaacatgacagccgccaatgcaaccattactgccgtatcatcagcagtatcagctcaaccccaaaccaggaagcatcagcacactgaaatcatgaataccactggacaaaccaccgatgctatggaatatttcttactctcacaccccaaaaaatttcaccttggtttatagacaaccgaagctcccacttcctctcctgcatggctgcatccagcagccagcatgagatttttccggtaccggagagattgagtaggaacgagatcgctagatgttcattcaggcaacagaccatctctttgctggagttctggcacccatttcagcttccgattgatcggccctttcaaaatttgagaatgttcccagtttccaacttcacatggagccatgctcaaacttggagcacttggcaatggataatgtgagtcttgaaattacgacccgcaatggtgaaccacaagtttgctatgaaagacctgtgctggcccttccgagcaaaaacatcccacatgtgagcattgttaatctcgataactgttggtgtgtttgagacatcgacaagagtgatgctcatattgttgcggataatgcagatctttccatttagggagaccagagctgcagcttcaaaagctcgtgaattgcccagatggcgcctgctgtccatgaatctggtccacgatcgtgtgtccctatcatagactctaagcttgcatccgtcccggcattctgctgaataaagacgtccattaaagcaaatgcttggattccgccagcccgtaaccatttcatcagcagtgactgaccatacgttggatgttggcatatagacctcactcacaacctgacgatgagaatcaagccctttcaggaaccatttgccatcatatacaactccaataaaaggtaccattcccgtgctcatttcactgatgtaagaccatctattcctgtttgggtcgtaaaattcagcagatcttagagttctttgtatcccttcacactccccaccagcaacatagaggcggttgtttatgacacaggaaccaaagcagtgacgcttttgtagcatatctggggctcggagccacttgtttatccgagcattgtaaaatacaacacgcctcatagaccctcggactgggtctttgccaccaaacaggtacagatagcagccactaagaacagcacagccaaagcccacggcctctgaatactctgctggaactggagggagtgacttccacacctggtgaactgggtcaaaggcatgccaagaaatcttccgatcacggtcc

SEQ ID NO: 64085 - DNA, 1683 bp, Oryza sativa
agacacagactctacctgcaaatgcattggtaaatgaagttaggatatgcttatactaacctgaatgtggaacagcataagtgaaacaaaaccacaagaagtaactctcctaaagacacaaacgtatctttctgtccaggcactagcaaaatagtgtgacgattgcattgcatgatgtttatctttcttatatatctagcaaaatacccatgcgttagcaacagattccacaaaagtataccgtaagtttctaaactcgaaaattatatgtatattaatcaggggggaatatatataacttgcaaccgagcatcaatccacaaatagccaaaccatgtgcataagtgatctatttgttcactcgcataagatcccaccaactctggaggtgatggtgggatagcaggctcatcatcgtcactattcactatgatcgctctactgtataggaacggaattggagaatgtcttttgctaacttatggatacaaggactagatgttaaaggtacaggctttggtttatcctttctccattaaactccttgtataagccatttttaagtgtgacatgagcacttgcagctacctaggggtgtaagtggcaaccagcgaaacccacttattttgacctataagtgggttcgcggctgacccacttacacccctacagctaccaccttggtaggtttggcctgtcatatactagtatcaattgataaaatatagaaaaatcatgcattgatattgctaagctgctctgctaacatatttaaatgcatcaaatggatccacatatattactttatcatgcagaggagagagaaagttctctaaatttttagtgcccaaatgaaattcccatgtaaaattattcttgtaaaaaggctttgtttctaaccgaggaagagcacctagatgacatctataagattgataaaagtgacaatgaaaagcccaacaaatgagttcacaagaaaggatggtttaggatagcaattatctccatctttaacttaaaccaaaactaaagaaagtaaccttaagttcctaaaaccctacagatctagatccacaaacaaatcaccaatatttttttaaaaaaaaaacaacttttagtaggaatgaatcaggtttgcaatatcgtgcggcagtgcggctactgctcggttacaacggttacctcgcacaataatcctcttggtttttaaaacctctcggtttttgcggtaaccatgacattaccacagtaactgtgataacaccaggtaggggtaatccctccccaaatggtaaggtaaatcctcctagatccagtggaaaatcataccattcattaaaaaaaaaacaacttcagaccaatagtggaataacccctgactctaaccccaaacacatgacaccctcaaccactgtttttattaaagcacacgatcgaagtcatgtgactcaccagagatcgaagcacacgagttacactggcgaatggattcacacactctctttgtgctgaacccatctcacaaagaaaatcgccgagaaactctctctataaaaaagcctcaataaaagcaggagaataatgattttatatcaaaccggtaaaccccatccagcgcgcacatggtttggtcttgtagaggttttcttttgggggagagaagggggcaagtcttgatttgtt

SEQ ID NO: 64086 - DNA, 4772 bp, Oryza sativa
ctttggcgataattagttcaacaaagagacagagaattttagtagcacttttaatgtatgtttgctatgtgcttctctgtcaatttgtaagagacaaagagagacaaatctgatgtacagtctaaaggttcctaaaattgatattgcatccatcaaacgttacaaacatcagcacggctggcataccaaatgtataacagtgtaagagacccaggatatcctacctagtctggccattatatttacatgaccatttcctggttcaactattatggatgctaatctcatactagcatcattatattagagttactagctatgctagagtagtgttcgtcatgctcagcagttcatatgtacatgattggcttggtcgttataactagtaagcaaaccttacaaattcacatacattgcacagaatgtctagcaatgtttgtaaataactctttatttctcttgatacaaaaatgcgctccttgcgtattcccaaaaagaatgtctagcaatggatcagacgcttgtgtagctcatgtgtgacacatggagctaggaataggatgatttgctagtgctacttcctccttaattcatccctaaaaaatgactatgatgagaaaaaaaatattatatgctagcttttaaatggggacaaaagaagggacgaacaaatttggtgatcccatactgatacaaattgtccatctagcagtattttgaccagcaaaaactcacgaagtggcatcagcacagcaaagattacttcaccaaaaataactaccacgcattcacagataattggaacctatactccaataccaagccctaagaacgcagatcgagccctcgtccatatcaaaaacccacaaatacgccagggcatgaacaggaaaacccttagattcagcacttggcagccaaaggttgacgcctttgggccaagaacactaccccggagctaaattcacgcgacctgcggcctcaaaacaagaagcgacgctcctctagggccagagagaagattagggggacggaactcaccagtggcacccggacgcggattccggccgcgggccgcggcggcgcgcctccggcagccgcatccattgccggatcgatccgggcaggcaagaacccccgcgattcggccccccaggagccaagaacccgcctctccctcctctcctctcctcctcgctactacaggaggaggtcgccttggtttcaaaccagcagcagcagcagtgggatgggggaggccgcagatgcaggagatgctctcctctcctgggagcttgggttggtttggcttcgaatcttgcggcgtgttcaggacttcaggtcagtacggctcgagctcgagacgtcaaggttctcaagactcgtgtggactctcgggcacatgagacacacgcacagtccacggcgtgttcagacccgtgtactgcactacagcaagggctaccaccctgaatgactggcttcttctgttgaagcttggaaaattgttttgccctgatataagtgattttaatattttattggtgctgtttgaccactcgtcttatttaaaaattttatgtaaatataaaaaaactcgtcttatttaaaaattttatgtaaatataaaaaatgaaaagttgtgtttaaagtactttaaataataaattaagtcataaataaaataaataataattttaagttttttaaataagacaaatagttaaacaatacaggtaaaatgtcaaaatctcttatattaagggacgaagggattacgttttatcttcgaagaattgcagtctcagtagaccccattgtaatgtttcttttcctcgactctaaacttccgtaaccaaaacctagttagtcatttattggcaaaaaaaagttcgcttaagggcctttctagtttttgttagaacatgagtgttctttcataacacatcttgtaagtgaagatttaattcctgagtaatatatccctttcccccaaaaaaaattcacctcccttatttttcgtttacatgttttttaatatgtaaaatagtgtattttttgcaaaactttatatatataagttgtttttttaaaaggtaaatgagtccactttataagtttataatagttaatgttcaattaatcatgtattaatgttttttcgcatgcgctaaaaatcatgaacacagccttagcttttaagtactactagaataaatagaattggggataagaaaagtcgtactagttcgtcgtataacggaatccaaacaagataagaacgacataaaacaaagcaattatcatccacggcataatagcttgaagatgtactttcgtgtttagtttgtatggtatatgattttctgaagtgttgatggaatttataggtaaattataaattagtaaagatggcttgattactattttgcttatgacagatatgactctataaaagttaatcgcacggctataataaaataagaaaagtaaaaattagatctaatagactctttgtaaccctcaataaaaaaggctaaggcagccatggctatggtattggtgtggaatcatgttgatcaatgaaaggtgacgaaaacctattgaaaaattttgttagcaacaagagatctaagaatggtgcaggagtttaactggatcaaaccgattacttaatataactttttatgttaaaacggattcatggtgtgataataaaatgcctcaaaagttctattcatatgaacattgaataatgtttcacaatttatttaaaaaattcaaacaaataaaaggtacccttcccaaaaggtttaggcccctttgattcaaaggaaatttataggaattttagaggatttcattcttataggaattttttctacaaagccctttgaatcaaaggaatgaaccatatggaatcctatgaaattcctatggaatgcctcttcacataaaagttttggaggaattttaacaagaggtagaacctcatggaagaaatcctttgagtctttatctctcctcaaattcctgtgtttttcctgtggtccaatcaaacggtcattattatgtcttttctgtgttttgcaatcctctgttttacactttcattcatatcagaatcctatgtttttcctattcctcagttttttcattcttatgattcaaaggggcccttaacagtggcatatctacatgttgagaataaaaggcaatagctattaatccgatcagatatgcaatacacattttttatcagtacatacgttagctcattcctttatttgttttgtttatagccataaaaacaaacttcgtgcatgaaacagtcttaaactctctagaattttattaagaaaaacctccatttcgggcccctttaaattttaggaatgaaaaaacggaggaatagaaaaaacataggattctgataagaatataagtgtaaaacagaggattgcaaaacacaggaaaaacgtaggaatgatcgtttgattggaccacaggaaaaacacaggaattaaatgagagataaagactcaaaggattttttccatgaggttctacctctttgttaaaattcctccaaaacttatataggaagagacatttcataggaatttcataggattccctagggttcattcctttgattcaaagggctttgtaggaaaaaatcctataggaataaaatcctctaaaattactatgaattttctttgaatcaaaggggaccttcaaatggtactcctatacaactgcaatttgatactcctccatgtagaaacctccatttcaaaacagtgatcctattcgaaaacttcacgcctccgacacgtggggcccaccgtccaagtactcacatgccacagcagcccacgtactccgtttcctctccagtccgtccatccatccacaaacggctgacatgcgggccccacccccacccccttgttgtccaggaagctccgcgaacgaacaaactatccgtgggcttccttcctctccagtacgcgtcgccccgccacgtcagcgactggcacgtggggcccacgcgccggccaacctgtcagcgacggacagcgcagtcctcctcccctccaaccacacgcagcgaggggagaggggatgggcccacgtgtcaggttgccctcccgtccagtactctgatactctctctctctctctccctccctcccgtgtccacagtttctctctcttctcttctcttctctctctcagtctcactctcccaatccgcctcggcccgagcgcgcgcgcgctttccccccctcgccgccggcgacgagctcgaggcggcggtgcgctcgcctacctccggagggcggagcggggggatggagcccatgagcgtggacggcggcgggggatgcggcggcctggacacgcagatcgagcagctgatgcagtgtcgcccgctcgccgagcaggaggtgagagcgagcgagcgagatccctctgctgctgctgctgctctggcttttccgcgttctggtctcgccgttcgtcccgccggcgatggctccgcggggggcgcctcgatctggggaatatggtggcgctttgatctgttcctagggttttttttgttcggggatgttgggttggggggttcggatttgccgtgtgatccggtggttcgcgagcgattggcgcgtagtttttgttgtgctgggtgatttggcggtttggagaggggttcgagtgcttgtttgttgtggctggcgagggcaacttggaatttggtg

SEQ ID NO: 64087 - DNA, 9816 bp, Oryza sativa
gggtacttcatagtgttacacaagttagttggtcctttgatatgttttagtcatacatttctgtgcctttcaatccaaccataattctgccaatgctgatgactaaaataaacacaggaattcaagtcttcctccttccattcaattttcatcaccttaatttttaccccctcttttacatgccattcagatagctcatagtatgtgcacatacaattctgctaagacgttctcaaaatatttgcatgttctgttccatggtaatttggtaaggtagatgagtactggttttaaggttttgccttttttttttttgggttatgcagcctgtcaaaagcccagtaacgatttgtggtgatattcacggacaattccatgatcttgtagaactttttcggatcggtgggaaggtactatttgcatttacttttgctaccatactttgaaatcttcctttcgttattctgttcttaaagatacttaatatatttgttcttctttgtttcagtgcccagatactaattatttatttatgggggattatgtggatcgtggctattactctgttgagactgttactgtaagagttaacctacttattttctttgatgagtatttatatacagttttacagaagctgtcaagtttcacataccagatttatttgttcttattggccagcaacaaaattcgattactggaattctttcaaatatttcaattgttttatgtttgagatcatgtcattatgtgtaagcactactgagtggtattccttatccagcttttggtagcgctgaaggtgcgtcacccacatcggattacaatccttcgcggaaatcacgagagccggcaggtgctgttcaacttttctcaatgactatgtgcagacttggccgcaattttctcagttgattagaaatttgagcaaatttgttgaattcttctggtttctgtttagcacagtttgttttattatcgtctgtctgtcataatggtgaattagttatgtctatgttaaactgaaaatattattttatgatgattgcagatcacacaggtttatggattctacgacgaatgtttacgaaagtgagtttgtttaggtgcttcatgaaaattaatcttaatcctgttccaggtctagccttgtaggctgttcagtatgaactgcatcattgctgccatggcagaaactctatgcatgttctgtctgatcctagagttatgtggtacttcttgtccttgtctcagtataatagacagacgaacaaagttttagtatatgtggaatctatttggtatcatgtgccctttttttctttctgtgcggtagtatataggttttgtgttgtttgtatattagagttctgtaccttttgaacctatgtggtagtacatatcattaattcaatatgtttcaaacaaaacagtgatattgtttgttaatttatagaagtgaaatttgcaacaatgatttgctactagatgtttgaaatggagtcatatttttaatttgtgttgttgacccttctttcaaaccaggtatggcaatgcaaatgtatggaagatattcacggatttatttgactattttccactgacagcactggtatgtgctctgaactgggacctcctctttttctttaagttggtttgttctgtcatttctaagtatctcttgtttttctttatttttttgttttgcatttattgcatggtacactgtttcaatatggaagcctagtttgtttttcacctgtatgataactactgattgtatatcgccacctgcagacttgatagctgggaacatatcgatggggcatgactagtgtctttaccttgtgaaagaatgcgacatatcatacattatgtatttacagctgcataattgaaattccttggccatttgggagttgtgtgacatcataccaagttgctaacagtgatgttctctctggtagatctttggattttcaattgtatggatgcattacttgaatcatgtaaagtggtcatcaataaacgtttaatgtagtgcataactctttttactgcaaaatcattaactgtacatacaataactgcattccatcctcaataaacccatattgtcagcattatgcatctatgagccatgttaatattttctttatgttcttgaaggtggaatctgaaattttctgcctgcatggtggtttatctccatcaattgagaaccttgatagtgtgcgtagcttagatcgtgtccaagaggttccgcatgagggaccaatgtgtgatcttctatggtctgatccagatgaccgctgtggttggggcatatctcctcgtggtgctggctacacttttgggcaggtactacactgtcttgaactttttcagttgcagatgttttaattatagtttgttcattctttcttttgttttccaggatatatccgagcaattcaatcacaccaacaatctcaaacttgtagctcgggctcatcaactagttatggaaggatataattgggctcatgtaagtttactgaacctttggatactttatcaggcgtgttgtgcaagtaatatgtcataattattcactatgcacatacaggaacaaaaagttgttactatattcagtgctccaaattattgttaccgatgtgggaatatggcatccattttggaagttgatgactgcaacagccatacttttattcaggtgattactgctaactttattctttacaacaactttccggcttccttggttcgttaagttcatgtaatacgtgctggtcatggcttaactgtcaaagtaaggtgttggaaatctgaattagaatgttgataacttgattttgctctttccttcattcaattcatttaaaatacgcattctgaattctgatagttagctcaattgcatatcctgtagttggctaatcatgttggtttcctattgttgcagttcgaaccagctcctaggagaggtgagcctgacgtgacacggaggacgcccgattatttcctttgagttaatggtgctaccatttgtcaccttgtactgcgaatttgcgatagtcaaatgctggtcagtgatactttgctggactgtgaaacctgcgcataggccaaccaacaataacaagggaacatcagatcccttcgtaaaacttgaccctccattggtcaatgcaagagatgctgctatcctgaaacaaagtgtcatgctcatgcagcgatgcctgagtttttcaggtgataaaaaaggcccatccatcctcaccctctcctttttaggcatttttacagaggaaatctagtggcaagactgaacttctatttgtattttgtagcgtaagcttgtatcgatagtcttgtaatttgtatcatcaatggcaaggcaacctaatcatctttcggtgtagtattccgaattttgggggtggttaccctgatgtgctacagtgcagtgttccatggcacctttttctctagttggatgtttttcttcgcatgtatctgacattctggttttcaaatttcgcactactctactagtactccatactgttctagacatgtacttgatcaaagccaaaaacttggtcaaccgatgttctctctgctaaattatattctgaattatgtgcatcttttgtaaattctgttaaattgattgccaatttttgctctgattacatagtgatagagataacatactatcaaccttaattactgcagcacaaagatcatctgtcagactgccacggcagaacaagttaacaacaatctagcctagtgtacacgccgcgcatgcatcctcctcttctccggcgccggcctggccattcaaacggaggcgccggcgagcagcgaggcgttcgatgacgacgacgcgccgctgccgccgccgacgcccctccccttcatgacgtgcttcctgagccccgggatgtgcacgttggtgatgtagtccgtccactcgatgctcctcacgtcgaagtggaaccgcgccttctcctcctccgacatctccccgatcagcgcctccgtgttcccattgtcgaacctgccgccgccgccatggccggcgatcgagctcatcagcatctcaaattcacaatgcattatccatggcgggtatatacgaatatactcccccgttttaaaatattttatgccatcgacttttttaaatatatttgaccattagttttattagaaataaattaagtaattattaatttttttatattatttaatttattgttaaatatatttatacgtatacatatagttttatatatttcacaaaagtttttaaataaaacgaacgatctaggaaacaaacctgccgccgtagaaggtgtagggctggtagatgctgccgaggtagatggtctgctcgacggacttggcgcagagctcgcgcagccgctgcgacaccctctcgtctccggcgccggcgccggcgccggcgaggcggccggcgcgcagcagcgcgtcggtctcgacgtagctggcgaactgctccatggtgtcgaacagccgcatcggcggcacgtggatgggccgccccgccgcgtcgctgtacggcgaccccgtgaagtgctggaagaggaaccggctcaggtcgccgaacgccagcgggttcaccgtcgacgacgccacgtggtacacgtgcatcccctccgccgccgccgccgccgccgccgcgccgccgcgcccgtgcttcgccatggacgccagcgttgcgttcaccaccatgtccgccggaaccttccatcacaaatcgccatagttaatcgattaaccactaatcgcaattagcgaatttaatcatctgcttaatcattaccacgtcaagaacaccctccgggtcagcgaggaacccgctcagctggcctttgccgtagtacagcacaacaggatccatcatcctaatcaagctcaaattcatttcgccaaaatcaatgccaattcatcgtaaactaaattatctcatgaactaaaattggtttaagttggtgaactttgatttacaatttgtacctgttcccttccatccaaccggggaagggatccctccaggtgctctcgatgacgcttggcctgatggtgacaaccggtatatctcctcgcatggagttgatcaccatctctcccatggccttggtgaacacatatgtatcttgccacccatggagttttgccctacaaattaaacccaaatcaagcgaattaaccaatgctgtttcatgtgtgcaattgcataatcttgccactgcacattcagacttgaaacgtttctggcattgcgtgtatacctctctaatcctaactctttcatttcttcagagaaagaggctgaatcatcaccgtgtctcctgtggtcaaaagccagcttgatctctgcctcgatgtcaagcatggtgttcttgtgttgtgaagaatctggagatcctaactccttggctatggtgtcccccaagcgaaatggcttctctagcaccacaccttgcctctgtccgttcacatatgctgattgccaaacatgaaattcaaaatccacagtagagagatatatctaaggtttttggaggtaatttcagtgcaagttttcagcacaagagcttttcatttgacatgcatttctgacctgttgacacttgcaagaacagcttcagcctccgaaaccgctgcgcgaagctcattatcctgaatggccctacggtgttgatgtccattgcaacatcgtacctgcaaaatcgaaccaaatgcagcaacagtgatcaattcatatgcttattatacatgaagtgatccaattaagaactcatctttggagcaacactgcagttcagagaatgacaaaacctctcgtcgaaagtggtgtttgctgctgagttgacgatgatgtcgacctcgtcggcgatcacgccggcaagctcaggggcgatgccaacgttggcttctctgacatctccgactacaggcaccagctttcttgccgcgaagctgtggtaatccttgccatggatttcctgcaaacgactgaacaattctgtgtccacaacctgcacatcacacagttaaaacaaaaggaaaaatacagtcaaacagatgaacagataggtactaacaaatgtttctctgaaatggatcgaacaatgatcgcaagtagaacctcgttgtgcaatcttttcagtgctgcgtcaccgtccttcgccttgatcagcacgtagatcttgccaacgtcgggattcgtccgcaatatcttctcgatgagaactgatccagatgatcaagcaaaatcaagaagagacgcgagctacgtacgttggatgatccaaatttaagagaggaagaagatagatttactaccttttgccaggaacccggttccgccggtgatgaggaagttcttgccgccgaggaactccgcgatcccaatgccgccggcgtgaccctccgccgccgccgccgagttcttgccgtgcacggaggaggaagacgaggaggagacgcagcacgccacgccacaaccgcttcccttcctcctcaccggcagtgcagcaacaaccggaagcacgcttctgccatgaccacggcgacctcccagctcaccggcaaatcccggccgtctccctgcggcggcggcggcgacacgggataggttcacgcatgaactcatccccatggccgcctgacgagacgaacaagaagaagatagacacgttcttgcccacaaagcccaagcaatgcaaagcaagcaaacgatcaaagcttggctgcgagtgtagaagcttggtaggtgagcgtgtgctacagcaatctacttctacttccttcctgccttgtgatcaaactgccaatcacctgagctgtgatcgagttagtcacctacaaattaatccaagcaaagcgaagctgaattaatcgaacagaacagctagggagctgtagctgagcagctcagagctcagagaggcagagagggggttaaatgacgcaggaggatttaaagctgcttagcttcagtcttgcagattgcaggaggaggccatctttttgccgctggtcagtgaagcaatttataataagggacgctaagctgctgagtcttttgggcttatggcatgcaaagctcgtgcacttcttggaaatgcagtggttcatgcaaaagattcagttccctggggcggcccaaagttgcttgttgatgatagcaaccatcttattatggaaatcgcaatgaagtatgataataaaacattaaatcaactctaaaaataagtataataggttttgaaatttaaatcttagttgcggttgataagctaaagagtaaatagtggagacataacacttgtacttgaacttcaaggtcatgttcttttcaactatttcactatattattgtcatggattatttgttcctgtctctacataaaccgtgtttagttgttttggtaaaaaaaaattgacgtatacggacacacatttgaagtattaaacgtagactaataacaaaacaaattacagatttcgcctgtaaactgcaagacgaatctatcaagtctaattaatccatcattagcaaatgtttactgtagcaccacattgttaaatcatggcataattaagctcaaaagattcgtctcacaatttacatgcaaattgtgcaattgttttttttcatccacatttaatggtccatacatgtgtccaaacatttgatacgtcggaaaagtttaaagtttgaatggaagtaaacacagccataatacggttcgtaatttgaggtgatgtgtgttctagatgaagaaatatatggctgtatcccccaatgccctacccctacgtcatagaagcgttcacatcattcctcaattattagatgcttacaagtctaataatatcgggaacttttaatgcttacatatctacaagatattcactaatattgggaacttttattgcttacatatctacaagatattcattgatagttgtacacaatttcatgtacttatagagtactgtaaaattcattgacaatagaactatagggttaattagaaccatatcattactttatagttattggagataccactacttatcttttcagtgcaatcattaaaattttttggaccattttatccttcttcctctcctttcccctctctcctctcacctatttccaatgagtccggccaccctctgcacctccaatttcccctaagtacctcaccaatgccacatgcttccccgcgcctcctcctttggcgcatgcattggggaaaggggacaaaggttgaggtcagtctcgctcggccacctccctcattcctcttcaaccggacaccgattttgtcttgactccagacgccacagttgtcaagcgggtgtaggtgggctaaccatcagggacgaaggcaaaggtcgggacgaaaggcagatccaatagtggagaggtcctacggctgcgagaacgtcaatttagctacgcccgaagtgacaggagagggaaaggaagagatgaggggagaaaggaagagaagggaaccattggtccaacctcattgctcgccaccaccggagtgagtaaattggggagacgaagagagaaccatgagacccaacctcgtgggggtaagtagagggggaggagctgccgaagggagaaaggaagagaagggaaccattagccctacctcactactcgccaccgccggagtgagtaaattgggaagacgaagagagaaccatgagacccaacctcatcggggtaagtagagggggaggagctgccgaagtgaacaacaccacccaccgctccaccaacgggaagaaaggagaggagaaaggaagaagaggaatatggtaaaaaataataatttgacaaatacatcataggggtaaataatgacatatgggtccaaacatataggggtttgttcaggttgatgccatgtcaaactataccatttttttaagttgtcaaaaatgtgcataaatatagttttttttgccaaactttaaaaaatacataaaaaatcatgctaaaattttagtaatattgccaacttaacaaaatttgttaagttttattttgacaacaatctaaacagcctcggtttattaatggtattttttgaaacggacaaattagtaatggcaatggatccaatttatgggcaacgcgcggatgatattgcttagtttaaaagaaagttgctgtacaattgtactatacactctagggtgaaacaaatagagcgctaacaatcactacaaccaaaagggcagggcagcaggagaaacacaaacaaatacgaccattttctctcaaccaatagcctatagtacatgcctcaaatgtatacacaagtcacgccaggtcttagtacagacagaagctgatctgatcccagagaaatcagcatcctggcaaggattgagctgatgccatggcagataagcttgcatctgaatcagcacagtgtctcagataggattgccggaaagactggcctgaggatgctcctgctagatttacctctgaatcagcacagtgtctcaggtaggattgccggaaagactggcctgaggatgctcctgctagatttaagtcggattcgccgccatgacgtaactgggactgttgcggcgactgaggggccatggtagacaagctaggccctgattccccacagcgccttaggtatgaccgatgctggctggatgaaccgagataaaagcttgaagatccatacgcagagttaaaaaacacggctgcaggaattcgat

SEQ ID NO: 64088 - DNA, 1550 bp, Oryza sativa
atataaagacaaaagaacataattataatctattatgccatgaatggagcgtatgatgcccaaccctgacagtggaactaagatgttgcagaaaaaaaaaacaagtgggagtgataaggtacattacttgaaatcagaaccccgctattttcattgtcgtatactattgcagctttgaatccagcatcctgtgcattttttactttttcatcaaatgtgcacccgcctcttatgatcagtgcaaatggagatggtggacccttttctgctttacttgttaacggactgcaggcgtccaaaggttcagcagtataaacaacgccttcaaaacctgaacctttcactcctggagctgcaaaccaattgaataaacagcataatgaatctttctgacaagacaatatagacttaggaaaatgggaagtagaagaaaagaacctttcaagaaaatgcagcatggcacaatcaatgggataaaatcgaagctaattctagtcagagagctaacacaaagatataataggaaatacagcaacagattcgcacactaccataaataaaacagtagcacaactacaaggttttgaaaaccaaaacattaagaccaaaatgaccataggcaactggcttacaaggtatgtgaaattttaggtaataaagtttcacaggtagggagactgagatcccgacaaatagaatctattagtactctactataacaaaactaatatgataagatgtccagaacttaccaaaacttgcctcaacatcatcaaacgacaaagtcagatttgtccccatcagcactacatttgcagctcctaactgagtcatgaggcaaaatgttgcacagagacagataagcaatagcattgttcttcttcgattcatcttatcgaccaacacagatcttcgagaaagtcaaggttgttcatacaaatttcaaccatggaaggacaaaaaggaaagccaccttaacactcagaaagactccaaacctacgtctgcacaagcaggaaacggacaacgtgtccagacctgcagtccaaagcaccaatcagctaagattcctgcaatgaaaaccgacaatcgtcaagatcctgtcaactaacattaagccaaagagtagggctttcgcacagaaagaccctggaatagtacatactactgagcaacgcaaaaacaagtaaaccaacaaaaaagaaatactacatggtaacttgttttccaaaacaaaaatttactcttaatgcctctaatggttggaaaagaaacaatgttaagatggtacttgacaagcaatgatgattctcctaagaaataaagccccagaggaggtatcttccctaactacgtagtactaagaaacaattggagaataggtctactgagtggagagaattaggacgaaataaacaaatatcaggagacccaaaggtctggtcctaatctcaggaatcacgaaaagctatgacgcaacaaacgatccctatttctcctgaactgggcatccaaaaagataccatccctgagtcctaatcaagtatcat

SEQ ID NO: 64089 - DNA, 1007 bp, Oryza sativa
  unsure (1)..(1007): unsure at all n locations
nnnnnnnnnnnnnnnnnnnnnnnnnnnnnnnnnnnnnnnnnagaatatccattcggaatttcggattatccaatgtacgcctatactaatacagtactctcactactcactatatattttatgcgatttaactcttgtagctgttttgtttttgcataggtttatattcattttttaaactcaatattcctagctacataaatctttaaatttagagataacattaaatgaattattttgtttttctttataaaaagtacttcctctatttcacaatgtaagtcattttagcattttccatattcatattgatgttaatgaatctaaatagatatgtatgtctagatacatttattagaaatgctagaatgacttacattgtgaaacggatggagtaaaactttccacctatataattgaacttacaacttacatcctttaaatatgacgtagatcagagatatgacgacgtatcaaatacaacctagtattattaccaaattaaaagttcagcgagataaacgtatcttaactggttagattttttctgatgaaaccaattataaaaccctaaactcagcacgtgtacttccgtgataggtgtttagaaaaataaataatagtgccagtaatcagtgcagactgagctaaaactcgagaaaagaaagcgataatgattaaagaaaaggaaaaaagttccgatttttggaggcgcacggagacttctcgcagcagtttgttggcggccggataaacgagacgaggcgaggcgaacgcgaaagctccccatctccctccctccctccctcattattgattgattgattcgcagattcgccgctgccaccgcatcccgcccacccaccgcgcgccaccgcctccgccgccgacgagcccccgcggccaccgccaccgccacctcatcttctctcccaccaccgctccacagccgccctcccttacatggaagtcgacgtctccatcgccacgcccgcaccgcaggtccg

SEQ ID NO: 64090 - DNA, 2381 bp, Oryza sativa
aaaaggcatggggttcagctagagaatcttggaccagataagggcttggagaaatcagaacttcagaactctgatattgacgcttcatataacatggatggaggtgtgggtgctgtcgtgcccaacaatgaataggcatcaattttatgatgcaaattgcacaatttggtgctttataatttggatgtatgtttatagaagccaagagtctgattgtgggtgtgataatcttgaatattggcgcccatagatgctcataaaaatcctatatattaaaaggataaggcaatgcgccagtgtgtctctagttttgtaacattgaagcattttaagcttcttgtattccgcttacttttttcataataaatcgtactggtgtggattacttttttcataataaatcgtactggtgtggagtcagtgcatctttcatggcaactcaagtgagctccagtgtgtctttcatggctagaagaagtgtctgcgcaagcacaactagtagtaacactgattgaaaaaaaattaatgagaagttgagtgcacactctatattgggttattcaagaaacgcaatcgattacacaggctctaattgaagagaaaagtcgcaggggtgaatcacctctgatttgatggagtgatataatatcagcattatctccgccaacataaacgataatcgaaagtacatcctgtttagaaaaataataagattacagccaaagtttgggattattgtttccacttttagaatagacagtagtattaccttatcatgaccttcagatgtgaatggaacattcaattgcattagcttgatctcatggagttctgtcagttccactggtgtctacagttcaacttgacaatcgtcagttcaccactttctggaaaaccagacatcagcattgcttatatcttcgctccgaatggccttttgccctattatatataaacttcacggggagttcacttgagttgaagaaataaggttggacaaaataggcttctcatatcctgtagtcctcttagcattactacttaaattgctaataacagaccagtgcatctcaaagttgggtgagaacccagcttgctgcatgtcatgcagaagtgttgcagccttctgtagattgttactcctgcaacagttctcaaaaacaactctatacatgtgataggatggtgaagagccaatggtggtcaacatttccaaaatattcatagcatcacaggttcttcccatggcacaaaggccctgtataagcacatcgcaggacatgtcgcttggttttaggttcgcaaattgcatctcagcaagaaaatcaagtgcctgatcgaattctttcaacatacatagcctgtacacaacagagtcgtagctaacttcactcggaattttgcctttctttagcattgtatttagcagactaacagacatttccacatctcccagtaagcagagttccttgattaggacatcaaaatgtatgtcaaacccaatcagctctcttttgttcatgctgttcagacaagatgttgcttcagaaaacctccctgatgagagaagacttgaaatgagggttgtctcaatgactaaaccatgcttccatccgttgctttctatcagatgaaataattctagtgatttctcaaggtttcctaacttgcaatggtgactcaatactactctgagactacgattgcttggcgttaatccctgagcaatgcaagaatcaagcatattaattgaatgatcgacatctccagacttgtgaaacccattgacaaggaagtcataagtggtggtgtctggagaaaaaccattgcttttcatatccttcaacaaattatgaacctgtaaaatgtgtcttctccggaaaagataaaaaatcagaatattgtataaaattagttctgttgacttgtccctatcttggatcagctctttaagtcttaatgcgctggaaatccgactttgctcgcacattctacggacaagaaagcggtaactagaaatagaaaggctattctgcatctttaacatcatgcaaagaactgcatctgcctttctccaattttttacacaataatatgcttgtagaaaggaatttagcaaggtagcattgaacttcttccccaaaactgtttcctcaaagactgacattacctggcctatttttcctgattgcaataagttcttcacgatagaactgcacgttgagaaatcagtagattccatgttcatcacagattgtaccaagtccatggctcgttctgcatcaattcttgccactgaagacaatgcagattggtaagtggacacatttaatactttgtttctgttaagcaacatgtcatacattccaattgtttcagca

SEQ ID NO: 64091 - DNA, 1173 bp, Oryza sativa
ggaaacattctgatttacttgtagaaaaattcagatgaccttctacggaaatgcactgaatatatttttacaaagaaagcatcttagtttgcgcttgtcatagcaagaatggtttttctggaggtaaatgtttttgtttgtaatttaattagttccaaacaagtaatgttcaagattttatactttcatagcgtgtaagactttcttttacttcctccgtttcacaatgtaagtcattctagcatttcccacattcatgttgatgttaatgaatatagatagatatatatgtctaaattcattaacaataatatgaatgtgggaaatgctaaaatgacttacattgtgaaacggaggaagtagtgtataaggacaaagtttcatatgcatgctcaattgcaatgtggtaagaaattacattggtggaattttctgttgcagctttggtgatctgccaaccagttgaagcatccttttctcggagcaagaggtgctttctgttgatccgattgtggttccgagctggcaccatgaaggaaccatcagaactattattcttggatccacgctgagatgaacgagaaatagcccaacagttcgtcagagcagaagccattgccatccttcaactgaaaaagaaaggatgaaacagatcagcactcctgaaatgatgtggaaaatgggaaattttaaaagcttacatgccacaacgtatccacacgaacttttcaagagctggaaatgtttgtgatggtgatatgggaatggtccatggtatggtatttatagctgaagaaaagtttgcttcagaagcaaaggatacctcatcctccctaaaacagagcccctttttgcttttttttttcagttcatgttcgtgagttcatcactctaagaagcaaagatgattatccaaaagaagatatggacagccacatttgttgttacctgccatcatatctggactagctaggtgctttatatactcagtttccagttctccagcaaaagctttggtgtttcttacactctgctgatttctatctaaggcggcacggcttgtgccatggactggatgaagccgatgtgtatctggataaaaagattgtcaacatgactcatctcttctgtagtgtgtcaatcctaatgcattgtgtgttctgtgagtcatgg

SEQ ID NO: 64092 - DNA, 19845 bp, Oryza sativa
tggaacatcctgctcgatctgcgtgcgaatctatctgtgatttttacgttttagtacatactaatactgagttactgactgatcaaactaacatattaaaggggcagtaacacctgctagtcagaaaataatactctatccgttttatattatataaattgttttgactttttccttagtcaacttttttaagtttaaccaagtttatattaaaaatctagaacatcaaattagttttattaaaatgaacatttaatatattttaataatatgttgttttatgttagcaatgttgctatatttttctacaaacttgatcaaactttaaaaaattgactaggacaaaagtcaaaacgatttatagtataaaatggagggagtatttacagtatgctgcttgataattactgtattccttttgaagtaagaagatttaggtaggtgctaaaattgataatagaagaacttgcattgaacccataattccaaaatggatgaactaaaatacttttcttcaataaaaaaggagatccgctggacgaaatcaagaaaacaaagaatctaatgtgaaaattacaccataacatggtcaaaagaaaaaaaaaaggaaattacacccatagctacttaccagcatacttcttttttcccacagaaaccagggactggtttcccatcaaccttccaaggttgacattgctacagaggttacaactaggacatcttttgagtttttccacccttccacttatagatcttccacttacaccataagttgactacccctcgatggctcgaagggtataatgtatatatagtcgtgcaatgtcggtggcatctttgtgtccgacaccatgacctgatatttttcgcagagcttgtcgcttgttgggtcgacgtgtcgtttaagtcatggtatttgtcacgcaatgcatatccttttatgctcttgctctttttcggctacaaggattgtgttttcaaattaattaatgcaaaaatctagatataatataaatttttttgcaagggaaattactaaataaacaaaacagcacattcttaaaatcgttttatcccactgaagagttgtatttagatttagaagacttctttcttgagtgaatagtggagatactcctttgctatagattataattataggggaataattacaatagagggcatggggagtagagaaaacaaaaaaaaactgttaaactgtaaatggattctcgattgaggaatttaagatacacaattgtctccaatataaaaataaaccataatatttgggctgtgaatttattgtataatagaaaaatcaaggacacatggctaatggttgctaagaaaaaaaattgcaaatattctataggttctcagagagaaaagggaaatcattcaatttgattgactccaattacaaagaatttcttttagtgtcttagaaacatatttaatgatatgcagtttggaaaaaaaatagaaaataaataccgggcactatgtttaattaaaaggtaaaaaaaaatttactacttggggtgtggatttacattgtattcctgcacataagaagtttcaaattcaacagatacaattttaatattgaactctgtccactatacagcaatgcagtacaccgtgcatctgataaaaacagtgatatgctttattattcatggttctctttcttctggggagaactggaagatccaccttttggcaaaacaattcacagctttcataatacaattggctgctacagagcaatggcaactgagcgtaagtgcgtaacactttaacaaaattaataaagctcaaaacaattaatattctgcaggcatattgcacaggccagtattggcttcagaatacacagaaattgtaacaaagcaaactgcttttgttcttacccaagaataaccattatattctgtaaaataatatgggtaatttggccatttctttgcaaaggcaaacatgcaatttcgcacagttcagatccttgtccacaatttgttttgatcattgcaatcccttcttgcagaaccatcaacttatgcttatttacaaccatacaggcatcgatgacagcatcactcttttgtcgctcatgtagcttttttcacttgcacaaacacagtgccatactcccattgtacaaatgatgtgcaaactgatgtttggatggattgaagatgtttcacatatttatagccacgatccacgactcattaccttgtttatataattgagttcaggaaagggttgcatctgtactaaaaaggatatcagaagataacacaatggaggatatgtataaccacaagccatggctgcacatcttgttgttacaaattgttcacctttatgtagcttatgcagcttgggctgatgtttatctgcttgactagaaatccaaacaatagcctgtgatgcaacctctctgagtctgacaagattagacccatttcattaatatatcatcataagtactagaattcactattcaggatagcttgttgttcttcgcgcacatacatctgcatcattttctttcccatttcccatatgtgatattcagtttctgatccagaacagagcttcacaactgatatcctcaaccaatgaatccttttctttcagaatgtgatctcgactgtccaaaagactgaattatatccttcacactgccatctacaaacgtttgacctgcttctttgttgacaccactgtcatccattaactttctcattttctctgacccaaaccattctccaacagatgcatagatgtttgagaggagaacataatcaccgctttcatcattccttgcctttagcagttgcctatttgcatgtttagccagttcgatctcaccatgaaccctacaagccgaaagtagtgttctccaaatgacagaattaggctcacatttcatcgtatcaatgaactcaaatgcttcttttagtagcccagcacgacccagcatgtccaccatgcaaccgtagtgcttgatattgggttcaaccctgtacttatgctgcatcaagttgaagaattcacgtcccttgtcaaccatcccgccgtggctgcaggcgataaggacagcaacaaaggtgatctcatctggcctgaccttccccttcagcatcttctcaaacatatctatggattccaggacatgcccatgcagtgccagtcctcctacaattgagttccaagttgagacgtccttgtctcgcattgaccagaacacctcatgtgcacttttcatgctcccacattttgcatacatgtcaatcagtgcatttcctagaacaactggaaacccatttcttgaaaacatatctgaaagagaggaatgcagcctctggccaacgtccagatcaccagagtcagcacaagctgacagcaagctgagcattgtgacaatatctggcttttcacccatgcgctgcatctgctcaaacaactccagtgcatgcaaatgcgagccacatctcacatacccagaaatcatcacgttccaggacacgacatctcgctcgggtacctggtcgaatagctcccttgccaatgccatatctccccgcttcgcatacgcggtgatcatcacattccaggacacgaggtccttcacaggacattcgtcgaacaggtcccgtgcagcaccaatgtcccctcgccttgcacaccccgtgatcatcgccgaccaagccacggcatcctcacgagctctgccatcgaacagagcagccgcaatgcccaaattcccgcagctcgcgtgcatgccaatgagcgcgttcttgacgaacgcgtcggactcgcagccagccttcacaacgtgggcgtgcacctgaaccccggtgtcccccgcgcccatggcggtgcaagcgcggagcacgaacgggaacgtgagcttgtcgggcctcacgccgccgccgccgccgcgccgcagcatgcgcgtgtacagggagacagcgtcccggggcgcggccgtgtgggcggcgccgcggatgagggtgttgtacatgaagcggtccgggcggggtatttggtcgaacacgaggtaggcgtgcgcgatggcgccgcggaccgcgacggcggaggcgaaaaggagctcgcggagctcggagggatcggagaggaagccccggagcgccatcaccgcgtgcatctgcttgatgtgtcgcaggctccggcaccgccgccacgccggcggctgccgccgctgcgtccccgacttccgcaacatctcagagtctcagtccactagccttgtccacgtcgccaatgtttaaatccagtcccattttaaacgcatactaattgaacagttctccatattttttctcaaacattcatgtaaagttttgcaaacatggtgtcatggtacattcaaattcaaaccagattacaggtttaaaaatgtgcaaacatggtgatacggccttgtccacgtcgccaatgtttaaatccagtcccaccatttgtagcgtagaatggaacagctttcgataaaatttctcaaccatttagatgaaattcgcaccgtttcaagcagggtctaggaccaacaaatcctagaatcaaacatggtacattcaaatttcaaattcaaaccagattacataggcttatttactactccggtaagcgatacgggcggcggcggcgcggctgccggcgagcggcggcgggggtcagacggaggtggagacgcggaccttgaggccgtgagccatggagaggatggtcatcatccggtacttgacggggtggtcctcgacgaggtcgaaggtgtagaagcggaagaggatggcgagcgccatcttcatctggaggtaggcggagtccttgccgaggcagatccgcggcccggcctggaacgcggtgaacttgaacggcgacgcgttccggaacgcgccgccgtcgccgctgagccaccgctccggccggaagctcgccgcgtcggggccccagttgtactccatcctccccatggagtagggcacgtacgtcaccatcccgccggcgcgcaccttggtgccgtcggggagcacgtcgtcctccacgatccccttggggtcctgcggcaccgccgggtagaggcggagcgtctccgtcacgcacgcgtgcaggtacaccagcttccccaccgcgtcgtagctcagcagcgacgcgaactgcgccacgcgcgccgcgaacgacgcctcgccggcggcgtcggcgagcgcgacgccctcctcgcgcgcgcgctcatcctcgaacgcggccagctcgcgccggagcttgtcggcgacggccgggtgcgtcatcgccatgtacgtgaaccacgacagcgtcgtcgccgtcgtgtcacgcccggcgatcacgaagttgagcaccacgtcgcggaggctcttgtcgtccccgaagctgccgcccccctcgtcgccgccggcctccccgagctcgatgaaccgcgacagtatgtcgtgcttgatctgctcgccattacaaatcaacgatatcaagaaacaaaaccttttccgatctgatcatcaccattaccatgtcagttcagttctactgattctttgagcaagagaggaaggatcaccttctcttgcttgccgctggctcgagcctgcaagatctcagccttgcggcggcggatcacgctgtaggtgaagtcatcaaccagcttcatgctctgctcgaggagagcctctgatccgacgtgcaagaacttcttcagacgccacagaggatcgatgaaccgcagcgtgacgatgatgttggcagcgtcgaatgcctgggcaaagctgttctccgggagatcaggtgacagcgtcccgatctcaaccccaaacccgaccttgcagatcgagtccagtgtcatcctcatgaacaattcctgaattttggttagttcttgcatcagaattctgaacaatttggtttctcaagaaatgtttaggtattaggcaaggaattcagttggttacctgcatgtctacaactctgccggccttgcatgcttggctcagaatgcttgatagcttcagggagtactccctgaacaccacagtgctgaagtctctcaagttcttggaggcaaactcgaagctcgccgtcttcctttgcttcctccacatctcgccgtcggcattgaatatgccatcaccgagcagcacatccatgtaagacctgtacacttcaccctgcatattttcagacattttttgtgtcagtgttagtactgtgcaaggcacattttacagtacactgaagatcctatggttcttttaccttggggtaattggtgaagttggtcttcaggacatgctcgacgttcaccgggtcggcaatgtaggtgtaggaggtgaaaggcatgtcgacggtcaccgtcctgtccttcgacaagtactcgacaagccagtcatgcatcctgtggtagttcttcagttgctccactgtcgcgccgatgattggccatgatcttggccctttctggttcctcaggctccacttgtggaccaagatccatgagaggacaacaaggaagatagctatgagcttgtggattcctgctactgggaagaatgatgtcactggcattgcatgagcttcctccatggggctcttcatgaagggttcagtctacaagagatgctatgtagcattttggatggcatagttaggtgatatattgggcactgatgctaccaaccttgagacaatctttgtgtgaccaagaattaagattgtctcattcatatggtgtccctaacctaacacccttaggagttggatcttagctttagttttctttttgtgatctgtccacctagaaaagaatcgttactcatgtaaacacaaaatgaatgctacagtatttttttcccctgctcagccaagttcgttgttttgttcagataactgaagcgtttgcagcgactaaaggtatgccaccttctaatatcagaaccatatccatctgaattctgttaaattgtcaccaactgaaaccaggcttaccattttctgtcgatattgtctagtctttgatgacaactaaaatgaaatggggtatcctcaaaagaaatataaattgtgaacccaaagtagttggtttctacttcacctgaattctacttcatctgaataggctattttaatgaagagaaaatccaagaaatgccatttacaaacacccaaatccaagaaatgctatcgacgagtacgagttccataaaatgctattgtagaagcgattttgtcccagaaatcagttgccatctagttaaaacattctcacataaacaagcaatataaaatactattgccaagatatatccaatactttgcatctctaaagcttctagttattgacaactaatttcttttccagtcaatacaaataagccatctatcaaagatttgagaaattgcagggcacaattctacagaaaattaaagaacatcacttgaaaaggaagattttttctatagaacttatcctttgtgatgtaacaacaaatactcgaatgaattgagaaataaccaatgtcaacactgaaacaagtctgaaaccaagatcagaagagcatgaaaatagtgctcttatggattgaccttgattcttgcccacactcttattacaaccttcgagcaaaccggagcatttgctgaataaatctctcatctgttactgaagatactaggtaactaaataaacaatcaatcaagagtatcaaaacctacaggcttttgttactgtcagcatccaatgtaagtctgaagagagctctcattgcctgcctcttcactaccctgccataggtagccctcccaatcctcaccaccttgtcttccacctcgagccgattgccgcagccgttgccattgtcggcacccctcagcattgccctcagcacgctctcgttcccgccgattgcgccggcgacgctctctgcgacggcggcctcaccggggacgcgcctcccccacttcctcaccagcttgtcggagtcgaacagcgcggagtacgcgctccagaacgacgcgcgcaagaacgccttcctcctctccttcaccatggactttctcatcctctcctccagcctcaccaccagtgctcccatgtctcctcctcggccattgaccaattcgttctcaagttttgtgagttcttgcccaacaatggcgtcgctggcttcgaacctgcaccgatcgcattggcattcgaggccccacgctctcgctgcctccctgcgcttgctcgccggggtgagcacgtcgaagtaggcgaatgtgatctcctccccggctttgatgtcccttgacgcgtggacaatggcgtggtcgccgacgtgggtgcgccgggcgttggggtggcacgagtggttgatgaacgccggcaagatccacagcccgacgccgcagttgacgacgccattgctgccgagcagattggcggatggcgctgcgtcctcggtcaagcaattgacgtcgagcactttcaagatcttgtccacatcaagagatgccttcggcgccatggccgtgccgtcatcgagctcctccgtttcttgcttgaaatgtgccatgtccgggatggggagctcgtcttctggctcctcgccggtggagagagtgtagatgagagatgccgtcctcgggcacttctcggcggcgtcgagcaccttgtcgacgaggtccttccacaccaccatcttctcgccgctatcggcggcgtccggaattactccccttccgatcgccaccgccttggagatcaccaggttagctcccgcctcgatgttcttcaccgcgaacacccctcggccgccgtgcgcggaccggcgcacctccaccgccccgacgtgctccgcgaggtctgggcacttcccggagaacccggcgagcacccactccgacagatccaccgcgccgctcctcgcctgcgcgtccaggcgcttacactgctcgaccatctcccggacctcgtcggtgccgctcacggcgagcgccgcgcggaagcactcggcggcgcgcgagtaccggccgaggccgcgcaggacggcgcccttggacagcaacgccccggggtgcgccgggtcggccgccagcgcggcgtcgcagtcggcgagcgcgccgggggcgtcgccgaggcgggcgcgggcgtcggcgcggtgggcgagggtggagcagaggacgcggcggtctttgcaggcggcggcggcgtcgaacgcctcgatgatgagggagcacacggcgatgtactccgtccagttctccttgagcagcagctgcgtcgcgcggctgcgcagctgctgcagcgagtcgtcgtcgaggccgggcgtcgccatggctgggcggcggcgtgagatttggctggggagtggtggtggtgcgccgcggggcggcaatgtcggaggtgtttgtttggctcggtttcgaaagctcgcggctttacagcgtaacggtcggatctgatttctgaatagtttttcgaacgaaacaattctgaattttttaaactcactggagtgaatgcagtagcaacggctatgagctgtcacacactcacagtagtactccgtaatatagacgtcataatggtcatcttgtaaaaaacaaatactccgtatgtaggttatattggagtgaaaaaatatgtattggtcatcttgtacaatgcaatggacttgtgctcggtagagaagaagtgatgaatgaaataaatctagggcttgagaccgggtgactctctctctctcgaaccctccctcgcctgctacagtaaaattcccctttctcgacccctcttcctcctcgattccggcggccttgtcgccggtgacgggagggagaggggtcgtccccctcccctagtttagtatagtagtcgggctagtctcgttaggtcgggtttttcccgtttctcgtttctatggcgatggaagttgaagacggtggcggtggcgcgattgaggccggtgacggtggaggcgacaaggttggcgacggcggcggcgcggatccggttcgcggcggcggcggcggcgcggatccagtctgcggcgacggcggtggcgcggaccagctccgcggcaacggcggcggctcgaacgcggcccgtggtgacggcggcgcggatccagtccgcggcagcgccggcggctcggacgctgcccgtggcgacggcggcggcgcggatccagtccgcggcagcgccggcggctcggacgctgcccgtggcgacggcggcggcgcggatccagtccgcggcagcgccggcggctcggacgctgcccgtggcgacggcggtggcgcggatcctgtccgcggcggcgccggcggctcggacgctgcctgtggcgtctgcggcggcgcggatccagtccgcagcggcggcagcggctcggtcgcggcccgtggtgacggcggcgtcgccgatccagtctgtagcggcggcgatggtgcggacgtggcctgcggcgacagtggcggcgcgagggctgtctcccacgtcgttgcttccagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgttgggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgttctgatgttaggttatttcaggaaggttgctttcgtagttcagttaactctcctttcttaaggatggctcttttgcttggatatgtaatggggtttattccctagatctgttcctgcttaataaagttgatgtgttttcaaaaaaaaaaaaataataaatctagggactattgcggtttgcttgggaatggcaaagtatgaatatataaacttattactataaaatcaaaagaaaatgatttataagattttatacaaccttacatacaagtagtagtaaccaggaagaaaaataggagaacatcaaggggtaatatttttcaatacagtcattttgccttcacagttcatgtaatattccccctggcctttgattttccatttaccattgatgagtaatggtaataaaaacgcatagaccagactgcattttgccaaatcttactttgaatttgcaggaacctaggcactcacagttcagagagtttctgagctttggctttgtgttaatgaattgctgtttttcctatatttgaaaagggagctgctatataccggtatcccgttgggatactgtcccaacgggatcgctccctgtccacctccctcagacgctagagaacgaaggtcactatgggagcagcgtagatgaggttgacgtcggcggcgcggacgcggctgccggcgacgagctctagcgtggaggacgcggccaccggcgagctccggcatggagctggtcgcatggacggcggaggatcctgcgtggtgacagagacggcgccggcgacgagctccggcgtggggcgtggacggcggaggatcctgcgtggtgatggcggtggcaccggcgacgagcttcggcgtggaggacgcagccaccggctgaggcgtggacgatggacgtggtcgccggtgtcgaggtcccggcggaggacgcggtcgccggcgacgagctctgatgtggaccatggacgggggaggatgcggctgccggcaacgaggttcgggttcagtgtggagcgtggacgggggaggacgcggccgtcggcgacgatacctcgacgcccaactcctgtatctagtaggtatcatatgatacctcgcaagtatcaccccgatacatcgtagaaatcacgcgatacctgataggtatcacatgatacctcgcgagtatcgcctgatacatgataggaatcgtctgatacctgatacgcggtagaatcacatgatacctggtaggtatcactcgataccggctaggtatcaggacctgatacctcgcaagtatcacgctctacgtggtaagaatcgcatgatacttgataggtatcatctgatatctcgcaagtaatcacctgatacgtggtaagaatcgcatgatacctgataggtatcatctgatacctcataagtatgatacgtggtaggaatcgcctgatacttgatggttatacctgatgcatgttaggatacttgcgaggtatcaggtatctataaggtattaggcgattcctatcacgtattatgtgatacttgtaaggtatcaggtgatacctgtaaggtatcatacgattcttaccacatataggtaatacttacgaggtatcaagtgatacctgtgaggtatcaagtgatacttgagtatggtcatgttaaacctaggaggtatcatgtcccccttagtatcatgttcagtctcaccaggtttcataagtgatactttggaaggatcatgtgatacctgggaggtatcatgatcctcatttgtatcatgtctgctatcatcaggtttcacagatgataccctaggaggatctgcacgaccctacttaggtatcatgtctggtaacacaatcgtatgaatttcatagatgatactttagtaggatcgtatgatacctgtgaagtatcacatgatcctacccaggtatcatgatacatgatcctcaaaagtatcattatgtgtgatacttgtgaagtatcacatgatcctatctagtatcatgtctagtacagtggtttcatgcaagtttcacagatgatacttgagtaggatcatgtgaaacctgggaggtataaggaggtaggatcaattggagtataaggagtacatcatcctcctgaggccgcggccggacgccgccaccgtcggcatggacgatgacgacacgtagcagagatagtacttacccttcctccccggcaacaccatcgccgacggcaagccgtggctggtctgctcgtacaatcacgccgttgacggcttcaccgctgtcgccgtgtcaaagaagcccagctccgacgctgcttccaggacggcatcgcttgcttgtattgctggtttaagcaggaaggaggatgtcaaccttgcggatccggccatggcgatgacgcgctgcgcgcagcggcgagagcacccgaggcggagctgctgcggatgcgccggggtagcggcgacggcgacgcgccgcctgcgcggtggaggtcagcgaggtaggaggacgcgagggacgacgtcgccgccattctctctccaagccaatcccttcgtctcgcgctgcagcggtggatgacgcggtggacgaaaggggatcctgtcccgttccgatgggatcccgttgtttagcattcctttccgtattgaggttcgaagacgtatagttgcactctccgctttcaggttccagtctcgcgccatcctatccacccgattaaaactggacggtcagatcagcaagtccttccgctctctagccttgcactcccgccctaacccttcttccccgtaaccccacgggaaggcgatccatggcggcggcggcgggttggctccggcgagcggcagcggcggcggcggcgcctcgcctgccttcaggccttcctatactacctactccccctccagcccctctcacagaggcccaatcgttcgtgctcccgggcataggcaccgccgtcgccggcggcatggacctcatggccgttcccaagaaaaaggtatcctagcttctccccccactgtatctcgtggtttttggtttgttaccttcatagtcatggtctggtcgtgggtcgatggtgcggtatggcgcaccactgcaccgtgcccggtggagtgcactctaggtgttcgtcggattgcctggagagtagaaaggtattatgacctatggaataatggaaatgtcctaacggtggaacacggggtgatagtgcacacagaagattgcctctttttttctcgatccattgcttggtaggttagtgatagatgttttgtgttttgagcccattccatttggagcataatgtcagcgaggtgtggtcttaggggtatgcttgtttaagctatctttgcaactatggcaaacaatatagttctcatgaaattcagttccacttataactgtgacgaaggctgagtttgttctttcaatgtctaaaaagctctttaattgtagagtgtatactgaaagatgttgccaagactagtggtaagttttcacttttgtttgtaattagcaatgcacaagttgtttgttatgtgagtggatttggcagatgagtcaatacatgtgtaactcatcatgatgatatgcaaatgtgataactcaggaaaaatcagaaaacaaagataaccgagcaagtagtcagaaaatgtctggttaaaggcataaatttcttgtcacatttgatatttgagcatttgcagttatctatatgtaaatagtgatagtcttgcggtgagatcaactaattctaactactagcatagttacttttgaatatgtactttttatgtgctctgttgaagcatgtgcttcatctcattgcctcagcagcttcagctgctttttgagatttgagaattattatttgtttgtttcatgttccatgattgttgcttcttgaatgttgcaggtctcaaaatacaagaagggtttgaggaatggaccgaaagcattgaagccggttccagtgattgtccgttgcaggtaaatttgaagctgaaaacaacatgcttgttagttattctgatttgttctgctatgtctaaagacaacttagtattagtaaatatcatttttttatgtaacagcatactttattctgattgtttcactactcatgtggacaattattagactgttcagattgttgtctagcgataccctcactctttacaatctagaatgcaatagtatcaatagccaccaacttaggttttagtggagcccaaagtgcagacacagaaaacatgctatgtgatctagcatcacaaatgctgtagaacaacattttggcgtgcatcagttcttcccagatgattcagaaattgcgcgactcatttcagtttccggatttgtcatcctttgctcattgttgttttttgttccatgaaatttatttacataattgttctggagtacctttccattgtgctgacgctgaaaattgttcatcttgaatggcatgttgcaaagtttatataacctggtatcctttttgtgcctgtcaggtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaacccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtattcacgaattatttttcgtttgccaatatgccgtttcgcttattccctggtagagccgaaaagtgtaacaatccagcagcacggacaggggcgaagctagcatcaaaataagaggggtgcactaccattgagaatctagaaaatttcagcacataactgcacattctagtatttttaagtccgaaattaggaatctggcacatagtatagtttcgccactgccgcacggaaggtgggcgaggaagactggaagagagatgccagttcgagatgcggatgctctttcattttcgtgccgtttccggtgcggtgcaggtgcaaaaatgctgcaaccacacgcgcgcagtggtggtgcgggtttggtagaggacgaaaccgcggtcgttggcttggccttggctggctcgcctcagagccgccaccaactaaccaaccaaaaactcctccccaacccaaaaacgcgacgaaattcgctggcccccacgctgcgatttatgtggaccggctgcggcttgggtgcagcagcgagcagataacgaggcgaagcggagccagatttccctctcctctcctctcctcctacgcgacgcctcctagccgccaccgcttcaccaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgccttctcctcgcccaggtagttacccccaccgttcgcttccgagattgcgcccccttcttcgctggtatgcgccgcggccgacccgatctttgcgagctctcgcgctgtgcgtattacgtccacatggttaggggtggttgggcttcggggtacctcccggattggacaaaactccattcctgaacgccggatagcatgtcagagtcaaaccttctgggactggatgggttcatgagctttgagctgccggcgcaggttgaacgagctagtattgatgctatttctcccaactgctctcaagctgcaccagttgacttgaggagttcatcaggacggcatttcttagaacctttactgttgctatgatgctatctgttatttgtgttttgtaagtgatgtatgtattgcctagtcatgataaaacatgacaacaaaaggtacaaatgctggttaaacttaaaatcacatgttgaggacttcactgctttcttaccttggttaagtgctgtgatcttaaggttctcattctgtttttcccttgatgctttgcaggaaagcattccgagtgagggcatcatccagggttgacaagttctcgaagaatgacatcatcgtgtccccttccattctttctgcaaacttttccaagcttggcgagcaggtctgtcaagattctaccctccatcaaaccaccatgacatggaaatatatgtaggaggatcatttaggctactatatattggaataatagatcgatatcatgagacaaagaataggttgataatatattgtgtgaataatattactaggtaaaagctgtggaggtggcaggatgtgactggattcatgttgatgtcatggatggacgttttgtgccaaatatcacaatcggacctttggttgttgatgctctgcggccagtcactgatcttccgttggatgtgcatctggtacttcttgagaagccttactgaaattttaggtatttatgtgctgtaatttttctttcacccttgctaatttggcgtttgttatcttatttattgcagatgattgtggaacctgagcaacgagttccagattttatcaaggcaggtgctgatattgttagcgttcactgtgagcaatcgtcaaccatccatctacaccgaacagtcaatcaggtaaagattggcatcttttactagttaatatttgagatagctcatcctcgctctttcagtcattcatgaattagcataccactgtagaagtgtggattcctctccaaattgaatcagtattttgttttatgagttttactggtatgtgaccgggaggaaactggactttcactagtctcctgtcaaaggatcatactgtaatatacttgtatactgtactttaggactacttaccaaattgtttcttggatcctttatatactagataatggttatcgtttgctccttgagctaaccatttccttgacatggtgatcgggactgcaataagttgatttcttacctgtctaattctagttgaacttgagatatactccatattcatttttggcagtaattgcgtttttattctaaggataaaaatctaaaagtgacatagtggtctcacattttttcagatcaaaagtcttggagcaaaggctggagttgttttgaatcctgcaacccctctcactgcgatagattatgtacttgatggtaagactattctcactccaatatttatagggtgttgacacgtgtgtaaatctattgatggattgatgtccaaattctacttggtagtcgtatgaattttgttattattttcaatgtatcaatcctaatattagttgttaagtgtgatgggttgatgttgaaggagcacacatgacatgtttagattatgtttgtaattttgtgaattagacaagtcactcctgttatttagttacctattgcagtttttataagcatagccataatgcaattttagttaagagtcaaaactgtgctatttctggtgaaaatttgatgagtattgactgcattccaatcttgactttcttgactatcctgcctgtagtcacttcgtttccttggattaagcataattattaacagcactcacagtagaaatttacatgtctttctcatcgtacgacactattatttctttagttcatcaatagcccaacaggcatatactccgacaactgacaagctactacatttgtctgcgcagttgttgatctagtattgattatgtcggtgaatcctgggtttggtgggcagagctttattgaaagccaagtgaagaagattgcagagttgagaagattatgtgcagagaaggtatatcctcatttcctgcatgtattctcactgagccagtgctctaagcgtgcatttcattcttttaatagggagtaaacccttggattgaggttgatggtggagttggtcccaaaaacgcctacaaggtcacctgatttctagctttctgttactgttatttttttcactactgaataccaataacagttttggactagaattatggttcagttgggtgttaatttattgtttctttgaataacaggtcattgaagctggggccaacgccattgttgctggttcagccgttttcggggctccagactatgcagaaggcatggcttcttttcagtgacatacacattcaatcatcaaacactaagttcttaaacatgaatttctgacatagtttactaacagatagtaatatgcttatgtttttcctcttgcaattttgcagctatcaagggaatcaagaccagccaaaaacctgtggctgtaccagcatgaggatcctaaagtagtatgctgtgtacgttgtttttgtttaccagtaccgcggtttgtacagatatgtgccaagctgtacgttatattggagaaattgaaggaagaagaaaacgtggagggcgaccgtttttctcactgtccgcgaagatatactacatattctcagtgtcatgtgatactaccgtgctcacgaaattgttcataataaatatcgttctttagcaaatcctataatgatttacacttctagcatttgaaatttatccacaaatatatgcat

SEQ ID NO: 64093 - DNA, 3422 bp, Oryza sativa
ttaaacgatcaagatggactctgcctgctgtgctgctggcttcagtccactgcacgtcgccataataacttggctcggtgaggttacaacttgacttgacgctcaccttacactgattgcatccttggttcggctgcaaaatcttgaattggccaggcattcgtgtgggttagcataaaagtaatcctcttcttttggcttattttcaagtttctgccgacaggacggttgaactacacgatttctatgagtttcctggacagaagatgcaaaattgttccaagagattgtcttattgttgtacagatctataaatccaaccaatttctgtcggtctagtagcacacttctcctgaaacccaggaacctgaaatattgaaatgccaataaaaaactaatgaccacaacatatatctgattgcacgccaacttttggctacatgatcaaatcatactgaactgaacaagaagcttgattttcataaagaggaaatctggctgtgtccatacctccggtgaccttcaacaagttttgccatgttaccatcataagtaggaatgaaaatatcactggctgtggatacaatgaagtcaagtgcagccatctgagaagaatggttctggaattgtcgtagagcttccaagtctagcagcgtctcctttcttacctgaaagatattcaacactgtttatatagcgaagtgagtgaacatttaggcaatgaagtggtatcccaaaacatgtgaaacagtgttggcagacagatagggaaaaaaacacatgcattgaaatttatgaaaactgtactacaattattaccagttaccataacacatggaaaaggcaaaaaaaattggcagcattttgactacaatattgcacttacaagttttggaaatgcagcttgtaatggttctaatcttttttctcccccataaatttcaccggcagcaatgtatatgagagtgtccttctgaaatcccagagctttcagaataaaagatgtctcctcaggtgtaagtgggcatagcccttgcaatctcttagcttgtgaatcaatttccttttctctccaccatggataagcatatctgtttgagagaaaaagttggcctcagttgcttgtggcttgttgtacttttcttacacagaaaacattgagacacttatcttagagacatagacgtgcaattgtgtgtccatactcagcactcaagaataagatagcaattgactaatttgacaatattaagaataaatgagtatttttcctttttcatttcattgaaatgaatccaccataaaaaggagagaaaaactaggtatgaaaatgacgatttaatagactcagagtgatgttttataaactcaaataatcaccaaaaaggtaatacgagaatgttacatagaattgtagaagactgttacacatagtatctatgacatgaacaatcatttctagacgagttaagggggtatagataacatcattaaactattacccctttcattttaaatagatgttgttttgaattgtgtgtagtcaatgacattagtaggtacataggcgaaggaaaaaaggtccaaatcgtcatagctctaatatttttagtgaatatatgactagaaaaagtaatggtcaaaggtgcatattcgaaccatgcaaatgtcctataaacgacataagaaaaaatacaaaaccatggagagtgagagagtgtgtgttttggttgaatagggggatggtgtttgcctcctactacaacaaacgacataagaaaaaacggagggagcaatggagtgtggtatttcctcttatatgcaaggaactacttgggtcaatatctgaaaggctacattttggtatttattaatatatatataagagcacaagatggcttttgacctcattcttttgagctcttcagcttcttcttgagaaagaccatgattgcaaccagaaaaggccagcatgtccatctcatagcgtaaatgcaaggctgcaaatgatcccttggcctgaagtttctgcaccagtttattccccaaggcctcaatttgaggggtgaacttcagtgcatgaaaattaacacggcacctaagtagttgaagctgtgtactgataccattgtttgctaaccgagcatccgtcttgttaaaatggatgacgctatatttgctgaataatggtaagatctgcatagataagataccatgaagagtatataatatatagtaagcatgtgtcaagcaagatatatgtacaaacctgatgcaagtaatatttttcatcagaccagctcacaggtggcatattaagtatattgtttgaatcctctggaccaaacctcttcggaagctgtttaacaatgtgcacttcatctcttaatgtgtcaatgaaatgtttaacatcaaatatatcttcaaaattgctgcaaagtattgcaaaaatatcgcacatttcagatattaacatggtaggtccggtacataacctatcctacaaaatgaaaaatacctttgatcagcccagaatgacctcttgtctagttctgggacaaccattgtaaggtttagcaagcgagcaaccgccaccatgtcacatatctggaatatatggtttcaaaataacagaagtataaaaaagtgagagacaatataatactgagcagcaaaactaactcaagtaaaaaaaaaaacaactgacctctgaacgcatctgattcaaacccccattgcaagataccttcagataaccattactcttatagactcctaaaaacaaaaaaatcaagttaaaactgatatgcccaagtgatgattaatgctgcttcttaagtaaacattcaaaaaaatgaggatgtcaatcagctagtgcatccatttatgttctgccgtgacttctagagtgaaaaccatttttctcatcaatcgcaactgtacttgaagcagccgcttctacaacttcactaacttactatcgatttgggaaagggcaataacaagttcatccacatttgaatccaatacactttcatttgtacaattctactcatccctacagaatgccaccaaatccatacacatcaaaattcaaaactgaacaaaacttaaatcaaactccgcgaagaaataactaaacaaataaacaaataaataagacacggaggagatcacgcacttcgaggcggaagcgcggtgggcggaggcgagggctccgcgtcgccggcgaggccgaacaaggcgaggaggcgtccgacggccacgagctgcccgacgaaggcccacagcagcacggcgctgcaccccgccaggagccaaaccctaggcctcgacctcgccatcgctcccccaccctacatccaccgccccctcctcctcctcctcctcctgatccccgccaccggcattggcagccgcgg

SEQ ID NO: 64094 - DNA, 8306 bp, Oryza sativa
  unsure (1)..(8306): unsure at all n locations
gggttgggggcgagagcgtgtgtgcgcgccgccgccgtttgtgtgttggctttggtttttggtaaaggatctgcttgtctagttgtctttcgtacgagcggcggcgattagtccagtggtggtcaggaggaatccacacatgagacattccagacatctttagggtccagcatgtttatttgtttagtggagttgaataaaaggtcatatttggcattgccacttggagtattaaatctatggactctttgaaacacagtattgtcaaaacaaaatagaagaaataatacatgattgaaatgccctggcaatttaaattctatggattgtgaacatgtagaaaaactacataaatgattgtttcgatggagaaggaaaaacacaagaattataagagatataaacaaaggaaaggaattgtgttttcaaataagttgaacctcatgtcaaaatttttatgttttgagccaatcttaaagaatttcataagatatttggatgcctattttttttgactcaaaggatcgcaaaggaaagttttccactgaattgagttccttcaaattttcttcaaaaaactttgtcccaaaggagtactgtttaagtgaatagtactataaggtaatgtagtagcatggtgagaagtgtaaggatttatgagccgagacagcgggcaacaatagctaatgaaacacatctaagagcgaatgaaaatggagcacactcggtttgttgcactataattacgtcgcaactaactactaaaggaaacaacacagtcgctgtcgagcacaacaggaagcctagctgcagcaaatgcagtcgagcgcctgtgaaaaaagaacattatagagtatttacttaaccgctgtgattgctattggagaacaaggaaaaggagactcaggcatgagaaaagaaactgatagatgcgttagacgttagttctttagactttggtaaagaaagtgtaaggggtttacaagatttaaagagtactgattagatctagatttggtagcctcaaatataaatatttttttcttatttgatttgagataatcatactgtcaaactttccaaattccgagcaatttaatatttgaaattagctagatttgtgttacgaagactatatcgttggatttatattatgacattacaactttattgccaatttttaatatgacacttaaaaaacaatgatccaagggtaagttttatggtggaggtggatgtcacatccaatttagaccatgttatcttctcattaattaagaggtaacacatacttcctccggtttcattttaattgacgttttggacaataacacggtctacaaaatatatgtttgaccttatttttctattataatatatataataaataaatgcatgtttacttttattatagtgttttgaaaaaccaatctatatatgttgttctaatttctttaaactaagtatttttaaagttattgatggtcaaagttataaaagtgtgaccataagcttatctaaaacgtcaattaaaatgaaaccggatggagtacaatatatcacatttaatacacaaactctaatattagtccattaattaagaggtaacacatacaatatatcacatttaatacacaaactctaatattagtccactctcacatcatcttgcacttttcttggagattgtgtagaggttgccccttgcatgaggggtggctcattctctctctctcctaactactctcctccatctcatcatctaatcatatgtggcaaatttaggggtaatatgtacgggcttagggcaacagcaatgtatgtggtccaagcaatctatatgggtgggccttttggttgatccttttgttctctccacatgtactctaaggtgaaagatttctgctgtgcttgattcttgtaccatgtatgggctttctccataatcatgtcttcaaagtactcactagtacatgtatttctgacttgagcataagccccacagaactttgcaatatccctcttgacattatcccagtgtgtcttcatttgcttgactgtccttgtatgtgcatttctaggcatattgctgttgaactcatcagctacatccttccagtaatactctgacttcttatcatttccatctacagaatcaactgagttgttcaaccaagcgctaacaaaccgcaagttttcttcttccttccaattggtgcgtggcgctctcctcactccctcttcgctgctatcactcaactcttcgatgttaagtggctgcttctcttgctgtcttgtagttgtagggcaaggaatggatgactccgacccatgggaagaagtgttggcagcaacttcaactgaggtgactttgatgtggtgcaaagagtactctgttgcttgcagctccaaacacttgatttggtgagttagcttgtatccaatttccttgacgttgagtagcttgaaagcttggaggagaataaccatatggtgggtagttgcctggggcaccaaatgggtagaaattatgtaagaaatttgggttgaagctttgggaaaactgagatgggagaaaacggttggggaattgttggggaggagagttgtagtgcctagaattttctaggcttggagattcttgatttaggagatttttgaaacttctgttggatgaatccatgatgaaatgaggaggtgtactatgaagctctgtctattttgtttttataggcaacatggagctcaagctgtcgagcaagttttgtagccaacatagagctcaaggcaacggtaacttcaacgtccaaccttcaaccagcatatatctgctgcagggtcatggatcaactgcttttgtttttatattcatttccaaacagtgaactcaaaaagtaatatattgtattctcttgtgggcaaacccatagccatatggactactttagccattaatgctttaaaggccacatctacattgtatagaggcagcccatataggtgtttttattgtataatgcccgcttttgattgatattgtggatgccctttcttatagtacttgccctagcccctaagttgtgtcttagattttaaaaaacatggaagaaaaaggagttgaagtggtatattcactaatagaaaaactcaaatgccactaggctcctcatttcggcgactaaactttgggtgtgtttagttcacgctaaaattggaagtttggttgaaattggaacgatgtgacggaaaagttggaagtttgtgtgtgtagaaaagttttaatatgatggaaaagttagaagtttgaagaaataagaatgtgtaaaactttgcagttttggtttataaagtttcagcatgaaattctgaatgtgtgatgctaaccgcctaacttaaccatttgtgtggaatttttcagcgattgttcagcacttcatcagctccgacagttcaaagctctgaaccgatggagcgcagccagactccgcgatgacgccgccgtcgccgtcgatctcgccaggtgatctcgtatccttcgccggcaagtgctcgacgaagcgcaagctccgcctcctccacggcgccctcctccgccgccgccacctcctcccgaccgccgacgccgtcgcggcactcgccaagctcctccgcttcgccgccgtctcccccgccggcgacctccgccatgccgccgcgttgctctccctccacctcccgttcctctcctcggcctcctcccacctcgccttcttctacaacaccctcatgcgcggcctcgccgcgtcctcctcgcccgccgccgccatcgagctcttctccgcgatgcgccgcgcgggcgccgcccccgacgccttcaccttcacgttcgccctcaagtcttgctcgcgatgcgtgtctcagcggcggttgccttccgacctccacgcccaggcgatcaaacacggctgccttggcgcgggcagctctcacgtgcatgtccacaacgcgctgctccatggctactcgtctcgggctgctgttggggacgcacgcagggtgttcgacgaaatgcctgctcgggatgtgatctccttctcagggctgctgactcttcacctcaaggccaacgatttggatgccgcacgcgtggtgtttgatcagatgcctcaccgggatgttgtttcttggactgccatgatatccgcgtatgccagggcacgacgtccgcaggaggccttggcattgtttgatgcaatgccggtgcagccagatgaagtgaccatgctgagcgttgtgtcagcatgcactgcactcggggaccttgcaactggggagcgtgtgtgtcagtatgttgattccaatggcttcgggtggatggtgtcactccgtaatgcactcatggacatgtatgccaagtgtgggagcctcactgaagcacgtaatttgtttgatggcatgaccgtgaggagcttggcatcttggaatacatttatctcggcatatgcatcgcatggtgatgtggagagcacagttgctttgtttcatcggatgctggctgatggcaaatctgtgaagcctgatgggacgacactgcttgcagttctcaccgcatatgcacacaagggctttgttgaggaggggcgtgccatgttcaatgcaatcttgagtggcaactatggtaaagtggacctcaccattgagcactatggatgcatggtggatttgcttggtcgggctgggcaacttgaggaagcatacaaaatgatagaacaaatgccaattccaagcaatagtgtggtctggggtgctttgcttggtgcatgccggacacatggggatatcaacatggcagagcgggcggtccagaagctaaggagcctgaacccggaggagggtgggtactacattttgctcagcgacatgtacgctgcttctggacgaacaacagaggccatggagatcagacggatcatgaatcaggccggggcccgaaaaactgcaggccagagcagctggagcacaccctgtctgcctcagccgtaatttttcctaggctgcatttcacctgcttttgccctttggatcactagcataatcaggtattgtctcttactgcaggccccctgtttgatgaactgtgaaagtgtgaatcctgaatctgaactgtacaggtgctgtatgctaatgtgctatacttgctatcctacaaaagtgggccagaaacgcaacaatcattgtggagggaattgttttttgaacaaattttggaggggaaagatttcatcatggctctttaagaattcagctccccatgtatgctatcaacttatcctttcaaagttcatatggcaaatttgagtcagtgggtatttatttgcagttgagttattgggacagtggcctgagcatgtagtagcagtctatgtgacagttctctccacaattgccaattccttgggtcgacagtacttagtactacttagcgtcttggttatgtcaacatattatggtttggaaaaaggggttttctttggcactgtaggcatttcatcatatttttcatgtttacttgattctccgaaatattcttacctgaattccttgcggtagattttcagcttaatttggtaacatgtcaattatgcaatctcttagattcaaacttgtcagtctgtcacctctggagacagcatagcagtcatttcatgttacataggactacaacaccacatggggctgatgtcttattatctgtcaaaatccattataatgaatttcattaaattacagttgtcattatttgagttttattaccattttctgcataaaatcatccagggaacctttacaccttttctgaacataggaaaacttgcacttgtactatggaatgcaaagctttgaaaaactgttacatgtaaacctttttctgttctatggggattgtactgacgttttgtagcattgtgatatccacttaaaaccagtataatatttagcaatgtgcacggttgtaaatcttctttgaatggatttttctattcaagttcattctttggaattaactggtcttactgttcaagtgaatttgctactcaccattgttctcactctgtcactgatgtagtaaaacatgttgttcgattaccaaggcctacacttagaatggacaaaataaaaccgcttgctcatatgagtatatataccagtcctctctgttctttgtaaaatctgagtgttaattgggactccatattgcatattatcaattgatcactatattgagtatattcttgttgagctgcttttgtgtcttggcagactcttcatacgttgcatgataatgtgcacaagggcgcttatattggcatattgataggagctctggtacaggatcagcatgttgaagctgaaccagacggctcggtccagagaatcagttgttgatgaagctgtgcccacggccacggctcaaaacaggtatgagaagttcagcttcagcacagtatgctaacttacctcctgcctggacagtaatcaatacatgaataaatatgcacaattaacgagagagaagaaaaggtttgaatcatgtcgagagtgaagaagtattgttccatagcagattctgactcgatatcttctgtgaaacttgaattaacttgcatgctctccaagaaactgatgcatcacagtaacacacagccaccaattcacatgtttccagttcatttttcatcaaatacacactattactatcctatctacagaaaggcatctctatctctaacaatttgctgctgctatcttggcaggaacccgtactgcgagaccggaacctcgaacgccatcatcttctcccctcgagcaaacccgttgcggtcgtaggacgagatctcggtgatgtccagctccttgcacgccctgatgagctcctccccgaccctcccagctgcctcctgtcacaacaagccagccagctcaagatatcaatacaaatgagcagtttatgtctaattactaggtgaaattcttggaggcgtcgtttagaagtcctattcctttagggtgttgtgtgcttattttgttttaagtagtaggatcagacgtagacgcgtggtgtggttgtatattttctttttcctgtctatagtctcccaggactgtaggcttgtattttattccttcaatagaaacatcgcactatcttgtgcgggttgtttcaaagaaattcgtggaggaacggagtgggcggcgtaccacggcgccgcagggcgggtcgccgcagatggccttctgcagcgtgctgccgtagaagaggatcttcctgttgtggtcgtcgacgagcatggcgtagagctgcctgttggagcagaacacggacagcctcggcttcgtcgccgtgccattgaactgcagcgccggcggcaagaaccggtacatgttagcagaagggcaattggtttgtgctgcatggtgagccagatcggaacgagccgtaccttcttctgcagcctgcggttcctgaccttggggttctccttcctcgcgccgtgcctcgccgtggcctcgatcctcgggtacgagcgccggcgcccgactccgccggcgccgcctgcagaagccggagtgaagaactgcacgccaggcgagctgggagggcggcagcacgccgggcgcggcgagaatggcagcccgggggccgcgcggagcgatgccatggcacgcccacgggtggagaccttggctagctgcttggggtgggcaggcaatccgtcgagcaggtgcggcgcggaatcccggtgggagctgctacagtgcccgagattaggatttaggaatgggatttgtcctcacttctggggccccacctgtcacctgacaggtaatacaaggcttaagcaagggtgtaatcgcaaaattccccctcgagtttattctttccgtatccattttgtgctctcatctcaccatctaaacctcgattaatttcaaacccccgtcaaaaactactcacgtagtacaactacaagccaacccgcnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64095 - DNA, 12761 bp, Oryza sativa
  unsure (1)..(12761): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttaatcctaatgcaatacttcaggcactggcaacccgctgctcctagatgtcgctctactatgtacccggactgggaggacttaagtgatctcgagggctgtcaccacctctacacctacctcaacgtactgtggaatatgcagcaattactggataataattacctaaataccacatctaagtaattaatatctactttagtgtttataactcaccaaagcaatcactatattttagttgattataatgaacaataatctcgtatgctatttaggaactaaccaagagataattctcacaagataaatctaaattactcaggaagaatattacattgaattcagagtaataaacagaataaaaaaataggagaagattactgacaactccaggattcttccgacttcttctactctactctcttcctattctaatatacaatatagtacaatagagcctcttataatttagctcaagcttggaagtgtgggagtgaagggagggagtgatgtccttttatagggcagttatgacggttgtgagaaggagaaatgtccgaactgcctcgcaaccgtcactgggagagcatctggagcgtccacaccaaaccccaggatcaacggtgatcaggggcgtttggccgaacctgggctgggccctcctggcctggccttcagttggtggactccctggactctcctctatccatttctcatagttttgggctgatttactgatgttttgatgaaattcacatcccctccttgtatggatacataattctcctcactttagtctaatttcctcccatcttcaaggtttatcatctgcatacaaatagacaccatcacttgtggaatatatgagattaagcacctatctctatgttgaatattttattatctggactttatgcagatgttggtggtatagaatcggcatttaacagccgccaacaatgtggcaatgagaacatagtggtatccatgaatgcacttcaagaatgagccagataagcaaaggacattcctgagttcgtgatgcatatagcaggatgaaggtacttctttgtatctgttaacaacagaattttgcatgagatttggagaagaaggaagaagatcgaagcggatttggtataaggtcgagttgatttccatgtcggactgcgcattggctgagtaccgtatcggctaaaaactggacaaaggcttgacttgccgatatggcaagtcgccaatatggcataacttgggctcggcatgggcctagacaggataaccgcattgccaatcagagatagagctcatgtaaggcaattatatctattaattaggttagttatgtcggtttgttagatattttgtaagagaccgccgtatatggtcttgtttgtatcttatctttagaaaggtttgagtcgtgtctataatggactaagtttgtactcggggtataaatatgaaacccttaacattgtaatatgggagacaatccaataaaacttcctcgcatcgccacccttttcgcttttacttttcaacgagttcacttcacaacaagtaacccgtctcgatggcttgtgctatcggggctattatgtcattttatccttgtatcatgaccattgttatcttatgtctttgttaatctagtcttagcatatcgatttagctctatcgactgcttctcgttttaaagtttctgccggtatcggctaaatcgtcttgctagattagattagcttagacatccaccaccctaaaaattcagtcaatgggttgactgtttagatatcgtgtttcttttcatacttagtgctgcatcagtacattcgacttactaaatcatgtttagaacaataatctctagcctgcttcttgattgttaataggggtagcatcggggtttcagccgatcttacctaatatacatgcttctttacctgtttcatgtatatttgccatctctatagacagatcatctaatattaatatattaagtctaggtcatattggctaggctatcattattgactattgacctctatttggtatattactatagattgatttgcttatatatttttgctctaaatattgttccatcgactactttcataatattgtcttaaacttctttattaaatctgatagacagtattacagctgatgaggcatgtttaggtttaatattcactgatatatccagtccatagccgatttggtctagctaactgcattggctgagaccaccaatgataagctatcggtcgatcggctatcgactgactaactctgcttttgtctttcttgctgattgtaggattaaatctactggcacacccttggtacactcgagcctaggcttagacctacactagagttaagcagatctcctagtgtggagattatggataccccatacctacacggcatgtatagtccgactgggtatggggtaccatgtttagatagaatatctttaagaggactcgggttaggttctaaacttgcatatcaaggaaatatctgagatcctagtcggttacgattgtattttatctgtaactacatattccgttaaggatatggactgtattttgtaataaggaccccttcccctatataaggaggggtccgggtgcctctaggggcacgattttctcccagatcatacgatcaataatacactcggcggattaatcctcggacaggagtagggtattacttcttgattaagaaggcctgaacctgtataaaattccttgtctctaaacccatccacttttccaacttgatagccaccccttttagtattgctgaaatcttgtttcgacagttggcgcgctaggtaggagtagcgtcaagttcttcgccgattggtgcgatgggttccgtcttcggcatcgacgacttcgtcttccctcccgggcaagtgttccggttcggcaacctagacttcatcaccaacgacttcggcaagatttctctcctcgactcagattcgaaccagtcgggaagaggccagatctccgccccgttcggtatcccgaactcggccgaggtctaccccaaggtcatctccgccgagttggtttcaaaccactcggacaagatccaatctactccaacacgaccagatcaagacgatggggcctatccgccaatcttgatgaaactccccgacgatttggctgctgtcttcactacaagggcgtcttctccccgtaggcctaggcgggatccggcttcagccccggtccggcctagctccagcgaagtcggcatcatactccagccactcggcacagtttcgacggaccaactggacggctaccttagctcccccggcgtcgagtcacgaccaaccgagaacgtagagtacgatgacttcggctatcgctacgacaaccgcaacctcgacgacttcgacgagggctttgaagataactacacccctctctacctcggtgttttcatggctgacaacgagacggaagaacagcgccaagcccgagaagcagaagggcgacatgtacaacaggaagccgaacgacgccgattagaagaggagcgctaggcacaatagcgagaacggctgcagcgtgagcaacaggaacgcgaacgggctgcaaaggaggctgaggaccgacgacaatgaggcttggatgccaggcgacgagcgcgagaacttatcgggcagcaagacgtcgagggaacagcagtctttcgcacccctcaacaaaacgcggttgcagcgatcactctcctcgacaccctcctcaaggaagacgcactcaaccatgctgatcacgtcatcaacatcttgaaccagactaagaccatgatcgccgcctcggtcctggttaactccgcaagcgtccgcacgccgactggcagccgagttccccatcttcgatctcaagattatcaccagccaagcctcagtatcgccggcgcgggatccaattgcaggagcaggggccacgaggagcgatctgtccactcgcctcccgaacgacacagggagcgccgagttgaacggccacgctccccacctcgcaggcgccccgtcgatcttcgtgatactatcaaccagcgccgcgcggcacgaggctacgccccccaccattcaccgaatcgctatgacgacgacgtggatggagtcgctgccttttcaagtgacctgcgtcgagtggattggccagctggcttcaagccgactagaatcaagaagtatgacggcaccaccaatccggagtcttggctcaccgtctacggtctcgcgattcgtgcagcaggacgagatagcaaagccatggcaaactacttgcctgtggctctagcggattctgcccgatcctggcttcatgggttaccccatggcacaatcggatcatgggcggaactttgcgaccacttcatcgccaacttccatggcacctttgaatgccctggcacacagtttgatctctacaacgtcattcagaagtctggagaatcccttcgagattatatccgacgcttttctgagcaatgcaacaagatctccgacattaccgatgatgtcatcattgctgctttcaccaagggaattcgtcacgaagatttagtcggcaagttcgggcgcaaaccgcccaggacggtcaagcagatgttcgaaaaagccaacgagtatgccaaagacgaagatgccattatcgcgtccaagcagtcgagcaccacttggaagccgaagaaagatacgccgactacgggagggagtggaagtaccaatcgcaaggaccgtaagcgtaagcccgaggaacttgttgcaactactacacattcctcccgacaacgttcgcgcgtcaacacttttgacaagatcatgaactcccaatgtccgcatcatcccaattccaatcacgcgaccaaagattgcttcgtctacaaacagattgcagaacaatacgccaagaacgcacgaaaggcctccgatggagatcaaagtgcatcgaaaaagaaggacgatgatgacgatgccccgacaggttttcaagaccatcgcaaggagctcaatcacatctttggcggacccttggcttatgaatctaagagaaaacaaaagctgaccgaacgggagatcaacgctgttcagcccgatacgccccaatatcttcggtggtcggagacaacaatcaagtttgaccgctcagatcatccagaccgagtggtccacccggggcggtaccccttggtactagacccagtggttcgtaatgtcaagcttcgcagatccctcatcgatggtggcagtgcactcaacatcctcttcgccaaaaccctagacgacatgcaaatccctcgcacagaattaaaaccgagtaatgcgccctttcacggagtcattccagggctatccgctatgccgctcggccagatcactcttccggttactttcggtactcgggagaacttccgcacagaaaacgtctgcttcgaagttgctgatttcgagaaaccgtatcatgccatacttggacgcccggcgttagccaagtttatggctgtcccgcactatacctatatgatgatgaagatgcctagtccgcgaggagtcatatccctgcggagcgacatcaaacaagctatcacatgcgacaaggaaagctgcgagatggcccaaacccgcgagatcacgatcgcccgagaagatatccgactggctgcaactacggcaagcgaaggagaagtgcctgcaaccaagatgccaaagagtggagaaagcgacgccaagaccaagaaaattcctctagatccctctgattctactaagaaagctgtaataggcgctgagttagattgtaaataggaaagcgtgctcatcacctttcttcaaaataataaagatatctttgcatggaaaccatctaatatgcctggtattcctagaaaggtgattgagcactctttacatgttaaggaagatgctaaaccaatcaagcaacgactccgccgcttcgcacaagataggaaggatgcgatcaaggaggaactgactaagctgttagcagcaggcttcatcaaggaagtccttcatcccgactggctggccaacccaatcctggttcggaagaaaatgggacaatggcgcatgtgtgttgactacaccgacctcaacaagttctgtcccaaagatccttttgggttgcctcgcatttaccaggtagttgactcaaccgccggctgcgagctactcagctttttggattgctactcaggttatcatcaaatccgactgcttaaagacttcattcatcacgcccttcggggcctattgctacatcaccatgcctttccgattaaagaatgcaggagcaacctatcaacgcatgatccagagatgtttttcaactcagatcggtcgcaacgttgaagcttatgtggatgatgtagtcgtcaagaccaagcagaagtatgatttgatcacggatctagaagaaacctttgcaagtatctgcgctttcaggattaaattaaaccctgacaagtgcatcttcggagtaccgtcagggaagctgcttggatttatggtctctcatagaggcatacaagccaacccggagaaaatcaatgccatcctcaacatgaaaccgccaagttcccagaaagatgttcaaaagctaactggttgcatggcggtgctcagccggtttgtttcacgactcggcaagcggggatgccctttttcaagctgttgaagaaaacagacaatttccagtggggacccgaagcccaaaaagcctttgaagacttcaagaaactcctcactactccaccagtcttagcttcaccgcatccgcaagagccgctgttgttatatgtatcgtcaacttcccaggtcgtaagcacagtcctggttgttgagcgtgaagaagaaggccatgttcaaaacgtccaacgaccaatctacttcgttagcgaggttttggctgactccaagacaagatatcctcaggttcaaaagctattatatagcgttttaattaccctcaggaaactatctcactatttccaaggtcactcggttacgttggtcacatcgttcccattcggcgatatacttcataatcgcgaagcaaatgggcggatcacaaaatgggccatagaattgatatccttggatatatcgttcaagccgcgaacttcgatcaagtcccaagctttagctgactttgtcgccgagtggaccgagtgccaagaagatatgcccgaggagaagatggagtattggaccatgcactttgatgggtcgaagaggctttctggcgctggggccggggttgttttaattttcccgactagagaaagactgagctacgtattgtggatacatttttctgcatctcacaacgtagcagaatacgaggcgcttcttcacggactaaggattgcaatctctttgggaattcagcgtctgatagttcgtggagattctcagttggtcgttaatcaagttatgaaagagtggtcctgccttgatgataacatgaccgctaatcggcaagaggtgcgcaagttgaaagacaaattcgatgggctcgaactcacccatgttcttcggcacaataacgaagcagctgacagactggctaattttggttcaaaacgagaagcagctccttctgacgtgtttgttgaacatctttacgaaccaaccgtaccaaggaaagaaacaatcgaagccacggacgctcaaaacgtaggtatgattgaagccgactagagagagcccctcataagatttttgaccaaacaagaactcccccaagataaagatgaagccgagcggatctccaggcgcagcaggctctatatcattcatgaaactgagctgtacaagaaaagtccatcaggaatcctgcaacgctgtgtatctttagaggaggggagacaattgttaaaggatatacattcaggcatctatggcaatcacgctgccgcacgaaccattgttggcaaggcttatcggcaaggttttttctggcccacagctgtgtccgatgccgacaagattgtacggacatgcgagggttgtcaatttttcgccagacaaactcatctacctgctcaagagttgcagaccatccagttgtcttggccgtttgcggtttgggggcttgacatggttggcccgtttaaaaaggcagtcggcggttatactcacctctttgtggctgttgacaaattctccatgtggattgaagctaaaccggtcatcacaatcacggcagacaaggctagagatttcttcatcaacattgttcatcggttcggggtacccaatcggatcattaccgataacggcactcaatttactggcggagtatttaaagacttttgtgaagacttcggcatcaagatttgttacgcctccgtagcacaccccatgagtaatggacaagttgaacgcaccaatggcatggtacttcaagggataaaagcgcgagtcttcgaccgactgcatccctatgccgacaagtgggtggaacagctgccatctgtactttggtccctgcgcaccactcccagtcgagccacgggccagtcaccgtttttcttagtctatggagcggaagcaatgttgcctagtgaggtggaatttgaatctttacgtttccgcaacttcagcgaggagcgctatggagaagaccgagtagatgatcttaaccgattggaaaaagcccgcgaagcagccctaattcagtcggcacggtacttgcaagggttgcgttgttatcataatcgcaacgttcgatcacgagcttttttagtcggtgacctggttctgagaaaaattcaaactacacgagataagcacaagttatcccccttataggaagtaccattcataatctccgaagtcactcggccaggttcctaccgacttaaacatgaagacggtactcctatcgacaattcttggaatattgaacatcttggtcgtttttatgcttagccattacctttgtatttccctattttgactgctaacatcaagttttcccttgagttatcagtcgggggctactataataataatggagtgtgatttttatcaattcaatttgcttacttgatttatcattgccttgcttgatttttttggcttagtcaatgagaattgaaagttttttaataacttttgtgggttttaggctcaataaggtttgacaaaagcttttaagaaattaggagctaagttcgaaatatcaagcacagcataaattcatcagtatagtacaaattgtgccgccatcatcttcatcatcagaatcattgttataatataacatcactcggtgtcagttttttcctcatcggaattatcagatccagtcggccgaaggtcgttgtcctggaatctctcaactacatcaactgctatcttatcggcggttttctgcgcatcgttgatgaggtcaagggcggcttcttcgctcgtcccgtctgcaaagccattaatggcgtcaatgtcgatcttcgggtataaagacttggtcattgccaacgccaggcttgcccccatactcccagcctctttgatattcgtaaagtatgtatccggagcaactctcagcttgtcgaagatttcggaagcatcaaatgtactcggaccattgttattaaagaacatggtttggacgagtagggtagcagtgttggcgacttcatccctagacccttcaagcctcttgattttgttgaccaagacatcgaattgagcttgagacttgattttgcgatctgcataaatagatttatatcaacaaatgggcacaagggaaggcatagtttctagggtattagtcaccagtaccttcgacgtctttcagagccgagtccctttgtctcgccaattcggccttgtcattctccagagcttggatccgtttttctaattcagatatcttagccacttgcactgcattgcttcttgttagttgatattgcaagaatggcagcataagtaagttggatagagattgtattcaccttttgacgaaccgctcatctcaaagttggagtcttgaagctcagcgattcggtcccgtagatcatgctcagtttttctggcaagctccttggcttcgtgcagctgattcctagtggcttcaagggttttgagatggggaaccaacctctcaagagttgcagtcttcgcttcgttcttgagatggattctctgcaatacgaatttgtttgtatttgagcaaagtagtaagcaggatagttgaagccgtgcataaggagacttacatttacgatgcgagtggcttggccgagtgccttttttagcaggcatacttcttcgtcttccttttgcttgtttattataattccctgaggttgcatgtcatcgtcccaccacttgactaaaatgggcgggcgagaatcctcagctgattgtatctggaggatctcctcttcgtcgctgattattgggccttgagcatccatgaataaaggtgaaacaattgaagaaggtctgtcagattaaaacggattttggagaatgtgttaacctgtaataatttctggtcaaggacgagcaggctcttgtactttgacaggagagctgggccctggatctgcactggcatcctttctgggagggctgttcgtttgagtttctacttcaggaatatctttacttggctctgtacccgactggtttccagtcgggggctcttgattagcatcggctccagcttgggccgactggttcccagtcgggggttcgttgctagcttctacattgtcggttgccggttgtttgtcacttgaacaatcctctgcagttggcccggtttcttttgaaggacctgtctccacgttagtcggctccgagtcttttccggaaggatctatatcagatggcttcctacaaatttgagttatgccatcattattatttcaatagtgagtgagcagcactacgaggaagatggtcaaatgattcgtacctggaagatttcctaatctttggcattggacgactggatgttttcttctaaggattggtttgccttggctgttttctagtcacctctttattgccagattttccagcatcatcgccttcatcattactcagaaccaatttcctcttgcgcgagtccaactggatggctgattttgagatgtttgattgagtatcagaccgaatttttggtccaccacttgcctgaccagtctgccggcaaggtgatcggcgttgggcaattggagggtctgatttcatcaaggcgaattcctgggcatgatgattcaagttttctatcaactttgcaggtgataaaagcatgcttagatataggctgggattttaaatacataccggttgagggggattgaaggcattgtatggcaccactggcagcaagtgcgaatagctgactacaattgcatttgagaagattttatacattctctccttcataaccttgaattcaagggattcaggatcttcacggttagggtcatgtttgccgtcgaattcaaaggctgtgcgagatctttctttgattggggccaaccggctcttgatgaaatgtcgggtgatttgttctccttgcagaccttgctcctttagcttcagcatacgatccatcagggcgagctcttgggcggcttcctctcccattggtagtgaattccaagtgtcctgataaactggaggaagacaggagtactcggggagtgccggctcgaggttttgtacataaaaccaatttgcatgccagcctttgtttgaagttttacagggcatggagaaatacttttggctcagagttcctctcagttggaatctagctcccccaactacgcatggcttgcttttgttcggctggggtttgaggaagaagatacgatggaatagggcgaaatttggcctgatgcctaaaaaagcttcacaggcgtgtatgaagttggcaatatgaactatggagtttgggtttaggttatgtaaactaatcccgtagaaatccaaaattccctggaataatcttgaggttggaagagaaaatccgccatagaagaaatgagaaaataccacgacttcatgggtatcaggggttggaaatgcttcgccgcacgccgcacgccgcccaatgatctccttcgccggaagaacgccgtgcgccaccatctccttcaggttttcctctgttacatcagagggcgcccattgactctcgaagctttctctctcttccgccatgacagtgaattagatggtgtgatttggttcgagatatggctaggaatggatgggaacttgatgtggtggctgcgcggaaggtttttgtggagctcaggaggatggatcgaagaggatttgttaaccctagtttccgccggtgtggttttgcactgtagcaagagaatgggggaaaatggcgagagtttcagcagggaagacgaaacgacactgtgcctgcggcgtttatttcgctagggtttcaggagtgctaatgggcctgggcctgtacagtacttcagcccaattcta

SEQ ID NO: 64096 - DNA, 38994 bp, Oryza sativa
tcaaattttttatatatagtatttctatacataattttttttaacttttttgttttttaacaaaaattgtggagatgtgtaaacttgaggtgtacaaactttaggtgcataaatttactaaaataggaaagtaatacggtgcctaaaaaggaaaccaagtggagggagagaatcagaatctgatcgcctcctagcaacccctagcgatcgatcgctaagtagcattctcggcaactagcagcctgtttggttgcctggatggggctcagccaggcccatgtgatgcaaaacacaatgtaatttataacctctactatggattaaccttaccatccataaacagttttctttttggaaaaaaaatcttgctccacaaactttcgggggtaacctcaccatccacaataataggtatacacataagatgtatccatccaaccaaacaacatctcttgtatgcaaccatcccatccgcccgttgctacaaccaaccaaacaacatctcatggtatccaactttatgtcatgcgagcaatcaaacacatgcatgtgtatcccctaagccaggctacactcagtctggataagagagatcgaccatactagggggatacgagcaaccaaacacaccctgagtttcttcacccaactaataacctttgcacatgacagatgtgtgttgacagtcgttatcaattagtctcgcgtgtcaatattactaaaataaagagagaactagttatgcttgcaatgcatatttatgttagaataaactattttccactagcatttggattctaaccttttgcagagaagaagtacaaaatggaggagaatcaatagcaaagtagatgatcaatcaatcaggcgctgatgagattcagacttatggaaatatgggccaagaactcttaaatgacaagatccaacaagcccaaaattcaaaagtctgtggagagaagaagtcaaagaggccgccagccgaaaatgggttgtattgggccagcccatggttcgaccgaaccccacctgcgccgttggatgcagggtttggcgtggacgtccaggattgcatcctaatgacggttggagggtatttctgaccattctaaccgtcacaactgtcattggggagctataaaaggccttcacctcctcacttcttccacacactcaagcaaggagcttctcatactctctcaagtttagatgagtcctctagagctagtggaatagaaatagaatagtttctttagtccttagagtcttcggaagaattcaggtacggctctagtagctcttccttcttttgtgagacttgtactatttatagaatactcttctcaatatatttatggtactttacttcactctgattactttccgatatattattcgggatataattgtctagctagcttacctgggagatgcattggtgtgggtataatattcatttatatgattgctctaagtcatgacgatgattgtacagtagtatttggtagcataagtgaggtgcttaggctattgaatatcattatttggggttataggctacgagttagtagaggtgggccgctgatggtgacagctcagtatgagtattcctccacgacagtatataatcctaagttactttcttgggggggtactcctccgtatttagccctggttggatggccatgatgggttgtcgtaaggaactcggaaattaggggtggtcactcgaaaccccaggagggcattgtaaagggggtattgattatataattatatagtagataatattatctgaagtggtatgtatgtatattagaagtataggaaatgattattttcttattcttttccacttagcctagaatttgtatgtatgagaatattgagtgcttttgctttgtggcactctacccttgaagtaaattatcccctgcttatattttgatattagcatggttctctctattataatcttcccacgagattaaactaatatgataaccttgaaatactctcgagtgaaatactacaatggtatacccgtgcgcttgcggatatgatctataaccataatataccatgaatatttctgcgccattactgggaattatatttttagtaatgtagttaagaaataccaacaatgtggtcacctactggtgttgagcataagtcacattagaagaacgaaaaaacatgatttttttggttaggaattgccgtgataccataagtaaacattttgaaaagtgattggacaaagttttgacattgaatcttaatttaggtgaaggtgcatatctgtaatttgttatgacacacactctgaaaggtactaccgtactacgacgctcctccttttaggtgctaaccccaccatccgccatcctctattgaacaaaaatgtggagtatttttttaaatttaacaaaaaaaatgtggagtaaatttaacaaagctaatgatatcgtggcttaaatttgttcacgagtttcggttttgaaacattaaccgtgccaaccacaagccagcgtaggcaacggctttaccttttgtataacatagttcattgcggggcaccatactgagaagtggcggagataaacccacgggggtcgctggggagtccatgccttgaattataaggaggtgattatgatccaggaacggtgcgctgtgatggattgtgttatgcgaggggtactgtcacagctcctttccgaggtaccatggtggtattgaggcgcgtggtgacatgttgtggggctatgtcttgtggttacagtggtatatctctgtccagagtaaaactattcgaatagtgtaacatactaaaaattagctattttctaattatgcatcataccggttcttatgtttttattaacctcctaaacctaggatattataattaaagagacctcctaaatttaacctgcataaaatctctttctggtatttaatttcttttgtgtctttcctttaaaaatatatttagttaaattaaggtgtttcttgattttgggttttaatttaaaaaccttcctttgacaaaattccttttattcaaatttagtttgaaaatcttttatgaatcatggtccaagaaatcctccaacactatccttgaacctaaaccgaagcaattccaaatttgttggaattaattgtcaacctatcctttgattccaaacctatccttagttccctttccaaatttcaagtatccaaattccttttttcaatctagccaccaatttaatttccgtggcttgatttcctcctcggcacaaaaataatattattacaaatattgtgaataattgctcttgtgctaagagaatagactttatccctccgccccaaattcaaaacctcgtttagcccatatctaattctctaaatttcataccacatattttgggctagaattctatttactctactccctccatattccctccacatactcaaaaatattcaaatctagagccatattatttatggtattgaatattttgaatttctatttgagtgcattaaataaactccatctctaaagtattgcactcaaaccaactatagaaatatctcttttggaaattatattcaaatataatttcctttcaaactttcctagtcaatctcctccaaattctattcaaaatttagaaaatcatctattgggccaaagtctcctcttttcttccttttggcccaattgaccagggtcggcccagccaagcccagccggccagctgagccaacgcctctcctcccgtgggcgcacagggcgcccaggccaccgctgccgtcacggcttttgccgccgccactcgaagttttgcgccgccgtcgtcttgtcttcgacgctaagcaaccgccgcccgacgtcagcgccacctcacgcctctgatgtcagccgccgagccgaagcgccttccccggccaatcaactgacagaacgggcgacgtgttcgtcttctccatgccgccgccaatttttttccgtcgctgctaagaaacgaaagccggcgccgcctccttctcctccactccaccggcgccgtgaccctcttgccctcctcctccaaaccgacctctccctcctataaatagcccgccaatccctccccttctctgcatacaaaccaagctccatctctctctctctcctgccatgtccggccgtcgccgtcgtcggtcgatctctttctctatagctcccctatcaatttcctcgcacctccggctttgcctacctccgacaactccattttgcccctttcccccttctcttcccctttgaatcaagtcaccaccgtctccacccatgccggccggaggtgagcccttaccgtcgccgttccggccttatctctcactccttctaccagccaacggcctccccaggtgcgtggtgctagggaacaccacccgccgccggcgtcgccgccatccagccaccggagcaccggcgccccacctccctccctcttctctgttgccggcaagaaagagaagaagaaaggaacgggaggaagaaggagagaaggaaaaagaagaagaaaaagaaaagcctgacaggtgggtcccctgcacagtgacttttctcattttctagatttaattcaaaacccaatctttagaagcccatatttcctaaaccgtagatccgattccagtaaaacttggacctaaatttatataaattcaaaccctatcttttgacaccaaattttgtattttataattttatttgaatttattcaaatatcgtttgaatttatatttgccttttcaaatattttcttttgtcccaaattacccctttagccactaaaaagccgccggttggaactttatgccttccatggggacgtttgcgcggtctacggacctcaacgtcgaaccgttggttataaagcccggcaaagcctaaacccaaggtcgaagtgctgcttctggcaccccacgccttgatgcgtatagcggtcggagcttcactattccctcgacctccacagcacgccgcacagttagctctcgagctctgtgtgatcctagtcgctccgccgccactcacggttgtcggagtaacacttccgcccaactaaacccacacaaacctcctatccctctaaccgttatgctgtctgttgacaccggctagagaagataccaaacctagtcgttatgatctagcatcgactaacacacaaccaaaccctagccctcctaaccatttatcgttttcttgttattttatggcttttattgaatttagttcttcgtctttcttagtagagtctattatcttttggatggcaacttgtgatgttttgaggatcggataattaggttgcctatcttggatttgtttgcgttggagcaaggcaagttattattcctcccctttgagcattattatcctatattctatatctctattattccatgcattagccattcatgattttaaatgcataacttgaacatatagtaaaccagatatatgctagattttgcttagccatgcctagttagattgcataaaatataatgaacttagattggaacagtatggtagaaatggttgattttcgggtggctagtactgttccaaccgacataagattgccaagtacatgtgaagaacgaactagtacgaccgcaattctagaatggggacagacttagcaaagtaggttatctagcaaaggtggtacctctgtacagtggttcttctttaagtccttgcgcaggaggcaaatttacgccgagcagagcgattataatatttaccgagacgcaggtaaatatattgattattgcgcactgtgtgtgtattgtgaaaacctggttgggatgacgggggtctctcaaccagttctctctaaagacctcgggaacgccagaactcctctcgctgctgataacgttacgttcagagcgcgtggggattatagttcatggaacaggtaccgttgatgttagtaaccgaaaagctttgccatgactaagctgatgaatattagcatgtcatggattgcgggtaaagcgtacatctactgcagtatgagtatctctgaaactattcgaatagccgtgctcacggatattgagcatcgggactcactatggcatcttggttagaaatataactccagattttattaaatattgttgcatttcaaaacattatagactttctccttctactttctcagctttctgcaaatagatctagctctactcaaatactattatttcatacattcatacttgaatataatagcttgctgagtacgttgtactcacccttactttaacccccttctttcagagttaatttggagttcttgccgaagccgagagttcaatcatataagttagttttcatttcaatctagttctcaagtctagattagttagatggtttaagtctatagcaatacactagagttggtttattctatagcttctgctgtattagttagccacaagtttgtaaatacccatatattttgtaataacatctcctttggagccttattcaaatgtatgcaatgaagatccagattgttgaacctgtatcaatctactgatccagggcttgatacagttaaacatgtcggtttccgaatcattagttttgggacccaacaaatagccatacccgtggttgtgggcgggtctaacaatgtctttcgtgattaggctcacacttctcaccataataaatgatgatataattgctaataatttgcttagctcctggtttggaatggtacatttctggtttggagatagatctgtacagccgggtatggttgttcagttttggttaggcatatgcagcatgggtgtgctgttcagtgttgattaatattaatgatttattattctactgttttacaattctcaaatgtttgctaaatgttgcttttgcaaatgagccctatattatgccattctttggtatccttgtgcacttgcatttttgttgtgtggcttgtagagtattccatgtactcaccttgcaataatcaatcaaacctcggttgaagaaaagttgtgaaggagaagacgtttggcttataccccagttgagctgcctatgggagtggagctgaagcttcactagattttatttttccgctgcagtttttttcgtggtggggactaagtacctcttatgtaggtatttattgctttagttattttgatgaatttgtatattaaattgtcagtttgtgtatctcggctgatttctgtatgaggattttatacacaaataagttccgaaattaccagtgaatttctggacgtgacatacagtatccaacccggcacggcactggccaacgagcttctgggttgtgccgggtcgaggccacagcccatgggttggtatggcatggcgtgtactgggtaggcatggcccagcacggcacgaaaggcccaagccaccagcccaccgcaggtacatgtccacagtgccgcacccagctgccaatgtgtgcgcgcggcacgctcgcacgcacccccgtgcgtccccgcctcccttcgcggctcacgcgggccgcccgccttcaccaattgcagcatgcgcgcatcttgcctcccgccctctcctcacaccgcccgcctgcgccaagccgctagtcgccacagccatgcctgccaatagtgctagtaggcgcccgcccgtctgcaccaatccagctgagaagatcgttggagcacaaaaaaaatataaaaaatgcgaaaaatatcagaaaagttctattttttttacaaataggacactcactatggagattttgaatcatccaaaccttccattttgtgctatcttttgttcttttgtgtgctagttcaattttcttatctaaacaaaatttgttcaaaatcaaaaatactttgtgaagtccacttttttttagcaaaactgcatgcacaaggtgtaaagaaggtaagaaagaattggagaatcccttttttattattcgtattttatgttatatgtatatttcttttgaaattccgtccatgtggttataatattcagcatggacgatccgagcagtctgtcattcaatttgggtgactttgaccctaattacctatcagcgtcatacataaataacgagtatgatgcctccggatcggttccaacaccgtcagttttggacgaggtaccggtggcttcagatggatcaggaactatgagcaggagtccatcgacgaacaccagctcaaagagatcacgaacttcggccgtttggcaacattttgatgaggtggctgtgacatgccctggtggaaggcaagtaacgtatgcgaaatgtaaaatatttaaacgcgacaaataatctgctacagaattttctactcctttatatctttaatttcaaaatcaaattcttggagtggaagaacccatctaattaatcgaagttttgcatctttcttagtgagcaggaattttagagcagcatgatcaatgtacacaataaccttagcaactaagtaagacttgatcaccccttattaccccaagtgcattttctatgcgagaaaccaaagaagtgcactcaataggaccggaaaacttgaaattttctaaccattggcgaatcatgtattacataagagaaacttttatctttctaaccatgtcaaataagataatcaacttatcttcacgaatgggtctaagattagctctaggaaataaagtcatgccaagccatttatacatgagtctaagagtaggattatggatgccatctaggccttctacataacttgtttttctcagagttggaagctgccttccaaaaattaattttgcaagttttgtcaaaacctaaaagcagactcaattctttaaaagagagatagaactccttacagaaaaaccaaaaagaaatgccatcatctacttctagcaaagtagcaaggtacataaaaaatttctaggtaagtaagcgagaacctggctcatctaccacagcaaatttctcccatcctatagccttccaaacaatacgaaaatcaacatccgtacctattttctgaagaagttctaggtcgtatgctggggtgtcagcaaatggccgatccttgagcatgtgatagccctgcatctcccggtctcctatgaggtcgaggttggagtcatcgagaagccttggcgaggtgtccacctcctccatggagacatcggtggaagagtgtgtactcgacttatcttggtgatgacttgaacatgagcttgatcccttcttgaacaaacccgtgattcttctcttcatgactgcagaaagagcaagagcacacactacaaggaaatcggcctagcaccacggcgccaaatcgttgcgatatgggtgttttcgttgcaatacagagaaatcacaacgaaaaaatttcattggcatgcgttgcaagtacctctgatgcgatagggtatcgcaacgagtgctcacgcgttgccataaaatcgggctgttgcaacgagacgaagcatggggaaagattgaagaagcaacgatatttagcgttcgagttgacattgcaatagttgttatcgcaacaacgttagatagttgcaaacaagaattatcacaacgtttcagtttcgttgcaatcctgtatattgcaacgatatttgcaagtggcaataacacgtacggtgttgcaatatgcttaaaggatatcacatcgacgtaggactcgtcgctatacaattaaaggatatcacaacaaagtaaatcgtcgctattcgcttgaaggatatcgcaacgaagttagagtcgttgccatacaccaaacgtgtatcgtaacaacatgtaacccgtggctgtacgctcgaaggatatcgcaactaagttcaacatgtaaccggtggctatacgctcgaaggatatcgcaactaagtatggattgtggctatatgcttctaggttatggcatcaacatgcatcccgtcgctataggctacaactatatcgcaacaaagtaaacccgtcgctataggattgaaccatatcgcaacgattggatagaaccatatcgcaacgaattaggagtcgtcgcatacggtaggatatagcaacgaagcgaaatatgtcataacaatgatttatttggttactgcaacatatatattgaaatttttgaggtagcaaactatcattagtcttacagcccattgaaataacgagtacataaatatgacgatacattgtaacttgtccattcatccattcaacaataaaatgtccataaaccctatattgttccataacccctctattctttgttcccatgtctaccaatctttgagtcttaatgtgccgcccgagtttgagtttcctgctgaatacaaacatggtttgaactgcatgatagcaataggttgggctggattgtgaaatggcaatgcaaaaattaactttcttaccagttgtttcctgttgcttgctcacgttagagcaccagatagtagttgtttagaggaaatgtatttcgctgctgtccctttcccaacattttcagtaagcatactctttgtaactttggaaactttagattttcctatagtagggtccacattttctttgtttgcagtgacatcgtgtcgggtcccaaaattaattacttggatccgactatgattaatgtatcaatccatggatcagtaaatattgatacatacaatataactggttcttcattgcatatgttaaagttttacaatactaagagttttacaattaggtactcacctaattgatcaactagaattaatacatagcggaagtttctatacattctaactagggaggtataacctttagggattttctaaattatcggggtcatcatagtaatagtcataggggtcctcctcttgacccatatctgaaaaaggggttatgagagcaaggatgagtattcacaatactcagcaagttatcatggaaatatgttatgcactggcatattgtagggttctttgcaaaaaaaaagtaataatcaatctggaagagttatagcaagaatttataaatatatagactttaaatttctaaccagtgtaccatatgagtcccaatactcaactccatgagtacggctattcgaatagtttcaaagatattctactgcagcagatgtacgctttacccgtagtccacgacttgctgataatcatcggctttagtcatggcccagtatcaagttattaacaactgtggcacctgttccatgaacttatatcctcatatgctctgaacgtattgttaacagcagcaagaggagttctggcgttctcgaggtatttaaggggaactgaccgtatgacaccacgtcatctcgatcagggtttagaaatataccatatagtttatacacgagtatcacaaaccatttacctgtacctggtaatggttaaaagttgctcttcacggctataaatgcctcctgcgcgagggcttaaaaataagaaccactatacggaggtgccatattgctaattaacataatatctaggtttgtccccattctagaaacagcggtcgtacccgttcgttcgacataagtacctggtaataactatatcgatcgagacggtactagccacccggaaatcatccaattctaacgtactgtcccaatctaagtataagatattttaaccagattataagcgaagtaagcaaggctaaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctgttatctagtgtgttagaagaatcctcaagacctagggttagacatataaaattcaaattcaaaaggaattcaaataaaattcaaaaataagaaagatagggaaaataaaataaaatagaaaaataacaaaaggggtctcaaaagatagagaatgattttagaagaatattggtccaagtttcactggaattggatctatattttaaaagatatgggcttctaaagtttgaaaatcaattaaatgtgaaatggcactgtgtgcgggtcccacctgtcagtctctctctctctctcttctcttcttcaacctccagccgttccgcaaatgtggctggcagcgctggggtttgggattacggcggagctagaggggggaaggggttgtggctgaggaggggttaatttggtatgtggttgagctagcggctagggtggcggtggcatagttaagccgtgaaggtgatcggggtgatgtgagtcagacatggctcggggaggggttctagagcatctatgaggtacctagaagggtttgggcaacttgccgaccttcgacaaggtgcggagtatatctgccgactagcgcctccattggcggtggtcgagctcacgtcggcagcccagagggtggcatgataatgcaaaccgattgcaaaaatagaccctaggtagtatatagatggttaaaacggaagaactcaccgagatcggttgaaacgacggatttcggccggaaaaacttcgcggcgtcgaagaacagagcaaagcagggacgacggtgctcggctcagtacggcgaggtaaaactcgacgcatggcttcggttagggctcactatactagaacatggttgatataaggtgttctaagggttatttagggtgaaggatggatggaggggtgtggagtcgatcgcgcacaaggtgttcgaccgacgggcgagagtggttgatgagatggattggtgaagcagagcttcggagttgtggagctatggttgttgatgatcgatgatgagcaaggaagggattggggtcctatttatagggccaggagaggtggatgagctcggacgccatcatcgccatggattaactcaaggattggatatggcaaaggtggcagaggctgtgagagggtggccaaggtcaatttgagtggcggaggccacgtttgaatacttaccggcgaaggattggcttgaccgcgggtagaaacggctggcgacgtgttagcgccaatccgggcgcgacgcgcggtggcggcgagggttaaaacggccagcttaagggtgaatggtttgaattgtgagaggggaaaccaccgtctatcttcaattgaaccgtgcagcaagaattggcgcgattcatgctgggtagaataaaaatcggactcggcgacggctttggacgggagcgcacggcgtcaagattggtgcggcggtggtggtctgagggcgtcggacaggcgacgacgcgccaagacgatcgggcacgtgcaagcggccccaaagccgacgcgcggcgacacggcacgcggctaagtcggatgcccaggcatgcatgaatgggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaagtttcactagggtttggaatatagcaaatccttactaatattagggtaaattagtagggttctaaaggagtaacacttgaaccaattaagaatcaaataaatttttaaagcacactaaattaatcaaaagccagcatgatgcagtcaaattttagtttaaaatttgaggatgttacaaacctacctcccttaaagatatcttgtcccgagatttgcttaggagtcttcgaaaagatacgggaattccaattgtaaataatcttcccgttcccaagttgcctcatcctctgtatgatgattccattgaactttaaacatttttattgccttagtacgagttgttctctgtgtttcattcaaaattctaataggatattgtggataggttaaatctttattcaattcaatagtacttattcctctggaatacgtaaacatttctttaattgtgaaatatggaatgtaggatgtacatcagatagataatttggtaaagccaattgataggctacttctccatgtttagcaattatttgatatggtccaatataacgaggggctagttttccttttactttaaatctttttatccctcgtaaaggtgaaacctttagataaacataatcaccaatgtcaaaagttaactctctccgtctagagtctgcataactcttttgtcgagattgagctactttgagtctgtctctaataagtcgaactttttcttcagcttcctttaaaaggtccgttccaaatatacttctttctccgatttctgtccatatcaatggtgtttgacatttccttccatataaggattcatgtggtgacatttttaaactagcttgataactattgttatatgaaaattctgcgtaaggtaaacatttgtcccaactagcagcaaaatctagagcacaggctcttaacatatcttttaatatctgatttagtctttctgtttgtcctccggtttgcagatgaaatgctatactaaaatccaaataacttcccaattcataatgtagtttctgccaaaagtgtgaagtaaattgggtaccacgatcggaaataattctttttggtactccatgtaaacatactatccttgtcatataaagttctacgagttgtgctccagtataggttgttttcacaggaatgaatcgtgcagtctttgtaaatctatcaatgattacccatatagaatcatatctagtagaagttttgggtagtccagtgataaaatccattcctatttcatcccatttccattcaggtatttgtaaagggtgtaataatcctgtaggcttttggtgttctgctttaacttgttgacaaacataacataatgcaacatattctgcaatatgtcgtttcatatttggccaccagtataagtctttgtactacctgggtgtaaagagtaggctgagtcaggtgcttcttttagtattaccttccttaagattcctgattgtggtacgataattctatttccgtaccataatattccttccaggtcttcggtaatatctgtagcctttcctcgcaccatccgttccttaaaagtttgtattttagaatcctccttctgatgttcttttatttgatccatcaaggtaggttttaactccaaagtgttcaattctccatacttaataatacccagatttagtctaagcatttatgcttgtaattgttctgacattatttcttgttgtaaattgcaataaactttttgacttaaagcatcggcaaccacgttagcttttcctggatggtatagaatttccaaattataatccttaattaattctaaccatcttctttgccgaagattaagatctatctgagtaaaaatatatttcaaactcttatgatcgatgtagattttacaatgatttccaatcaagtagtgtcgccaaatcttcaatgcgtgtactactgctgctaactccaaatcatgagttgggtaattttcttcatgaggtcttagttgtcttgatgcataagctactactttaccttcttgcataaggacacatcctaatccttgtcgagaggcatcacaatagatctcaaaatctttttggatgtctggcaagattaatactggcgtagtagtaagcttatgtttcaatctttgaaaactatttctgacattctggtgtccattcaaatttcctgtccttcttaagtaatctggtcatgggttttgcaatagtagagaaatctttaatacaccttcgataatatccggcaagtcctaagaaactccttatctcaggtactgaggttggtgttttccattccattacagctttaaacttttccggatccacggcaactccttccttagttattatatgtcctagaaatgcaacttgatctagccaaaattcacatttactgaatttggcatataactgatgttgccttaacttctccaatactaatcgtaggtgttgtttatgctcttccttgctccttttaattgatcaaatagaccgtcgattcttggtaagggatatttatttttaatagttacttcatttagagctcggtaatctacacacattcttaaacttccatctttcttctttacgaatagtacaggtgatgaaccctgagttcctctcgacactcaaggctgttgttggttcgatctttcggtgagttgtgataactacgatttgggagaaacgttgacgatccgactacaaccgtacgagacgttgtgttgcgccttagcgatcaatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagctgacacgcgcgctgcaagcaagtagcaatggctaaactttaatatatcaaaacccaataaaccctaaaggggtacctagctatatataggggtgggaggacgacctagggatgcctaggggcgtgctctacctggttggggcacaccccacatgggccccacctgggccggggtcccaaatgaagttacaagcccataggcccattataggtgacgcagcaccttgtgcctgtgatttcagccacacgagatggaattcggatatgaggctagatccgttggaaagagggctccgagagtattctatcaagtactcacgggctgaaaatggaggtcgtatgcagattcggcgaccgtttgaagtcagtactatagcaagtggccgaatcggattccagcacttggacgacgtgatctcgatatcttcttgttcatccatgatgtgaacaatggttgcattcgtggtagttatggtcacatcatcctccccttcttcacggaaaaccatcctcggtttttccatatggtgctatttgcgtagtccatttacaacaacctgtttcttccaatcaaaacaaggcaaagttgagacaatttggttagcaataacatttctctctagcttgtatgttttatccacatgtacaggaagttctaaatccgagcagatgtaaactctatgcacaaaatatattccaagatcattatattcgccaaagatgtgaaatataatattggttggatatggcaaatcagacttagcaaataatttctccttcaaattatcgagctcacaaaaatcatcaaactgaacatagcccaaagtatttaaagaagatctcaattcacgcttctctacttcattagcaatgtgaacaacatgcttaaaatcagcgcagtatgaattaacagtaggaatagcatgttcattcactagttgtggcatggatataagtgaagcattatcacataactcttctttatcacaaggaactgcaaacaaatcaacttgtgacaaaggaatctcagcagttggttccactaatggttgctctgctatagtatgaaaagtggacaaattcaattcattaacaacacactcaccttgattaatttcagcaccattaagttttacctttgatgccctcttcagatgatggaggtgcctcgactttgagtgtgaacaatggaactggcggctctttcatgtctctctcctccttttcatgattatgcacttcctgcaaatggttagtattagaagacaaaaacatagcatgttgcttcttcatgtcctcctctattttactttcagcattgcaagcaagttgtaacaaatgagaaagaaatgtatatctttgacaatcaagcatgtcctgaatttctttgttaagcccacgtaaaaacctcaattctttagtttcttcgcattcatctaaaccacaacgtaataaacaaacttgcatatcatgagagtatgaagtaacagttctggtatcttgttttaaacattgcagtttgttgaacaaaatgtcagcataatacatgggaacataaacatctctgaaatatcgtttcaggtctttccatgattgtggtattttgttatgcctacaaagatgtttccaatcattagaagcatgtttaattaaaacactagaggaacacataaccttttgtttatcagacaagacatgcttttgaaattcactatcaaccgctagctcccaattaatgtaagcatgaggatcatagtttccctcgaaataaggcagtgcagatttgatcttacctagaacatcatcacttacctcataatggtcatattgatcactcctcatgtctcgacgaagatgtcgatgttgagcacagctatccccaattatcttgcgtatccctgccattgttagtagaaaacaaaaaacatacacaaaaatatgcgcgttcctattaactactaggtagtggcagctcaaaaatcacacacactcaagcttttaaccaagctcttccaagatcttaccattgaaagtggaatggtgacatacactgactcaaccaagcaccccaatggaagttggatgtatcgatgccttggcaaatacttgcggtacggctgtaatcaaatctgtggagctctgggtaggcttatatatgtagcaaaggaatagcaaatgctcaactcagataatgcaaagttgaataattgttcaaagtcaagtaccgtgctggtcctaggctagaacgtactagagacgcgagcctagacacaaatgatagcacaagatagcactaggaacaactcatgcacaactctgatatatgaagttcaactcaaacataacagtattttctcttttctttctttcttctttcttcttttcttttttttctttccttttcttttctgttttttttggtgcggattttttttcttttcttttttatgcacctttctgcctttttttctcacttttatcttgatttttttaacaaaaactgactcaaggaccttaatgtaaggttacagggactcaaacgtaaatataaaatctatagggactcaaatgtaaaagtctaaacccaaaattaaaattatacaaaaatggaatgctgaatttatgccggttccatttttccaaacagatctcgaaaccgacaccaaacaaaaattcaccaaggtgtttgacacaactcagaaccgtgaaagggagggagggagtcggactcggccaaaggggcgagtgggagtcggccaggaggtggagtggatggcagtcgaatttggtgtatgggataaaaaggaaactgatttttaaccaatccaatctactatatctttccaaaacaaacttgactacttccaaaatcagatatggtaattcaccttcctcctctcatgcacgacacaggcacggccaaaatagaagaacgcccagtcagcaaacccaagatgcaactcaacaactgcaaaaccaaccggtaaaaacttttgaaaactacaaaaatagaatcgtggcagcgagccgattcagttttcgtaggtcccgacgacaacagatacacggaggtgacgacgactgtggtacaaaacgtgaccagaactcgaaactctacacgaactagacgctaacaccagcaactcgactcgacgatgtaacacaaaactcaacaaagcaaaaactgataaaaacaatgcaatggcacaatatggctaggtacaggacaatttttttatggcaattttctggttatgggtagataaaactcaccgagcaacgaaagctctgataccacctgatgaaccctgagttcctctcgacactcaaggctgttgttggcccgatctttcggtgagttgtgacaactacgatttgggagaaacattgacgatccgactacaaccgtacgagacgttgtgttgcgccttagcgatcgatacacctctccgtggattgttgatcttgccggtgcagatcaaccctattcctgcaagcaaatcgaagaaacaagcaagaacaagataaaagcaatctgatgttgcaaataggaatttaatacaaatgataagttggggttccgaagaacaagcagacggacggtctagccgacacgcgcgctgcaagcaagtagcaatggctaaactttaatatatcaaaacccaataaaccctgaaggggtacctagctgtatataggggtgggaggatgacctaggggtgcctacgggcatgctccacctggttggggcgcatcccacatgggccccacctgggccggggtcccaaatgaagttacaagcccataggcccattataggtgacgcagcaccttgtgcctatgatttcggccacacgagatggaattcggagatgaggctgtatccgttggaaagagggctccgagagctttccatcaagtactcacgggccgaaaacggaggtcgtatgcagattcagcgaccgtttgaagtcagtagtgtagtaggtggccgaatcggattccagcacttggatgatgtgatctcgatatcttcttgttcatccatgatgtgagcaatggttacctccgtggtagtcatggtcacatcaacatgagttccccaaagtgaagaactttgtcgaataaagcctttttcttgtagctcagctatctgtttcttcaattcttccaattcattaattggcatcctataaggtctttttgatataggtgccgttccaggaagtaactctataataaattctatttcccgatttggaggtaaggtacttagatcttaaggaaatacatccaaatattcttgcaccactggaacttcttcttttggtataagcatacaaatgtctgtcatatgatattccatagatagattgggtttaactattatctttgtattaattccttgttcatcagtaaggataacctctcttgttgcatgattgattagtccattattcttggctaaccaatccatgcccaaaatgatatctatagtttgggtaggtagtacgatcaaatcaattaaaaatatttgatctcctaatttaatcggaacatttctacaaatagatgatactaatacagttcctctaggtgaatatattatcatagccttgtttaaattatctttaggtaaagactgattccaactggcttttgcagataaaaaggaatgagaggcaccagaatcaaatagaatagtaactggtttagagtttatggtgaacatacccatcaatatattaggatcttgttgagcttgttctgctttaatatgatgtacttgaccacgtccaagattaggtccactcttaataattggaggatttttctttataaaacctgtagtagatggtttctgataagaagtttggccacccatattttgacgattagggcatagtcttgcaaaatgtccaacttcccacaaacatagcatggagagtcttccatccttaatccaggtcttgatagtattggtggcatgcccggccttgcattggatagagatggcttaaatggataaggcctccgaacttgtagtgaacttctagttggtgattgtcgttgtaaattcattcttctcttacggaatccttccaccattctacgatcattttctagcctaaccactttattgactaggctttgaaaactttcatgatcttgactaatcattggtcctcgaagttcatcacgtaatccttctataaacctttcaatcctctctttctcatcttgaatgtctgaagcaacatatcacatatcgagaaagctgtgtaaatttattcaaatatttttgtactgtcataaaaccttgtcttaatcctcgaaattcattctttttcatcctgatcacagctgtaggtataaaagcatttctgaaagctatggtaaattccatccatgtaatgatatgggtaggatcttctatagaagcttgatatgcttcccaccattcattggctggtccttctagttgatgggttgcaaaggttaccttctcttgttcgtttgttctgaccaaggttagtttcttttcaatagcccttagccagtcttcggcatccataggttctttggattttgagaaaactggtggtttaatcctcagaaattctgcatgtgcactataacctttatttccttgattttttgctatgtcctgtaataattgagtttgtcttgccataacttctaccaaggtagtaggatttggtgaagggatttctcccgtatctccttgacccgtgctgccattacccgtattcatctagaaaatgggtaattgatatcttctcaaaggggagtcaacatccataattaaacatagattttatttatgaacaacattgtacatggtgtatgctacaaaagaacaaaccaagaaaaaccacaaccgcaaaagaaggggtaatcacacatagaagttagagaggagtaggatcactaacaattctacacttaagatctctaactatctataacttctattcatcaagccatccaccactgccttccgcgggattagcaaataacgatgcaggtgcgaagtgtgaaaattcatgaggagatgcagaagttgatgcagtaatattgggggcagagcaggagtaagggtcttcattattttcttgatcatcagcatgtatagaaagatgttcctgtgtctcaagctctcattcttctggatcttcctcttcgtctggagattcagtccaaattggggcagtatttaagtcattgatatcaaatacccgatttggcctgagtacttcaggttcttggctaggttcactgatatcgatagctgaatgcatttcttctgcttcatcatcagaataaataggatacaacggtggtggtgatggtggtaaaccttgtaaaactccttcaccattatcctgaggatgtggttcatcttcacgtactggtgagatatgtccttccataccatcatcatcatcatcgtcatcactacccatatttgggatttggtgaagacagaaggctgctcttgcaacacaaatattgaggatagaattatgtttttctctttcctcatataattcgtgaagtatacgatatttgtgtttgagaacagcttctctgcgttcagcttcctccaaacgtttacgttgtacatccatgtgttctagggcttcttcatacatgtcatctgcagcttccatccagatagacatagttgcttttactggttgttcatgataatccacgtcttgaagagtacagtaatcttcgcccggctttcgcataggatggtaagaatagcgagagtgttgcagcttatcttgatagatatgattaagacgtagaaaagcctccctggacacatcatataatgcagctcatacggtatcccacctatgacgtgttcggaagtaatacatatcacgttcacctcttgggggattgatcttcacagtcatatcacactcccaacgttctccccattgataggcatgtgaatagaattccggcttctcatttatcttcagcttagtcatcaagctgattagttgatcagtgtagtcattatcatggatagtaatcgcaatttctataactttttgctcatgcccttctgccattgtcctaaaatacacagatgacattataatgcatgctcgtggattaaatctaccccccttaaaaaaataaggttgaggtaaattcaaacttaacttagttagtagtccttaaggttcatcctatagtcaaaacatatgctctgataccagtcctctcgggtcccaaaattaattacttggatccgactatgattaatgtatcaatccccggatcagtaaatattgatacatacaatataactgcttcttcattacatacgttaaagtttcacaatactaagggttttacaataataggtactcaccaaattgatcaactagaattaatacatagcggaagtttctatacattctgactagggaggtataacctttagggattttctaaattatcggggtcatcctagtaatagccataggggttctcctcttgactcataactgaaaaaggggttataagagcaaggatgagtattcacaatactcagcaagttatcatggaaatatgttatgcactggcatatagtagggttctttgcaaaaagcagtaataaacaatctggaagagttatagcaagaatttataaatatatagactttaaatttctaaccagtgtaccatatgagtcccggtactcaactccatgagtacggctattcgaatagtttcaaagatattctactgcagcagatgtacgctttacccgcagtccacgacttgctgataatcatcggctttagtcatggcccagtattaagttattaacaattgtggcacctgttccatgaacttatatcctcatatgctctaaacgtattgttaacagcagcaagaggagttctggcgttcgcgaggtatttaaggggaactgatcatatgacaccacgtcatctcgatcaaggtttagaaatataccacatagtttacactcgggtatcacaaaccatttacctgtacatggtaatggttaaaagtagcccttcgcggctataaatgcctcctgcgcgagggcttaaaaataagaaccactatacggaggtgccatattgctaattaacataataactaggtctgtccccattctagaaacagcggtcgtacccgtttgttcgacataagtacctggtaataactatatcaatcgagacggtactagccacccggaaatcatccaattctaacgtactgtcccaatctaagtataagatattttaaccagattataagtgaagtaatcaaggctcaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctattatctagtgtgttagaagaatcctcaagacctagggttagacatataaaatctcaaattcaaaaggaattcaaataaaatccaaaaataagaaagatagggaaaataaaataaaatagaaaaataacaaaaggggtctcaaaagatagagaatgattttagaagaatattggtccaagttttactggaattagatctatattttaaaagatatgtgcttctaaagtttgaaaatcaattaaatgtgaaatggcacggtgtgcgggtcccacctatcaatctctctctctctctcttctcttcttcaacctccagccgttccccaaatgtggctggcggcgctagggtttgggattacggcggcgctagagggggaaaggggttgcggccgaggaggggagggagctagggttctccggcgacggcaagcggcggcggaggggttaatttggtatgtggttgagctagcggctagggcggcgatggcatagttaagccgtgaaggtgatcggggtgatgtgagtcagacatggctcggggaggggttctagagcatctatgaggtacctagaagggtttgggcagcttgccgaccttcggcaaggtgcggagtatatccgccgacaagcgcctccattggcggcggtcgagctcatgtcggcagcccagaggatggcatgatagtgcaaaccgattgcaaaaatagactttaggtagtatatagatggttaaaacggaagaactcaccgagatcggttgaaacgacggattgcggccggaaaaacattgcggcgacgaagaacagagcagagcaggggcgacggtgctcggctcggtacggcgaggtaaaacttgatgcagggcttcggttagggctcactatactagaacctggtcgatataaggtgttctaagggttatttagggtggatggatggacgggcgtggagtcgatcgcgcacaaggtgttcgaccgacgggcgagagtggttgatgagatagattggtgaagcagagcttcggagttgtggggctatggttgttgatgatcgatgatgaacaaggaagggattagggtcctatttatagggccaggagaggtggatgagctcggacgccatcatcgccatggatgagctcaaggattggatatggcaaaggtggcagaggctgtgatagggtggccaaggtcaatttgagtggcgggaggccacgtttgaatacttaccggcgaaggattggcttgaccccgggtagaaacggctggtgacgtgttagcgccaatccgggcgcgacgcgcggcggcggcgagggttaaaacggccggcttggaggtgaatggtgagaggggaaacgaccgtctatcttcaattcaaccgtgcagcaagaattggcgcgattcaccccgggtagaatcaagatcggactcggtggcggctttggatgggagcgcacggcgtcaagcggcgatttcttgcggcggaggtcgtcccggctttgtcgtcgtcaagattggtgcggcggtggcggtctgagggcgtcggacgagcgactacgcgccaagacgatcgggcacgcgcaagcggccccaaagccgacgcgcggcgacacggcgcgtggctatgttggatgcccgggcggcgcgcgtgaaggggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaggtttcactagggtttggaatatagcaaatccttactaatattagggtaaattagtaaggttctaaagaagtaacacttgaaccaattaagaatcaaataaatttttagagcacactaaattaatcaaaagccagcatgatgcagtcaaattttgtttaaaatttgaggattctacacatcgcttgttgggatattctgtttcgtaaagtttgttacgcaatatgtaattatatattatgactggaatgattggtctagttcattacctgtttcgtaagtgcacgattttctttctctgttgtgacatcactttttaggtcaatatgtgttatgaattatgctcaatattgttagatgtaatcatgtaattcaatgcacagtgatgggtagaaatcttgttcaaggtcgttacctggattgtaggatgctctttttctttgttcccagcatttcctgtaaacaaactctttgcaactttggaaactgtatctttgcatgtagtagggttcacattttcttgggttgcagtgacatggcttgttgggatattctgttttttaaagtttgttaaacaatgacatatgtaattcaatattatgattggtatgattggtctagttcgttacctgcttcgtagttggccgattttctttctcttatgtgataacactttttgggtcaatctgtgttatgaagtatgttgaacattgttagatgtaatcatgtaattcaatgttagatgtagttaaatgcacaaaaccatgatgactgaattatttgttcaattctttacctcattcgttgtttctggtgcgtgcactggtctctcttgagtgtgcagggctgttgcatcagtataattcacattgctccactctgcttctttgttggaagtgtttgtgtaacaccccaggtaaccacgtaccaagagtgccacaccaaaaaacactcaaaccactaacttccaaaattattagaaatttcggcagagtcttccctgtaaatacggacatccacgacatgcaattataagttaaactaataacaatatcattcccataatacgatccatccttataatccatggggaagaaactattagaaatctaaaagattattataagaccaaaccaggatataattttaagtgtcattatggatctaagcaatatagtttgatagtgagcaagtagatgtgcatataaggatgttacttcccgcccttgcatgccggtctcaatgcgtacctaaaaccaaataaaacacaagagtgagtataaaaatactcagcaagtacaatatggaactagaaaacacatatacacatcgctgacaataaagcatgaacagaagcctttctttctttgataggaaacacatttccaaacaccaagtcaaaaaagatagtagttcccatcccgggcaggcatgaattgaaatagtagttttcatcccggacaatagtaaatacatcctagcatttgccggcaaagccaagtaagcgtgatcagcgcttacccacaggaacttgaataaataaccaaattgcactcccatgactacgcatggtacttgaataattgaaaccggaatcaaagaaccaaatggaaacacgtccatggcaagcagggaacttgaattatttaagcagaactagaatccagaatattaaaacaagaataacatcgtacacataagatcaacttgaaatctaaatagcgtgaacaacaatatgaacataagcaattacttatcacgttgaaatatatcagaaataaatagatagagtaacaatccatgaatcacacaattagttcgtcatgcatttgcctcgaacgaacggttggtatcatgcacgatatgatggaccaccacctaatcataaacaaaaccttagcaaacatattcaaacatgcatataaaacaatgaaaaaggtgaacctactgccccatcccatcaaatctcaataacaaggaacgccgcttggactatacacaagactgctgcttcaaacctttatatcttgaaatatgaaaaggctatgactgaaaatatatacattttgaaaatctacagaacaatacctacaactttcatgtagaaagcatatttttattctgccatttaaatggtctaatttgcgcttgaaagcaggcttcagaatctgtccagaatttcagactgtccacactaaaacaactataactagagttctactcgcccaatcagggtgtactttaccaatatagaaagataagaaaatcctctacaactttgtctataggcggcctggctgattccactgtttaacctctccaaaaacagttcaatctactactatccagattatgacacaaaaacaacagtcatactaaaaaagttatatctcctaaaccacttgagataaaatcgctccctttggtcagaagatatatccaaacattatctacaacaccatagttataaacttttgcataaaataacatttagagccccgaaacatcgaaacactgaagcactgcaaatctacccacatgcagaactgcaacaaaccaaaccgcaactacccaaactccttctctagccttccctaaccatgaattaatgcactaaagccatgctagaacaactgatacaacaaggggataagcctcacctagggtttctttagtgaacttgtgaggagacaatcggggagactccggtctaacccctccttctactcctctcctccttctcgttccgtttttctacttctcttcttgatccaagctatgaaggtggagatctagggagaggaatttgctgtagatgggagagatgcaaacacaggaggaggggaggaatgaggcgccggccagggagaggggtggcggcactatgaggggaggtgggattcggttcccctctctctagcttttatgggagaactaatgggctgggtttatgggccttctcatgttggcccacttctaaagatatttttcttttatttatttctgttaacatctttattttaacaagtcaacccaaactaaaaaacctaaatatcttttaatatacggggtattacagtttgaatcaatggtagccttggtattaaaaaaatgtctggtcagatattagcagtaatatttgtatcatcaatcactaaggatacatcttctccagactctcaagaagcatgacataactattcaattcattaccaattctctatgattttaaaatgtattatgaacagagcatgtacacatattaaaaaatgcagacaatatgaatgtcttacctcctgtgtcaatggttgtttactctgctccgacatcactttttgaatctccttcaccaattcatccttgagataggctttaagttattcctgattttcgtgttccttgcaagttcatcctttaatatctgaacctcacgagcttgttcttcaactatctcatgaagttggtgttttgtttgtttctcaaaatatccgtgtccacgtttctatgttgattttgttcctgttgtttccttgtatgtgttctggaaaacatcgtcttcttgacccccaaatgtgacacttcttgatccttcatcacccgcctcatctgaatctgtcatagccaacttccttgttgtattattctgatgcaaagaaaaaaaatgtaagacatcgatttaggtaatgttgcgactcaaataatatcttgttatgtgcttgaaattacaactcatgtaaatactttcagacatcttatttgaccattttccgtgcctcgtgtgagtagacttccaaagttccagaacacctggctcagcaccagtttcttcatctctctacgaatgaaatattttgcatcattagtattcatttgattattattttgttagttcatctgaatgtaaaacatattcacctgttcccaactacactgagagaatggtttggaacccataagatgcatggttttcatttgttgcctattcgtagagttctgggtgctgaccttctgcacagataagacacgcaacgttcagcaattagcaagtacaatatgcacaaacgcttgtgttattaattgtacaaaaaagtgcctcaccttaaattttttggatccaaagtacatgatcagtcttgaggcttatttttcattctgtcttcataactgtcatatgccctgtacgtagcactaaaagtggatcaccatcctttgtatcgttctttggcaatcttccataccatctgcctagaatcatcattctgcgggatgtcccatgaattatgttggaaacattacattcaattacattgagaacataggtgcaaattgaaaaattcatttgcataacagatagaaaagaataaagatgtggcatatacataccattacacaatctgcaattgaattcttgacatcttgcttcacatctttccactttctaacaccaattagtggagtccttaaccttgtgtacattaccacttcatccacaaatgtacgcctattgtctccacatggaccacccagttttgctgaaaattcaactttaagtttacgagaagatgacttcaacctcttggtaccatggccaacttgcttgccatctacttacaatcacgtgagaaaagttcatacaaaggattaagtgttgattcaattgcagcaatgaaagtaaaaatttaaagaaatatgaactgaatataaccttgtgtatgctttgttattttcctagcatgagatggccattctatttctggcatgtcactgctgccattgatctcgacaccatctgatgtattcttattattggtaatataagctttgtaagccactgccaaaaaatgtacacatgtgcgctttgtagattataaaaagtaattagaaataataagtactccaaagggaaaaatacatactaatttgtttcagaagcccttgatcccttaaccattcagtgtaagttttaatggtttcgtccctgtaatcatcgtatagatctgcgagataccaacaaaattatgtaagtaaataatacaggtacagatatgcacaacttgctactgcaatacaactagcatatataccatgaacagtttcatcatcctcttggattgatgcaagccattctttgtatgcatcaacctcatcatcatcatcattatcatcgtcacactcttgctcccttggtcactttagaggtgtaatgttgacatgtcgttcttttacttgttgtgtagccagtactaacctgactttcttttctgaagctacgtccctaatcatgcattctgcatctcttctgtaatcaattgcctcaaggcttgctatatcatttccacatctcttcttgtagtacaagtagtcgcgcaagccaaaccctagctactcttatcaaagattcaaatcatatgttacccttgtcaacattggctttgacccagcgctctttggaccccttgcagttgatccatacctcccatatctcacctgtcaacttgatgctatttgtgtggaaaacaaccattatgataatatagtaggaatatcaaacattgatttacatgaaaaacatatattcagtacacttctagtaatcttatatagtaccctaaacgagcgagaaaaaacaactctgttttataacatcaaaaaatgaaaatgtcaattaggcgcaaaatgcagccctctgtattatcaaatttgctgacctcatttagtacacactagggcaatgtttggcaaatgagaaagggaaataatttcacacccatctttaaatcctaactatacattctcaatcttcaatttaatcctaacccatcattgattttcccaatcccaatccaatcccatatatcccattatctaatcacaccctaggttaatatgaacatacgaagatgagcacatgaaagatgcgcactagttggaaaaaatactcacctttggcttaacgggtcattcaaatcctcttcttcaaaaacgacgtcggcatcctcgactattgccgtacgaccaagtatacagagacggtccacaggtcaacggaagcataccccgtgtgccaaccgaggcgagtggccgacaaacggactccactagacaccatgcgggctgcacacgtggaaacaacgcggctaccgagcgaacaaacaaccacggtcaccacacgcacccacaaacgactaccgacaccggtacacgggtaccggggtcgacaaacacacaacgggcatggggcgacatcgaaaggacgagaacagggcagcgagaggatggatccttaccaccacgcgatgaggcatgggaacgacgatgatgaacggcgcggcggagacggatgggaacgacggagacgaacggacgacacttcggcggcgatccttggatgaaggcaggacgaggccgacgcagggcttgatgacacggagccgatgacgaagacaacgccgaggctgcagcagacttgacgaaacgcgggcgacgaacgaacgcggcttgacgaagggacgaacgccacgacgaccaagaacgatggcaggacgacaaccggaactggcgaggaggcgacgagggcagctggcagcagctgcacggatgcgaggatgacgcggaacacgccgctgcgatgacgacgatggaggcggcaccgcgggatgacgagccggcaaggatgaacggtgaagacgatgacggacaccggcggtggggttcggatggaggggaggtgatgccgaggacgacgctcgctgctgcgatgccactgttgcctgcggggatgcacttctggaggtctccgagggaaacggagagcaggccggggaaggggaggcgactgtgacgccgggggaggcgacggcacggccggccggcgtgctgacgcggtggcaggggcggctggagttggccggcggcgtaggagagagaggaggtcggcgacggtgtggctagggagctcgggaaggtggaaaaccgaaggaaagggggactagggctccgttttataggcaatggaggggagtgccgaccacaggaggggacgggaacgacgccggagaacgtggccagcggcatcaatggcggtcaaagaagagggattaaatcctagtgattgggggcgggattaaaaggggaaagttgggggaaataatgaggaagggatggggattctgtttttgcaatttatttggccggaacttgcgcagtggagcgggatcgaaggatggcggcgctagggttcaggagagggacagagaggagcggccggctggaggttgaagacgaccgggtgggtggacccaccggtcaggcgcgaggcgcgcacgtgcgccgcgcgtgcagaggggcgcgaggggaggagggaggcggcctggggtggctggtcggctgggccggcacagggcaggggtggcccaagcggaagaggagggaagaggtggaccgggaggaggaggggaggcctgggagaaagaggggatgaaaaagagagggggggaagagagacttcggccgcgggccgagggagagaggaaaggaactttgggacggacttggcccaaaggaaaaggaggattatgtttagtttcctttttaataaactttcttaattgttgttgttgcttaataattgttcttgttgcacacaagcaaagctacaaccttataaagaagcaataacaatacataaaaagaaagcacacggttctttaggttataagaaacattaggagacttgaatgggtcaattcagggttcgtatgatcaagatatgatcatccgaagtttaatgctgttattgcaggggcgtgagcagtagggcaaggacaaggcgagtacatacactccgtgcacgacgccatctgcgggactgcccaaagccgtctcttttcgggtgccttcccagctagcgagcaagcgaccagctgcatccggagcttctgcggcaccaaaaccatctccaccatgataagcagagtcaggtaaaaattcttcgcaggtacccgccaagagtgcctcatctgttgcctcgacgggacgcattcagtgccaccgttgccaagggtttgggcatgtgtagaaagattgccctagtcaacaggcatatgttgctacagaagatggctacatcaccacctccaacgtggaagaggaagaggaagaaggagaagttgaggatgaggacggcgaagtctttggtcgtgatgacacaacggcctataggaccatcattgtaaagcgggtgctcagcacgcaggtacagcagcctgagaggttgcaacgccataatttgttccagattttcttcatcatcaacaaccgtcgtgcacgtgtgatcattgatggaggtagctgcaacaacttggtgagttctgatttggtcaagaagcttggcttgaccgcacgtacacatccacatccttaccatattcagtggttaaacgtttccggaagagcaaaggtaacacaggtttgcagggtttcgttttctattggctcatatgcatattctgttgattgtgatgtggttccaatgcaagcttgttcacttttgttgagtcgtccttgggaacatgataattatgctacacacaatggtaggagtaataaatacacttttgtgcataatgaaaagaaaattacttcgctacctttgacccctgctgaaattgtagaagctgataaagagcgagttgctagtttgaaacttgatgaatctgaaaatcagcaagttgttaaatctgtttttccacctaaaacggataagctttcacctagctctaaggttgagggaattaagttgaagggtggtgttatgcttgcaacaaaatgtgacattgctgaaatttcagatgatgatatttgctattccttgatatgcaaacaagccttggtatctctagatgatattggtagttcgatacctcctgttgttactaaccttttgcaggagtatgaggatgtttttccagctgagatacccccgggattgccacctatgagagggatagagcgtcaaattgatttgattccaggagcatcattgccaaaccgtgctgcttatcgaaccaacccaaaggagactaaggaaattcagcggcaagttcaagatcttttggaccgcgggtatgtacgtcaaagccttagtccttgtgcaattcctgtaattttggttcctaggaaagatggttcttggcgaatgtgtgttgattgtagagccattaataatattattattcgatatcgtcatcctatttgaatgtgtgttgaattattccacgtatgataaggaattgtatgctcttgtacgttctttagagacgtggcgtcattatttgtggcctaaagaatttgttattcactccgatcatgaatcgcttaaatatcttcgctcacaaaataatttcaatcgtagacatgctaaatgggttgaatttattgaatcttttccttatgttatcaaacataagaaagggaaagataatgtgattgcagatgctttgtctaggcgctatactttcttgtcccaacttgattgtcagatttttggacttgaatcaattaaagaacaatatgtgcttgatcctgattttaatgaagtgatgttgaattgcaaagagggacgtacttggaacaaatttgtgatcaatggtggatttgtttatagagctaaccatctatgcattccagttggttccattcgtctttcgttgatacaggaagcgcatggaggagggttgatgggacattttggagctaagaagacgaaagatgttttggctttgcatttcttttggccaaggatgagaaaagatgttgagaggttcgtggcatgttgcaccacttgtcagaaagctaagtctcatttgaatccacatggtttgtatatgcctcttcctgtaccttctattccttaggcagatatttctatggactttgttttgggaatgcctagaactaagagggggagggatagcacttttgttgtggtagaccgtttttctaagatggcacatttcataccatgccataaaagtgatgatgttgttcatattgctgatctgtttttccatgagattgttcgcttacatggtatggcttctactattgttttagatcgtgatgcaaaattcttaagtcattttttccgcacaccatggaacaagttgggtacaaagctattgttttctacaacatgtcacccacaaacagatggacaaacagaggtagtcaaccgtactttgggtaccatgttgagggctattttgaagaaaaaattgaagatgtcggaagaatgtttgcctcatgtggagtttgcgtacaatcgggcaacacgttctactaccaaggtaagtccttttcagatagtgtatggtttcaaccctcgtgctcctattgatatcttgcctttacctactagtgagagggttcataatgatgcaaaggcacgtgctgaatttattttgaaaatgcatgagacaaccaagcacacaattgaaaagatgactgaaaagcatagaattgctggtagtaaagataggcaagaagttaagcttgaaccgagtgatttagtttggttgcatttgagaaaggatagatttccagaattgagaaagtctaagttgatgcctcatgctgatggtcctttcaaaattattgagaagattaatgataatgcatataaacttgagttgcctcccgagtttggggttagtcccacgtttaacatttcagatttgaagccatacttgggagaagaggatgagcttgagtccaagacgacttcaattcaagagggggaggatgatgcggacatcactacctcagatacacacaacaatcctccaacggtcattcaagtaccgataacaagagctcatgcgcgataattgaatttagaggtgagctcattcctatgttcttctttgtatgaattcgagagtagattgctacctaatgattatattgtgattagaaacaatggaggagacaaggagacacttggagaaggacttagagccatggaggatcatcgaggacgtccaagttaaagtggaggcccaaaccaagccgacctcgagtgtaattcagagtccaggaccagtctgcactaaaacgggcgcccaggtcgcatacatgctcggattggggcattctttatatggatggaaagctaagaagataacctttccaatggttttcgtcccacatccaaattatatccaagtcaatgggaatcgaccgaacaatttgacgtccagaatatgtcacggtgctgcgtcaccgtatttgggcctttgggccgtgtatcgtgttagaacccattagggttgcgtcgagagggggttgcacgaccctaaactctatatatcagtatccgccgccatctttaggtttttgggttttgcttagattattctgtcgagaacagtttcgccgctagatcggtttgtaagaccccaactcgtgagtttaatcattcatctgcaattttggttgttttctataccgttctcttttgtgttcttcgattggcaaatagggattagccttctcggtgaggtcatccgcgtttcgacacgggtgataaacagaggagacgtggtgctgcgattgcggggctcaagagcgtccgcgttcgagaagccggatcgatttgtgtcgcgactccgcccaaatcgttgtttatcagaacctttcagaagatcgggaaccctagtatttatgtcaggaagggaggaaccttcttttgccgagcctgaacctgagccttcaacatctttgggtctgactagagagtcctccccagagccatcgccggattccaaagaaattcaagctccgggttgtgctcctaaatttagggatgatcctcatagcgattatgagaaaaccttgacgggcatcctccctgataatatgttgatagaggaagtaatgacggttctgcttcatgagtcccctgaatctactctagaaccggatgatcttcatttcattcaaaaagattctggtgagacctttgaattg

SEQ ID NO: 64097 - DNA, 4348 bp, Oryza sativa
ggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgctctagagatttcaacatatacatcatgctggcggtaagtgcactcaggtataggacatgaagcaaaagattcaccatttcttttactcatacttatctctagttgagtctagcttgatcatatatggttatgcgtcctcagtccatttttcgtatgctatggtttgggtggtcgtcaacattcataggctttttaaattaagcatgatgcttatgataaatagtctgctttaatcaaagttgatgtggtgtcaagtttgtttaaatgaaccgtagagccagtactttcatggacttcggatgtatatccttcgtagactaacccctgcaggaaccttttcaatttgacgggtgagttctcaagcatgagtcacactggaggtaagtcaagggccaggaacaaatcaattgccataacaggcaaaggagagacatatcacctctcaagttgcacggtacgtatattgccaaatactcctttgctatgcttgtaactttatctcagccatgtatgagttctgcttaaatagaagtttggtgaaccaaaaaaaatgtttttaagaataaaagaaatgtctctcggagaaaaaaaaaagacaaaataaaattatggcaaaattatgggatccatgctcattaagttttcaatccaattcctttatagcatggatgtgaacaacaaattttgaggctatgataaaatcttttcaattttttgtagtccctcgagtatttgttgtccactaaccttttgcatgaaaataaaaagacaactaaggagcagtgtagaataacctcaacattcataccacgctccttggactatgagaagacagatgcacagggaaccaagcagagcaaatgcaatactttgttatagttgattcggttcaaagtttggtaagttcgatctggtaataatctcaaacaccctgtgtatcattgcgtcatatagtcgtcctgctaggatacccaccatgctcattgttgccataaaaaaataaaaaataaataaataaataaaagtgaaataaaataaagtaaatttaggcacttcatccgcctagagttacttaaataaaatttggctcaccggtattttaccccagtagaagtccattttactttccatgtttttgttgaataaagacaaggtacaaaacaagtgtgggggaatcatttccgaacatccgacgcgcaacagcatcaactcaacatgacaacatgatgaacaccaacccacggctgcgcacaaaattcagcagccagaacagagtcctggctgggtcggttgaaccaagtgttcgcccaacccttgcttggtccgattctgtcatccttcgccgtgtggtcaggtttgcgcgtctcctcccttatcctccactatttgtgagttaaacttggcagaaaaattgaatacaaatttagtttgactccaaatgaaaattgaaaacattaactctcaacaaatagaattttcctatgattgatcatgtatactttttattctttgctaacacttgtcacttgtgaacaaacatctatcatagggaaccttgctcatctaagtaattgatgtatgtgatatggttatgacgaaagaaattcctgtccaactgtcatgatacttgggattttgttttgtgaaattaaaactttttcgagcaatactcctcagtgactatataattacctaccaaggccatgtataattatcattgcagaaacctttatatatatgtatatatacatatatgtatatatatatatatatgaatatatgtatatatatatatatacatatatatatatatacatatattcatatatatatatacatatatatatatatatatatatatatatatatatatatatatatatatatatacatacatacatactagcaatagtgcccgtgcgttgcaacgggaaaaacactgtttgatagtgacaccttgaaaaccttaaatcggtaaaaatcaagtctaatttgatatattaacaaataggtagaaccgagtctaatttgatgaattagcgtagaatttatgatttagttttagatttatttttcgagcctacttaggagcttatccgacggattttgattttaaaaatctaagtcacattgtttgatcaaatttgctttcgacccaggtcttcctagtcggcccaaacttgggctggcccatcttcggcgagctaattcaatttgacatcccgcaagccgagcagctgagcgcggcccacatatgcggggacggtccgatgcacttcgacggcccatttggcacagtgtaatcagcggcggcggcggcggttttttaagtagtatttttttcgattcggatctatagtttttttcaccacttaggggaaaaagacttttgttgttgttgtttttctttattttattttttgtgtggcttttctttttctttttatgcactttctgccttcattctcccttttattatttttttaacaaaaacgacctcaagtaccttattgcaagattatagggactcaaatgtaaatataaaaattacatggactcaaatgcaaaagtacaaaccaaaaaattaaaatcatataaaatggaatgctctcgaccgtaggttccgtttttgcaaatatatcttcaattcgacacatcaatttttcaccaatgtagagtcagactttttttttcttttttgaaagggaagtcggacttttttttcttttctaaaagggaatcggatataggtgtcggacttttttattttattttttcgctattatttttttttgacggacgaaggaagcatctctcattttgacttttattgttgttgtttttctttattttattttttgtgcggcttttcttttttctttttatgcacctttctgcatttgttctctctcttttattatttttttaacaaaaacgacctcaagtaccttattacaagattttagggacacaaatgtaaatataaaaattgcagggactcaaatgcaaaagtacaaactcaaaatttaaaattatataaaaatggaatgctctctgtaggtttcgtttttgcaaacagatcttcaattcggcaatcaatttttttcaccaatatagagtcggactttttttcttttctaaaagggaagtcggacttttttttcttttctgaatcggatataggtgtcggactcttttattttatttttttcgttattatttttgttttgacggacgaaggaagcatctcttattttttaagtagtatatatatatatatatatatatatatatatatatatatatatatatatatatatagaactactatagagcaccctaaggtgctacgtattaaacagcacctgatacagcttctaaccccacccctgcaccctcccaccctgctccccaccaggtccatagtacgtagttaaaatttaactcaccaacgaccaatctcga

SEQ ID NO: 64098 - DNA, 22419 bp, Oryza sativa
  unsure (1)..(22419): unsure at all n locations
cgatccaatggtagtttccacgcttacactacatataaggtttgtgctatatatttttttctatttatagagcccatgacttgcggggagtcaaaaaattactacctgtagaacaagggcctaatttttactgaccctgaaaatctgcttccgttaagtaaatgttttactggtagtgtgaactgaataaccgagaaaatagggattgggtggccacgtggagatcagcagggggagcgctctggctgagggtgcggggaaaaacgaaaacacgatctgtgggagaaaaaacggaaaaaccggagaaactctgcgctgtgtgagtcgcgccacgatgttgcatagcgcgccatgatccgtgagtcgcttcgtatagcgctaccgtatatatataactactatatggcaccctacgtgtcatatagctaaatagcacgtctcaacgtaagccctcccctccatcctccacatcctccacccaccacatcaagatgttaagtaattttttaactcgcgaacgaaaacataaagcgctaccttattggatgagagacacacgaaggtgcgtagtaaaatatttactcacgcgccatgtgcagctaccctctttcatattgagatgtttagttatatttttacttgattaaaatatgagtatttataccgtaggaaatcctatccaaccattccttcctccgtcaattactccatttttttgggatctacggcacggcagcctcaaccgtgattccagcagaggaaaggatgacgactccttcaccgcgcgcttgccagcgagggcttgatggctgcggccaccggcgacgaagaagatgttgaggaaacacagggctaccggatcggaaggatggcgacgagagaagccaaagatggctatgggcgttgtcgctcccctggtctagccatgggcgacgggcgccggtgtgctttccgagccatctccgccatgggaggaggcgtttgacagtgttgtgggcggtgtcgctcccatggtctagccatgggcgacgggcgccagtgtggtgtcctggccatcgccgccataggaggaggcgtttgtaggcggcgacgttccccttatgttgcggctggaggttggctgtccctgtgctatgcttggattccaggcaaatctggcactgatggctgacattgcccgtgcatggccacacctgctgctcgtcaatttcttccacatctacaagctgggtcctcaccaacaccggtgtcacctctcatgttggtccctagctgtgctctcctttatctcctctctttcaatcaaaggggtgggtaacaacaaccctcttcttaccagtagaacaaatatatgtttcctcttcgatggtgcggtcttaatttgcaacagtatcgccttacatttgctcattgattttgttgtagattgccagcacccaaagacagccgaggacttcctcaagcttagccccagccccaaggttgattgacaaatgaccttgattattcgtgcatacgccaacggttcacaatccacatgatcaacatttgcattttagtaaagaatgtgattaccttcttttgtttagttgccgctgctagcatcctacgagctcattaatctgaactaggggatgtttggtttcgattgtgaattgttgttcaattcttaggattgttatctgaatggaatatctgatggtgattctgtatcagagtatgtactacttttctaaattacatatgactaccacccattatcaaaatccatgcataaaaaacagaatcattttttattggctcagacctgggctgtaggcaggcactagaacggataccctcatctcaatcgggcggtaagccccatctcaatcaggcacagcgtccgtcacaggctagaagtcactgatgtgaagagttatctcaatcgggcaaatggccgtcacgaatgaatatatctcaatcgggccctaagtaaagcccgtcaccgaccagtcaaactatagcccgtcacagatgacctatctctatcgggccacaactagcgcccgtcacagatgactactaacctttatcgggcctaaactagagcccgtcacagatgatactcatctcaatcgggcctaaactataacccgtcatagatgactgatgacctcaatcgggcctaaactagagcccgtcacagatgactgctgacctcaatcgggcataaactagagcccgtcacagatgactagtgacctcaatcgggcctaagctagagcccgtcacagatgacctcatctcaatcgggcatttagttatggcccgtcacagatgactataatccacaaaaaaaataaattttgttttttgtctagcctcaggcctttgctagccatgcccgctgcaaaaatgacagaaacaaacacagatatccaatatcctcagctccccagcatcacccattcatacatatgcattcacatacacagacatcaacatatttcacacaaccacacattcacagccatctcatatttcacatccattcacatatttcacatccatttaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaatttcaacattgttcatcatttcagtttaagcctaaacattcctttggggttaattatttcgcggaggatgaagctggctatctcctcgcgaacctcctcaaagctggtagtcagagacttggttattgtgccctacattgtcataattctagattagttgatcgatcatatataagtactaaaatgtagttagtctatcacaattgagaccaccgacctcaaactcagccaaagtcttcaccttttctctatacagaagtcgtatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattgaggtccaatcatatgcgttcttatcaattctggagttcaggtaatgacatgtactccatttaggtgttatgaccagaaggatccaatgggcactgcgacattaatatagtgaaagttaattaagtactcaaggaatgtgtcatgctgttatgtcttactattgattataggcacacataatgtactccttgtctcggcgggaccacaaggtgtcgtagatgtagttgaccattccttgacggtcattctggagatttgtgacagtgaccacttgtagatcaaggaaggcaacttccggtgcatgcttcttacaccattgccaacttaacctacacacaggatcaacgatcttgtaagcaagttaaaccgattgttattaccagaatgagttgggcgacaatacttacaaggagtagcacttaaggagacttgtgtccaccgctcggagcctgtagaggtcgaaaagatccttgaagtcgatcacgacataatttattggaccaaggaatggctttccatcgtgctgtccaagtatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctccccttttcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcatgaggggctgaaggagcagtggcgggtctctttggtggaggaccgcctggtgcagtggttggcctcgctataaccctgatctcaatgaggtccttaggccattggatgaaggtaccacgggcatttcctagtgagaggacctcgtcgttcggtggatacttcagagggaacagctcgtattcgggcttcaccgagtcgacttgaacttttgcacagtcggccctgagttgcgctccatgcactcttgtctctggggtcggcttgtacgcaagtccctcggttgctagaacagtgaaggtcagcatcaccctaactgtgagggtgcagctcgttggttcctgcgatagattaatcaatttttttagaatattatatatcatatggattcgttacatctttcatgtattgagtaagttcacggttaccgttatgtggtcgacggcgctgtcgaccgatgttggattttctgccaattcagttgatgcgcaactgctgcgtttttcggtgggacttcctaactctttgtgcgcagcagcagcgccggcctgggggatctgttgctcttctcggatctcttgcctaatcttggccctcatcgactcgagcttttcgtcgaattcagatgtcagcttagctcgtatcgactcccggatcttggcttcaagtcgtgcatctttctccgccttgttggaagtccgcttcttgtactgccacgcatagtctggaaatccatacttccagggaacagaagacccaacgccccgtgtccgtccacggtgttccttgttgcccaacgttttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgtacgattcctctgcttcttcatcctcacgctgccattcctcttccttaccggcatatccggcggtaccaagccggtgcggatgctggttcctggtctggagcaagcgatatgccttgcttctagctctggactcgggggtcgacttcttcgcatggaattcctcccagacctgttccgtgatccaaggaaatttctctcttggatctggatttgccgggttgtaaacgaactcgccgactagcttagtcttgaagttcttccaagcagtgcccataaccttgaaagcagcccgcctgagacggtcctcatgctccgcaggataatcaaagctctccttgaacgttagcgaagcaatgtccttctctgcggccggcacgagcttgaagtcgtcttgcagaatactgaatttctgccttcctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatctattaaccacatttcacaataatttcattaatgcaccacatttcatcccaacataaataaaccacatttcatcccaacacgaataaaccacatttcatcccaacataaataaatctcatttcatcccaacataaataaaccacatttcatcccaacatgaataaaccacatttcatcccaacatgaataaaccacatttcatcccaacataaataaaccacatttcatcccaacatgaaccacattgcatataaataaagttaaatgaaccacatttcatcaatcactacaatcatctatcacaaaattcataaatgcaccacatttcatcccaacatcgacatgtctcactaacagttcaatcacatatcatccacatccacatttcaatgacatgtcattcacagttagcagagggcggcgcaatggaggactcacctgaggatggccggtggggctcggtggcggtggcgcccgggctcggtggagggcggcgccggtcggtggagacaccgatcgggcaggtcggcaccgggcgggcggcgtcgtgctcggtgggggtcggcgacgtgggtcggtgaggacgcgggtggcgactacgaggaaggccaacaccggtccggtcggtgtaaaggctcggtggcggcggcggcgggctcggggggggggggtcgaccgtgaggaggctcggcggcggaggtccgaatggagggcccaggaggctcggtggtgacggcggcaggcttgacgagggaggacgactgccgcggcggcgggctcggtggtgaccgcggcgggcttggccagggaggatgacggcggcgctagggttctaaggaggcgggaaactgtaccgggacttagaaaaattttcgatccgctctgagaaaccctagttatattagagtgatgagtcatctcaagcgggctttgccgtagggcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcccatcaccgatgactatttttccattttccaggcaagtctttatatttgtgagtacaagatatatagctgttgtataataattcattttattagtcataacatattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaattactaaatgattttaaatggaaatatggtcaacaacaaagttgatcctctcatcaagatctacaacttttattttggtcatttatctatataactttgtttcaaacagcttgaaattgattttgacaatatgacaaatataatcaacatttgtaaatactaaatgatttcaaatggaaatatggtcaacaacaaagtttatcctctcatcaagatctacaacttttattttggttacttcttcatccgataaagtgatagttatagttattcacaaaaatcacatttctctcatctggtttataaatatcaacacagatatgtcaattttgtaaacattggtactatcactttgtcggatgaagaagtgaccaaaataaaagttgtagatcttgattagctgtacaagttagctgtttatggctttcccatttaaagtcatgtaatatttacaaatgttgtttagatttgtcatattgtcaaaatcaatttcaaactgttggaaacaaagttatatagacaaatgaccaaaataaaagttgtagatcttgataacctctacaattttgttgttgaccatatttcgatttgaaatcattgtcacttattccgnaagagattacttgctctactcgcactctacaattagaaaatggaaattatttgatacccagcagctatatagttttgtactcacaaatatacaagacttatctgggcaaatggacaaaatagtcatcggtgacgggccttagttcaagcccgatcgagattaatctatctctatcgggcattatcttagggcccgtcacagatgagtcatccgtgacgggcctaaatgcaatctcaatcgggcattagtatggagcccgtcaccgatgagtaatcttgacgggccctacggcaaagcccgattgagatagattaatctctatcggctgtaaactaaggcccgtcactgatgactcattttccatcttttatttgttgtgagtgcaaaatatatagcctatataatttttattttggtcattattctgtataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatgtgtaataaaacaaaattagccatattaatgactacacatatcaagtctatgcaataaaacaaaatactttattcattacaatagataagtacaaatgcatcagccacaaggttatgccttcggtatgatctgaacgagcatatgccacaggctcttggggatcatcgtcaaggtcaatgtgaggtcttatatgaagattatggttgttttcttcttcatcgacgacgttgtcaactcctacaattcggcgctttccatccctcacgatgtgcatcttcttgtttgaagggtcttttatgtagaatatctgctcgacctgtttcgcaagtacaaatggttcataggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgtggccgtagtatgtgtttgacccaacttgatcctggaatgcatctatacggatgccgctgttttgcactgtgcttttgtcatcttgtttgacggtgtaaaatgtgtatccatttatatcgtatccttgccatgtgtctatggtccaagacggtcccatccccaacaactgtactgtctcatttgggacaaccatggacattgtcacacgattcttgaaccattcgttgaaccgagaattatgttctctgttaatccatgcatcagatcgccccaagttctcatctcggattttcgctaagtgttcctcaaagtatgggccaacttctgccatatgttggagcatagcgtaatgagcctgcgcgtacgacgcttgatcgggcctaattcttttccttccgattgtgccaacacctgacaaccttccctcgtgacgagacgctggaactccgataggatcggcatcggacatgtaattgacacagaactcaatagcgtcctcggtcgtgtaaccttcaatgatgctcccctcgggtttagctctgttacgaacgtacgacttcacaactcctatgtacctttcaaacggccacatttcccttagaaaagccgggccacatagttttgtttgcttcaccagatgaacagggagatgaaccattatatcaaagaaagacagtgggaaaaacatctccaggtgacagagggtattcataatatcggtctgcagcccatctagatcttctggatctataaccttctgtccaattgcattgaagaaggcgcacagacgttgaatcgtgtaacgcactttcggtggtaaaatgcctctaatagcaactggcaagatttgtgtgattagcacgtggcaatcgtgagacttcattccaacaagttttagatcgtccaatttaacatacttatcctcgctgaatagcccgatggaactttaatatccttcaagcatgataacattgcgatcttctcatccttcgatagtgtgtggcaggctggagggaggtacactttacctgtctctgcatctcgtatggactggagttcgctgcgaatattcatgtcctgtagatcaaggcgtgcgttcaacccgtcctttgtcttcccgggaatattcaacatcaggccaaccaaactctcacacacattcttttctacatgcatgagatcaatgcaatgatgcacatcaagatctttccagtaaggtagccgccaaaatatggattttttcttccacatacccttctcctttgtctagctacgttttcttttcttcccaaactcattgcttatgtccttgaccatattgtggacctcatctccggacaaatctttgggagcaggctgaagttctctcttaccattaaaaattttcttctttcttctaaatgtgtgacatagcgggagccacctcaggtgacccatgtataccatctttcgtgatttcttcagccaccggcttcgtgtatgttccttgcaatcggagcatgccttctttccttttatagtttgtccggaaagattaccgagtgcagggtagtcattaatggtgcaaaacaatagaactcttagcttgaagttctcctgaccatgtgcatcccaagtttccacaccttctttccaaagaatctccagatcgtcgataacaggctccaggaatacatcgatatcattgccgggttgccttggaccttggattaacaagcacaacataatatatttctgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcaaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacagacctctaaccccagtggacacagaacctgctttgcatcgtatatcgtcttgggcaatgtgttctcaacaggaagcatagccttcaaaattcctaaaagatctgtgaaactcttgtctgtctatccactacttgccttcagcttcattaggtccaaggtaactgacaacttagtgtgttttgctttgcatccaacgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctaattcttgctctccatgcttcacccaacatgtatggccctctatgaatcctcgttgtatcagatgaccgtgtacgtcctctccgctatcaaacatattctcgttcttgcaatctgcacatggacaacacatgtaattactgtttcttcttatccgatcctcctccacggcgttcataaattttattacgctctttcggtactccgtagaatgacgtttcaaatttttggcatacatccaacttcgatcaattggtacaaaataaaaaaaataaattagaggcacatattataagatcagtattgcaaaagtaagacgtgataaaattgctcaattaatgatttatattactcacttgattgatccattttgatcacttttgagaatttaatttctgttttccttggaaaaaggacaaaaaatcgcccccaacagcctcccaccaaaatagtgaacagtgggatacagttacactaggtggtggggggtatttatactgtgcaacaaatatctgtaatggccctaaaacaatcaaccgtgacgggcatacaagtaatctctatcgggccttaataaaaggccgtcaaaaaagagtgtcatctgtgacggacaataaacttatctcaatctggcctctagttggagcccgtcagaaatgaccctcatctgtgacgggtttcttttaggcccgattgagatatggaaccctcatctcaatcgggcctcaactatagcccgtcacagataagtgtcatccgtgacgggctttagttttatgccgatataccatggctgtgcgaccatatctcaatcgggcgaaacttcggcccgattgagattacttccttatgacggcccgcaaattccagtcttgttatgggccgtcacagatggaaggatctgtactagtgaggtcagatctatggcgcatggctggtgatgtgcgatggtgatgggtcaaccgatgtgtggactaggagcctgggacgcacggcgtcaaggccgaccacgtcgtcacgtggtgaagcaagccaggatagatgcttactatcgccggctatccaatgctgggccagctgttcttcctcactcctagaagaacatatttcttgtttttgtgggctagcttgatgtgtaatattttttcacccgcatagtgacttctacaatgtttgtattatttactcataatcaaattttcatggttcaaggtaacaaaacgaacggtaacatattgctatttcacatattattctaagataaatgaagcaacaaatgagaattcatgggagtaaaagagaacatgtagtaaaatacatgagtaaaattattactatgaggacatgagtaaaaatattactatgagaacatacgagtaaaaatattactacgaggaaaatatatccgagtaaaaatattactatgacaactcgcaaaatatatgcaagtagaagaattaatgtgagaactatatgggagtaaaaattttactaactttggagagatttttaccaaataagttatgtcacgcccagaaattcacttataatttccgaactaatttgtgcataaaatcctcgtccaggaatcagccgaggtacacaaactgacaatttaatattcaaatccatcataataataataacgttacatacttacaaaagaaaagaaaacagcagcggaattaacggtttagcaatggcttcagctccactcccacaggcagctcaactggggtataagccaaacgtcttctacttctggatccttttttttcaactgaggtttgatgattattgcaaggtgagcatatgacatactcaacaagccacacagcaaatatgcaagtgcacaaggataccaaaggatggcataatataggctcatttgcaaaagcagcatttagcaaagatttaagagtaaaccagtagagtaattaatcagaaatattaatcaacactgaacagcacacccatgctgctcaggcccaaccatccagaacaaccatacccggctgtacagatctaactccaaaccaggagctaaacaaattattaccagttattgcatcaataattatttgtgagaggtatgagactaatcacgaaaaacattgctcaacccgcccatgaccgcgggcacggctattcgaatagttttactctagccagagatgtaccattatacccacaagacacgattccacacatattgccataccccgaagtaccaccacggcactgcaaagggactccacagcgacccccatggacttctcgccgcttctcagtctggcaccccgtaataaactatgctatacaaaaggtaaagccgttgcccacgctggcttgtggttggcacggttaatgtctcacaatagtagctcgcgaaccggtccttaattgccatgagcacgaccttcaaaaccatgtgctcacaacccaccatcgacaagttttaattatcatttaattatcataacacgattaaccatcgtgagctaccattaaatataaccataaataataatgtagtgtgattcatcccattagtaagctaatgtttctaagcatggctaagcaatcatatatatatatatatatatatatatatatatatatatatatatatatatatatatatagcatttagctgaaccaaaccaatatataaggttctagctaatcaaattataacccatagaaaaataaagtcatcttcggccattaattaattgggaaaggctcaccacccgatgacattcgaaaataatgcataaattgaaataaaacattagctttaaacgggttcaacatgctcaaagggttgtttgggatctgtgtgacttgccttgcaataattagtcttcaattagtctttttaacacttccgacgcactcacgaaccttcgcaacgacggaaacgacaagctaacacgcaaaacgaagaaaaagactaataaaaaccaaataaacagtacatataatgtaaacaaacatgtagatcatgattttagatgaatttagagacttgaacggcctcattctgatttcatataaattaattgtgaattttaaaagatttaactctaattaaacctattaaagaaaagactattccaaattaattaaacaatttacaaataatttatatctgagatataagactaaagcatcctccggaaattattgtaatgaatttagtagacgacatatagtaaaaagaactaatatgtcattgaaaagagataacaggatttatattgattttgatggccaagatggcgctgatgtcagcgatgacatggctgccacgcgggatcgacgccggcgagcacgggaacggcggttaccagcgaaccacggtacaatgatgcaaaccgagggcaccgggtgagagaggagatcaaggcgacctttaccaccacttacgcgacgacagacggcgagggagatggccgacggcggcgaagtactgtccacggcggcgacggtgtttcggcgacgagcagcagcaacggaggggtggacgagcttctcctcgcagctgcgaatccaatggaagcgacggcgaccaaaggcgaccatagacgacaacgaacggcgcggctggagatcggaacatgacggcaacccactggttcatggtgagattgacttccggcgaggtttcggcgcaaggggaacggcggccggggtagctctcacccttgcgaagccgagggaggtgacggggctgaccggcgacggccgaggcgacggcgcacggcggctggagaggcgaccggaggtggagagagagggagctcgcggggaggcggctagggctagggaaaaactcgggaaaaagagggaacggaagaggaggtcttgggactgctatttatagccggaaaagggagagatcggctcgggaacggaggaatttggtgtaggaagctaggatttatccgagttcacccgaataaaaacggccaaaattcgtgagatagataacgaatttgatgggggtttcttgtggataagatagaggagatagagaggaatccgtttttgcaatcaattttggaagggaagcaacggagcgaccggattcggcggagattggcgccggtatcgggatgaacacggcctctgtccagccggctggaggtaggagaagcactgtagcgagagggagtataattagactttaggctgggctgaggacagagagaagggatgaaggaatgggccgaaaagggcccaagctgaggaggaggatttttattacttttccaaataaatcaatcaccaaaatgatctttgaattgttaaaaatacttccattgctcaaataatttcagggaaaatcctgaaaatacttggacactcaaagtacttaaaaaaattaaaataagatcatttaatgattaatttaatatttaaataattgctgaactgctctttgtatgattaaaattaagagttgagctccgaaaaatccgagaaaattccagagattataattaaccatggagaatttaataaaaattaaattcatccatgctttatatttaggaaattttatttcccacatttaacttcacttgtaaattaatgaacatttaatataaattctaataataatttattaaataatttataaatcctaaaacgaaaatcaggatgtgacaagttattactaccatctacatttctctgttctcgagctgaataaaaatggcaaacggaagaaaatatactgctaaattataaaaggactggattcagtaaaaattttactacagtaaacttttacgtttactctctagtaaaaaaaattactattgatggaaagttgaaggaaaggaaagcaccatgtacaaactttttactccagtcaaactgtgcatggatggatgggtgggtacgaattgaaaggagcataaaatccggaaacagcaggaggaaataaacctcaagtaaataaattactcctactatggatgaaacagagagagaagatagtgatcctatagtgatttttttacttttgagcgatggatgaatggcgagcaggaagcaagttattttactgaagcagtgatttttctagtggacaattgatacatgcgtaaggactataggaggaaggaaattattttttttttactgaaaccggggaggaccggtcaatgccgcaacttaagaaactaaaacgagaaaactggggaaacgatggatgcatgtggatgcggaaaaaggcaagtaagttttttactactggatgagtgcacgagggatgtgcggcaggaggagaaaaaaacggaaaatacggagggaagagtctatttcctagcgcgtcagagacgccatgtaatatatatatatatatatatatagcagcatatataaacatatatatatatatatatatatatatgctgcttgacattacatcgagctttgtcaaattattgtgacccatgtgagatgcttttcgtactttcatgatcaagattacacgcacactcgacatacacacattatgctaaatttctacactggaagctagcatctctcatccatcatttattttatccattatccacaaaataaatactccacctcatttatgcctcttgcttcgaaattctttcaaagaaaaaaaaagagaggaagagaggtatgactatgcaaaagaaaaaaaaaagataaagtcttgctcatacaagtatggagcgttgataaaaaaatgaataaaaaaaatcttgctcatacaaagtatggggcatgataaaaaaaaaagggaagaaaaaaaggtagccatgcactctctcatatttccaatgaaagaacattggaggaggaggtatatcaaaggagttgttgtcttcaattttccattttccacccataaaacaaccatacacatacatacccatacatatatcacacacatgcacattcttgatcagagagtatgacttgctatctcctttggtccggtattttggctttgtaatatatgtgatgcaggtatgcctggattgatccctaccgagctccacctctatagcctgttagaatagggacaattcggcaaacatgccttggtgaggatcgacaaataaaatcacatgagtgatctgagagaaggtcatttgaggagtacaactactttgcgaaaatataaaaaaaccctaagagattgacaggaggaataagatggacttgagttacgaccgttccattcatcaattgcccaagatggtaagtttgacactgcaaaagttcacaggtacatgtgtggcttaacatattttgtatacttgtattatatcttgggaaattttattcctcattaatccttaacctttactcgggacgagtaaagagctaagtgtggggggtttgttgacggctgttaagtgccaaaataacaccgtcaatacctgtataaaatcataaatgtgaaacatctaacatagtggtaggatgtatttctaacaatttccacgagtgttggtgtatattcgtatgcaggtgatagagagtgacatgggagagagtgagcataaagaatggaaatatattttgcactaacggactcacatggttttgagctacaatatataaaatgtgcaatcatttggagtcaaatcatggagtatcataaaaatagggcccacatgtcagcatcctgaaaaggatgtgggccaggggaactagcagctagcccaatccagcccaacttcggtatgacggttgtcctcctcatcctatgacagttacgagcgttaatactggtagaaaccgtcatcaaaaggacacatggcaagaggagaaggaagatgctctttggattctatggagaatattgcgggcatctccactctctcaagttacctccacactataaatacccctctcttctccctcattcacacaaaccaaagcatgagctgaattacaagaggctctagtgtattttattgtatattagaatagggagagtgtaagatagaaggaattggaggaatcccggagttgtcggtaatctcctcctatttttgtatcttgttaattactctgctttaatagaaatatcatcctgagtatttaagattttcttagtgagaattacttcttggttagttcctaattagcatacaggatcattgttcactatagtccatttatttataatgattgctttagtgtttgatcggcactagagtagttattaattgcgtagacgcggtgtctgggtaattaatctccagtggttgctgcgtatcgcacagtacatttgaggtgggtgtagaggtggtgacagccctcaagagcactcaaatcctccctgtccgggtacgtagtagagcgatatctaggaatagcgggttgccagtgcctgaagtattgcgttaggattaaagttaagctttccctagacaatatttctcattaggaaattctctctgtcctctgcccacattagctttgtttccttggatgaaccggaggaagagataatcacacacgttcctttggatttgatacccttggaatactccgtaggggaagtgctacatcggtatatccgtgcgcttgcggattctatctggatcgtaagaaatatcaacattgttgcaatatcaaagaatgattgcaacgattcatgtttgcgttgcaatacctatagactaattcgcaacgatttaggtttgcgttgcaatacctatagactcatttgcaacaaagtagtttcgcgttgctatatacatgaatcttataacaacgctctaaatttgttgcgacatggataactattgcaacgataacaaaaagcgtggcaatattgtcaccctaattacaacgcagatttattcgttgcgatacttcctacttattgcaacaaaaaaaattacaatcgcaacactacgcaattagtggcaatatgcccccctatcgtaactaaattagacttcggtagcaataacccctatgtattgcaacgaaaatcacgtcgttgcctaaaatttcgtggcattagcccgaaaaccttgtagtgactaggcaaactctaacgggagataagctagtaacacaaaaattaattctacccgcctgttagccttgcaccaaagcaacttgtatatgctaaaaattgaagcaattgcagaaagtgaacttgaggccagcacttaaaagcttgaaatgaatttgagagcaagagaggttgcgaaggggagtggaaaatgtgttcaaatggggtgaacttccctccgccggccattctcctcttatagaggtcccataggctataactgccatatggggtgtggggacctgttaacgaccaaatttggtaagatgtgaaccaggttcaacattaggatcgaggcgaattcgatgaagagatcgattcgaagaacagagtatgcatcggctgtgaaggtatcggctggagtgtacattggctgggatggatcggacagaggatagtcgatacagccgatggaggcaatgcaaccgattacgatgaagacagcttcgaggctgtttttagaatcgttcaaagtgcttcacaaggattgccacgatagagataaagctctcggtttgggcaattgtttcaattaattaggatattttatgtaatttccttagagatatgtttgggcaaaagtctatcgcaaagacttattgtatcttagagtttgttagagataagtgtcgtgtccggcaaggacatattttgtatctcgggtataaatagagcccgaacccatgtaagcaaacaacacacgttcaatacaatctcagcgcatcgccacccttttactttcgtttactttcgacgagttcttgctttcgggttgagctgcatcggtttcgatcttcaactagaggtaaagcttgttatggcggcttgcgttctcgggattagtgcttttatctttatgatactctaatattgtttatgtaattcgtcaagttatcatatatcctatataatctcttgcaatattgttatttaaccttcaattggctgacatctatcattggaaagcagccgattaggttaaatactaatgttgacttagactatataagatatccaccaccctatgaaacattcaatggcttgattgtctagatattgtccttcttttcatatttatagctgcatcagttgagtttgatcttataagtcgtcattagaatctcaatctctagcctgcttttggttgccgattagggcagtatcggagtttccgccgatcttacctgatttaactcttttatatctcatatgcttgattgagatattaaatccgccctttatgttaagatcttgttgcgtttaggtatattaagctttccgtttgatatattttgcttgctttaatatcttaatatagagtggtatcggagtactagccgatacatgctagatctatctgatcggctatgctatgaatgcttataatctccttgttaatatatatttcgatctaagtgatttatactatctcggcatggcgatgatctatcccaatcacttgatttaaacatatatcgacgaaagcattatataccattgatatctacagccgattgaatagattaagttctttcttgcctatttataactgccgatcgactcaaatatgacatcggctcaaagataaatgatacgtcatcgacgactggctgatcggctatcgtttatagatttaaccgctattttcctgtctttatttcttgttaattgcaggatcaaatcaactggcacgctcacaaacttaaaggcaagattttttggacctgcactggagttaagcagatctcccaggcctcgtgtttttcgcatcaacaagacccccagtttaatacaccggaaaccccatgtgtcttgcaataccactccctgaatcaataggtggtacacatgtagcacaattgaatatcacaagctgacattgtttacaggtatttctacattaataatactagggtagcccaaacaggtcccaaaatagaccaagcatggtcatatacattacaagataccaaaagaaatagatagggtagcggaagcgaagcagcggcgatccatcgtactccacaggcaacgactggtgaacctagggtctcaaatccattgtcttcgacatgcactcgacagcattgcataaatataatcgactccaattcctttctaaaagatttaaattaagcaagggtgagtacatacgtactcagcaaaccaccactacaaaatgcatctggtgctcacaggggaccaccactacaaaatgcatctggtgctcacaggggttcaaggatggcttggtttagttgcataaagctagttttcacaattcatttcataatcctatgacttagcagttttaactgaaaaacaatgttaatgttgaagttgtcattaatcgagggttcatccaccttcccacgcctcgcattccattttacaccaactctaccatattcccgcacatcgggcaaggttactcatgtcttctcttctctaaactaagcaatgttaaaatctactagtagcatacccgtgctaacgctacggtgacaactaatattgcaaatgaaacaaccaaatgacagcgacacaatatatgcttcatgaatggtacatagaacagatagttaggctaaaaaagcgatagagttattagaaaaaaaattaatcaacatatctatccacaataccatctaggaacaagccatcccttgcaatgctataaagtacaggtattactcctctcaaatacacaatataataaatatctaaaattagcttgacttaagccatccatttcgcttgatgtggtcctgattatctggacaaggttacaaaacaaccaaaacgtatattgtcactctagttatttgtatttacacaaaaaagaatattggtcatttcataacttgaa

SEQ ID NO: 64099 - DNA, 19002 bp, Oryza sativa
ctacagactcatacatacttgagtctagttgaaggttcaggctttcagctcactagtacagatccttccatctgtgacggcccctaataagactggaatttgcgggccgtcataaggaagtaatctcaatcgagccgaagtttcgcccgattgagatatggtcgcacggccatggtatatcggcataaaactaaagcccgtcacggatgacacttatctgtgacgggacatagttgaggcccgattgagatgagggttccatatctcaatcggaccctaaaagaagcccgtcacagatgtcatctgtgacgggcaccaactagaggcccgattgagataagtttaatgctcgtcacagatgacactcttatttgacgggcttttattaaggcccggtagagattacttgtatgcccatcacggttgattgttttagggctgttacagatatttgttgcacaatataaataccccccaccacctagtgtaattgtatcccactgttcactattttggtgggaggctgtagagggcgattttttgtcttttttacgaggaaaacagaaattaaattcccaaaagtgatcaaaatggatcaatcaagtgagcaatattaatcattaattgagcaatttcatcacgtcttacttttgcaatactgatcttataatatgtgtctctaatttgttttttattttgtagcaattgatcgaagttggatgtttgcgaaaaatttgaaacgtcattctacggagtacagaaagggcgtaataaattttatgaacgccgcggaggaggatcggaaaagaagaaacaatgattacatgtgttgtccatgtgcagattgcaagaataagaatatgtttgataacggagaggacgtacacggttatctgatacaacgaggattcatgaagggctatacatattgggagaagcatggagagcaagaatcaggaagtggagaagcagcagacagaagtggtgcgcataattaggaagatgaagatgagcatgacatatttataccttctctattgggcggtgaaatggttgatgtggatcacgatctgctgcaaatgttacatgacgttgaggacccagccaagaatgagagagatggaatgaagttcagcaggttggtcagtgattccgagacgcctctgtacgctggatgcaaagcaaaacacactaagttgttggatagacaagagtttcacagatcttttaggaattttgaaggctatgcttcctgctgagaacacatttcccaagacgacatacgaagcaaagcaggttctgtgtccactggggttagaggtccgtagaattcacgcttatccaaacgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcatttcaagagaatctttgccaacccgaacgaagcgaagttagtacgttggcacgccacagagagaaggaatgacggtatgcttagacacccaggggattcgattgaatggaggaatatcgatcgaaaacacaaagactttgctgttgaccctagaaatatgaggatatgtctgtgtacggatggcatgaatcctttcggtgacatgagtagtactcacagcacttggccagttcttattgcgaactataacctcccgccatggttatgctttaaatggaaatatattatgttgtgcttgttaatccaaggtccgaggcaacccgacaatgatatcgatgtattggacgaggataagtaagtatgttaaattggacgatctaaaacttcttggaatgaagtctcacgattgccacgtgctaatcacacaaatcatgctagttgctatcagatgcattctaccaccgaaagtgcgtcacacgatccaacgtctgtgcgccttcttcaatgcgattggacagaaggttatagatccagaagatctagatgggttgcagaccgatattgtgaataccctctgtctttctttgataaaatggttcatctccctgttcatctggtgaagcaaacaaaactatgtgtcccggcttttctaagggaaatgtggccgtttgaaaggtacatgggagatctaaagtcgtacgttcgtaacagagctaaacccgaggggagcatcattgaaggttacacgaccgaggaggctattgtgttatgtgtcaattgcatgtccgatgccaatcctatcggagttcctgcgtctcgtcacgagggaaggttgtcaggtgttggcacaatcggaaggaaaagaattaggcccgatcaagcgtcctacgcgcaggctcattacgctgtgctccaacatatggcagaagtagacggatagtcaaacgttagacacagaaacctaggaattgagtctttttggaacagagggagtagatgcaagggcacaaaactcggtaagggtgaaaaaaggcattatattagttagcactaacctccaggctttccaatattgacaagattaacaaagaagcatgaatatggtctggtctttaatttgtcatattcctttttcatataagattttttttatgactcgaggaagtaaataataatacaattatttcttgaacatgcataatttatcatgaaactaatttcgcactgtagtttatcttatcaaaagaagtaacacatagcatgagagacgcactgctaattgtgcctcctgcaaggaagaaagttagtagagctaatcgtttgatagtagtgttagttccaaaggctactgcaagaaagagagaagcagattactcttatcttttagagaattttcttactatgtatgtaattctatactaagtaattctgcaatatttttcatgcacaaatcctccttcacttcagtttctcatatactcaatcctcaaacaaggagggcagagatacctgcctcaatcacaagagctgaaagctttcaaaaatttgatgaagctacattgaaacttcagtctgaagacctgaaacaccaaaaacaattgatagtttgactccgaattgatttgtgaaactattctaaactcaattgcgtaaattactaaattggattgaatacaggattggttatagggcattgagtaaaacttctgaaacatttgcaaaatcaaaattgtaatcttaaaacctaaacagatgcataaaccaatcagtaaagaacgcaaggcaagcttaattaacctttgcccgtgctgtcgcagtagttgttgcacgcacattagtattgatccagtccaaaccagttctccatgtactcatctaggcttgcatgctctgtggcaaccggagagaaattccacttgttagaactcttaacccacaaaatagagagctaaagactaaaaccacagtttcatctataagaacactcaatcctcgatggagagctaataactgaaaatgcagttaggattgatgtgtttcaccttcactttcctgcacatgcaggatgacacctcagaaaaagaacaaaatgctgatccatcgtgcttgcccattgcagggagtcggcgtcgtcgcacgcgaaggaggggtgtcggaatctacggcgcccggcggctgctgtgatgcagttggagcggcgactactgttgggttaggcggcggccagcgttgcgtgtgagaggatgccgggcgtcggtggcgccgcgcgcgaatgcggggtgtccgaaccgacggcgggcagatatccggcatcggcggcggagatcacggcatagattctgtgtgagattggtggctcgacatcggcagcgaccgcaggcctggactggtttgccgcaaagatcgtttttgagccgttttctcgcccgcgccgcctgtgtcagctgccacaacgccagcccagaccgtcgaagaaccaccgccaccgccgtcgtagtcttcaccagctgtcgcacctgattgtatcaaacacatttagccacaccacacacatgacgttcgtttcggcaggcgggcggagccggtcagcggctgccgcggaggagatcgtcgctggctcggcgatcttcggcttcagaaattcctgcacgaataataagaaaatctttcacaatggaagtcatcataaatcttgggcaggaaaacaagactgaatccccaaggcaacgcaatacacgtgaatccccaaggcaacgcaatacaggagaacaagacagaatccccaaggcagaaacaacacatggatttttttcattcagaggtaaactaacaatcattcagagttggcgatcggtgcggtggtagctcgtcgttgcgttgtagctcccaaatcctgcggtggcggtgtcgagaagcagcggggtgaggagacgaagcgacgcggggcaatgggctgatgggtaggaggagcacgcgaacggcggcagccacggcgactgtggcgatctggaggattagtcgtcggcggcggctggtggtaggaggaggcaggtgggcagcacgcgtggctagtgggcgaagtagtaggcgtcggcaacggtggcgtccacggcggttgcgggtgggtgacggcggcgtcgacggctggggtggatgggcagaggaggcaagcgggcagcgcgcgtggtgagtgggcggaggagtaagagtcggcggcggggaggaggaggagtaagactctgcccggcgggggatctggagcggaggcggcggtggttgtgggtgggtggcggcgtcggcgaggaagaatcgttcgtgggggtggattggcggaggagtcggcggcagttgcgggtgggcggcggtggcgagtggcgattggagtggagaaaccgtctggcagtctactgcgatggcccgtttgatatgacgatccgatggttgatattacacgtatctgtccgatgtctctgctaggaatcaagaccaccattacaaattttctaagtagtagagatgagtttagttaagagtagtataagtcttggcgctcattaaatgtgagtacggctattcgaatagattggtttactcacattgtaatagatgtacgcttttaatttaatggagatctttagtacacaacctaaacacacgcaaataaataacaaattctattatacaaactgggctaggccttccctagaggaaaaccagactttatctgagaatgctatttcttttaaataaacttctaggaattatacttcgcaaatagagtttttagtaaatactttactggtagctattatttgcaatatagttgccaaaagacttaaccctttacagggactcatagaaaataatcaaaacaatatttcttttgtaaaatagtatttgttttaatgactatcccaccgagggtgtccatccataatagtaatatataattttatttacagagcaaatataccagaggggctctattatatagagaagggtttttaggaagataactagtattagggcctgttcactttgataaaaaaaaaccttattaaaatttggcattgccaaaattttggcaactatgccaaaattttggcaacttatcaaaatttttgcagaatttcttatatagttaccaaaatttaacagcaaactaaatatagccacttttttagcaactttaccaaaatttggtaaggttgaaaatggcatcaaagtgaacaggcccttaatatatttcataatcatggttctttaattaaataatatttgaaatcaaaatacacgcatattcttagaagttcctcatttagcccatacataaccggaaaacgaaaaataaaatcaaataaattctagcatgcaagggagggcctcatcggttgccctatagcttataaaccaaagccaaaatttgaattttaaaacttgattttgaatttgattttaatattttttcaacattgtttttttttcaactttggcttttcaatcactaagaacatacatacaaaagttttactcgcatattatttttttaatcgctaataaaccgttatggcttataataagaagtgggcaaccgatggggaccggagttcaaaagatttttggttattccgaatttttaattccatattttagagtcaaaatttttagggtgttacatggggcccacaagttgtttgaaagtggcacagctgaccgttgctttgccggttcagccgaaccccttgtgggctgtaacatacccaaaatttaaaatttaaaattttgcacctaaagaattagaatgactttttcctatctaggaatcctagaatttttgcatcagacatctaaatgagcccatcatagctagaactcaaataacaatttaggacaatttaaaacttttccattctaatttaatttgacacgtaatatatttcatgtttgcattagcacaaagtgtggtgtgtgatttgagtccttttaagtgtttttggaatttaattgcattgcataataggtatcatggcattaattaaaaactggaggcaactaattttgtagaatgacttaataactttattccctaaaggtcattcaacttaaatattccagcctaatcagtggcaaactctaatatattaaattggacacacttccctggacattgtcatgagcataaagttttataaacacaataactccttaccctgaagagaactaataatttgtatagttaagtgatcaccacacacgtaatccaacttctagaattcataggaaatttatattagctttaaatattatgaactcggttttgttagattaataaaatatttttcttcatttgtatagacagcaagtaacacatcatgtacagataaacatctaaaactatatatataggaaactactaacatagaacgcattataatttgtagaatgcataagaaattcattttagctccaaaaatgatgaatccaattatgttgaacttagtatatcatgacctttcctgttaaaaaaatgaaattgtacagaacatggttagaaactacctttaaattcgaataaagcctaaatgacataattgtagcctaggacttgtaaaattcctatctcccaaaataaatgagataaaatagaaattcttttacctaaattcatataaggacagaaccttcccactgcgcacaaaacattcattttagagaattttgtatttttcgcataatttggtatttatttgcatgtcgtgttatttgtctagataatttgcattcacgttaaaggagtgacttaggaattgtccaagttgcacaagatcaaggcaagtttttcctcccccttcgtttgatcacattgaaacccatgttttgggagatgaaatgtgttgtttgcaaagttgcatttatattttattaaaccaatatttgaaaacttgggatatggtagttatccctaacttgctgcataaactcccttgaattattgtacacctctccatttgtatacttaggaatggttagagtacaacacttgtgttcatttggggctacaaatgcttaatatgctactatgtgcttagccatgcttagaattatgcaaataatatttatggtcactttataaatgaaattttgggtattattttgctgctgtacagatatgaaaattatgattatttctgaactaaaaatgaagttaaacttattttaggcttgggcgacaagtggtgtgcatatggtggtagttgcacaccaatagggggagtgttcgcccgggtcgattaaggaacgaacttcgtgtcaccctctaatgtttaccgtgcatcgatatgagttattatggggtaaccttggcctattaagttaagtatgtctctaaccttgtactcgggaggctgttctagtaaagatggcggtcacggtttgtggagctatctttaggaactacctatgtgtgtgtgtttgtttgtaggatgactagttccctatgtatgtgttctatgggggacagatgttccacctcacagcatgggcgtctaagtccgtccaatacaatgatagcatgcctcgtgggggaacggatgtgttcgccgccacagcattaggttaaggcgtgggccctccacctaacggctctaggacttaagcctagggtggattcacacttatcgtgctcatgcaaggttaggtacttcttaatgtaaaagctcgttgtgtcctctagaccacactcaatgtgtagagagtggtggtaccgacgggtaccggacaaactagagcgattcatatcatgtgggtaaagctatacaaactctgcagagtctaaacctaatcgattagcaatgctcatggtcatgagcgacatagtgagtggtatgggtatagttttatgatttatgttttcaaattgtgattgtgaaatataggttggaaaatggtaactagtgtagaattgtattgattatggtacatagatgaataatgtgagacttgatgccggtttaggtatcaagaatgattataatatgatatatgataaatattatgatatatctatgttcgtgttttgtcaattgaattgtcaactctctttacaaatgattgtgaactaaaatttgtctttatgctaaaatttgagctaaagaaagccttcctttgaattatggccttacatgtagtatgttaggcttgttttgtagttgtcagtacattaatttgattaatgtactgactcttgccaattgtttatgatcttgttttgcaggtagtaggtttaaattatgtttagtgattcgggtttcgactacttcttctaggacttgattcattaggggtctaccactagtcggctgcttatgggaacgggtatacaagcttccgcagatcaatatatattaggccggttggcctgctatgatgatattaagtgcaagttccatattggtcaggattttgtgtagaccttgccgttatttttggtcattaggattgcaagaatgtcttttgcatttgtgttcttggctaagctattgtgctatagaccatactacagaaatttttttcatcccatattgctattaaaggatcagaaacataggcattgaatctttaaatcaatataacgcctgccaattgcttgcataatcattaatttgattgctagctgtgagcataaacttttatagaacatgcttgatttaatttttatttttgacaccagacctgatttaattttcattttaaaatgaaactcctgtacaattagagtattaaatgtagactaaaacaaaaatcaattacacagttcgctaggaaattgcgagacgaatcttttaagcttaattgtgccataatttgacaatgtggtgctgcagtaaacattcgctaatgagggattaattatgcttaataaatttgtctcacagtttcttggtggaatatgtaatttgttttgttattagactatgtttagtactttaaatatgtgtttgtatatccgacgatgtgacatgcagaggcaaaaaattttgctacctaaacaagccctaagcctgcctatgttctgatccgtatataaaagttgactttattgtgggatagagagagtaacaggacggtatctacttgtagggatgctaatataggctgtgtttgctgctcagggttcctaaccattctttgtcgttttccgcgcatactttttgaactgcggtgtattttttgtaaaaattttctatacaaaagttgtttaaaaaaatcaaattaatctattttcgaaaaaaattaactaatacttaattaatcacgtgttaatggaccgctctattttttttacggagagaaagagttcctatacaagatctccgaacgcagctatagtactgtttagctgaccattcgccataagtaaattgggcgatgctccggtgctctctgtattatactacaagtagaaaagatttgtaccgttcattattaaagataaattagtaatttattaatataataagggtaacttagccattttccatttttccacctcatggatcggcaggtcgatggcatcaagcccatgcaccttgacttgctagttggctgtgagcctgtggctagctcggcacatcgtccagatcgattccatccagaaattaaattggatcgcaagttatggcggcggcgagtggcaagtcctccgcccggcggcgcgtgttgatcctgccggcgatgacgcactccggtggcgtttgaatcttataaatatgaagatgaaaattaagtgtttcatataaaataaggtggtaataacatgtgattaattaagttataattattacaaactaaaaaaaatagattaattttatattttagagtaactttcatatagaaagttttcacacgaaacatttttttagcagtttaaaaagcgtgccacaaatattcaaaattttattctctcttcacagaggattcgagcggggcctccaccgtgcccctttcttctcgtccacccatccccggcaacccatctgtgccaattttgcacgcatgagcatctctccgatccgttccacgcggcagcggcgcatgggctactaggattagtgagtgtaaatgacaactatacccttccacaaataatttttcctgaacaataatacccctccacgattctactaccgttaagtgaggtggtagtagaaataaatttaaaccctttgatcaagcagtccattagcgcgtgatcaactaagtattagttttgtatcaaactgcgcacggaaaaaggattaatttgatttttaagcaactttgtatcgaaatttttttttaaaaaaggcaccgtttagcagtttgaaaaacgtgcgcgtgaaaaatgagggagaggggttggtaacagcatgaaacgaacgcatctgccctgttcagtcaactgatggatgaagattatatacataaaacgagaacactattaacatattgattaatttttaattattttatacataaaaaagaaataatttatctaatattttgttaaaaagttttcgcataaaatacaccgctcaaaaatatgctaaaaaaatcaaaataaaatacgtttctttggctgtgtttagatctaggaataaaaatttttgccgtgtcacatcagatatacggaaacacattggaagtattaaacgtagtctaataacaaaaaaaattacagaatccgcatataaactgcgagacgaatttattaagcctaattaatccgttattaacaaatgtttaatgtagcaccacattgtcaaatcatggagcaattaggctcaaaagattcgtctcgcaaatttggtcgtaatctgtgtaattagttattttttagtctacatttaatattacatgcaggtgttcaaatgttcaatgtgatagggtgtaatttttttgtgtggaactaaacaccccctttataagaaaagaaaagaacagggctagcactgctcaatgctagcagtacccacaatggtcagcaacaacgataacgaaaaatggatgagcaagagacattgagagaccccatgtatccttcggggtcgaacggacatgctacgaaacccctatcctcttgtcaaaggatcattgaagtctggcctgcggcctgcccgtacttgtgatccgcctgcacgacgacggcacagtgcaatggatacaggaaacagtgcacgcctcactgctacacgttcccctccctacgcacgctaaaaaaaatttctctcccacagtgcaagggtcttcatgcgtagctttggttttttcgtttcagcccctcgcattttctatttcagtcccttgctatctttctattaacaaagaaatccaaattttacactttgtatctcgaaagtcagataatacgtatagatttctccccaatcagataagcctgaagctgccgtttcttctcccctcacaacgtcccatccccatccccatcgccggcgcccctccctccccatcgtcggcgccctctctcccatccccatccctgtcgccagcgccccttccctccctgtcgtcggcgcgacgagccgcgatcttgaggttagtttcttgggttgctttgctgcagagactgatctcctgttttttctttcttcttggactgctctttcagatagaattttttagatcggttttctgttgaggaaggcaagttctttcgagggtgatttgttgtttgttctcgatgtcttttttattgattagtactaaagcatctattctagattggtcttgtgttcatgaatacgcttaaggtgttgaagccatcaatcagttcagtgtgtgctaacctgttccaggttctcatctgggttcatgatttgaattggtttagttttttttggtctttgcgattatgaaatttcagtagttagatgttgattttctaatagatgaacagtcgtgcagtgcagtatgtcaatcggtcaatgactaatgcagctgttcatgtcttgtgcttgattcaggagagcgcgggaggagaagaaacacgcgcgcagagagggcgatttggggatgaagcgcgccgggaggaaccgcgcggcgaagacacgcctcagcaatgcgtcgtgccctcgtttctccacgccgccccacctcgatagcattgaagaacgggtgaccaaatttggtcacatgcgctcacgatttgtgggccaacactaggacgtggcggcgatttttggctgctcaactacgtggaccgctcgggctgaatgccagcagggtgcactgtgaatggcctgccagccgcgcccctgcacgttatggccagctgcagtcagctcgtagtaatggcgagctgaagtcagctcgtagcaagggcatgtttgggagttttattccgaaaagcagcatgctggtaacgagtttatgagaatcttttctagctttggtcttctagttcatttttttattctatataactataagttcttagaatctgaataaaaaatgaactctttggaagagcttttgattctgcgagaagtcacagcagctataaactatccaaacaggctctaagacatacttcctctctctctctcttataatgtgttcttatttatagaaaaattaaactctactaaaaatccattaaacttcctagattctcatcctaccatatggcacttctataaacccttctaagccgtcacatgaccttttaataaattgatggacccatagttaagtagatttacatttgcaatgaacccgacattatagggcatatattagatatgttttttaagaaaagttcatgtgcctaggtacgtgcttacgtgaaaaccacgttcggtgcgtgtagctcaccctttctattcctttcgtattctatttcaatgctatattaggggctatttgggataggaggaacttattttagtccctctcgcaaaagtttcagtccctaagtcccttccatccaaacaccaccttattaacataaaaaatcattggtatttacaacaataaataaattttaaattactaaaactgaatctcctgtcctatacacctacgtatgaacgtatgtacgccctccttcctgttctgcggccagtgttccccttctattgtttcttgtttctgtattagttttttttcaatagtggaatataatatttcggcctttgctcaagaaaagctacaactaattattacaaagtagcactcgagataatagtatagttcaaataaaatagaacacatttaaataggaaaagccaaaataaggagaacacatttattctagcttatttgtgaatctctatccatagtttgcataaagttgcataaccattgtctccaacttgcgacatgcaactttcaaaaactctccatcttcatcacacctttgtaattgtgcccaaaaccggagccaatgagttgccctgaaaattacctgcatatagaaaatagatggtgatttatcaaaaaccatatcatttctactcaaccatagagcccaacaaatggccgaagctctgacaagtatcagtttactctttttcttgtcaacccccaaaagccacctatcaaaaatatgagatatactaattggaaggttaaaaccaaaagaaaactaaactgctctccatatgaattttgcataatgacaatccataaagagatgttgaatagactcattattcatacaaaagcaacacctcaagctgccgttccaattccgtctcgccaaattgtccttagttaacacaacccctttaagcaagtaccacataaagatcttaatcttaagtggcatcttaagcttccaaatacacttatttctctcaacatagccattattaattaaagctaggtacgttgatcttaccgagaacctaccgttcttatggtagttccatctaaaacaatcagaagaacgattcaactggatatgcacaatagaagcacacaactcatgccaatatacaagattttgaccaactaaagctcttctgaaagcaacattaagcggaacagaacccatgacagtggcaatagaagacgatctccttcggacaatagcatataaatatggatatttatccttcaaggccaagttgcctagctatttatcttcccaaaatctaatttgttccccatcattaacaatacaagaacccatatctaaaaaagtactcttgactttcatgagccctgacaaaaatgataatcaccttgtttctgtattagttagaggaacaaaatagaaaacccaaaaataatactgctaatttaaattattacaactaaatttatgactcgagagccaagttaattactcttaagtatattttaacataaattcaaacggttagtagagtattgaccattttgcaagagatgtgtgcattaattatatcaaggtccttttattgtggtttttttaatagaactatctcatgatgagttgcacttaatgatgttttactacagtagtatttggtgaaaacatattatattgatttttccatgtcatgtttggagaaggactaacagaaaccttaataaggcaccaagatttattaccacgtcgtaaatttatactataatgattaatattacgaagtatcattggattagggaaatttgaccaacaccgtgtaaaatcctgccggccaaaccatttaacactctagctctaaaatctacattaacatgaactctatatgttgattgagcgttcatatgcatactccacttacacttctatcctcacttcatataaaaatgattaaatataggtattatatttaaagcgtcaagactgatttataaacagacttttatccatgtacaaaaccactaattataacaacctatggcatatatgggcctcaactacaccatcctgtaggcttcagacaagctagggagttgaatcaagggtcaccggcctgtaaggtggtgttcttctctcgtgaagatgaacgtaaattttttttacgtaaaatgaggtggtattaacgtataattgattgagtgttaattattacaaacttgaaaaatagattaatatgatattttggagcaacttttatgtaaaaagttttcacacgaaacgtaccatttagcagtttgaaaagtgtgcaacaaaattcttaatcttcatccaactcttgttggagaaaagaacatgacataagtatgaaaattctaccacatcaatgtctaaatttcatattaatcaatgtcaccacatttaagtaaatttaacaataattacaataaaaattgtggatgaccaatttggaatcactatatatcatgagaaaaagctcacgagtcattaaggaaaatagaaattcaggaaaatagaggtatatctcaaaattcatagaataattagttcaatattatctgtagatctcagctatagttttattgctcaatgtatatacatgcaatcaaaggcgtcaaattctttacgtgtaagcaagctttgaaggaccaatgactgcatgatggggggactgctatatacattgatattttacagaaactttatgtatagataaaagatattagtcatcataaaagattctaacattaatggaaaaaaagcccatggtatcgtgtgggctacctttctaatttgacttaaataattacagtagtattaactattatacatattatatcatttgacttatatttaaaaatacatttatgtgtgatactaattttaattttatagttgttagattatatataatatgaaataaattacagaaaacctacactacgcatcccgtggagacggatcccctcctcctacctcactcctctccccaaaatcatcccaatcctgtcctcctacctaactctcctctcccaaatcaacacagcactgcccccctctctttccctctcccctttctctctctctctataaagaaggccgagcggagacgaagcccgccgggaggaaggggtcgtctccggcggccgaggaggacgacgacggcactgcgtcggcgaggtcggccaaccctcggcagggtcaccctcgagctcgcctcccctcgctgcgccgctctagctcgccgccctcgtcggtcgggtgtgtgccggggagttgtcgccccgaggagggcagaagcgggagctcccctcgtccttgccctcggcctcggcgtcaccgtcgtccctgctgcggcctgtcgcttttgcgccttcggtatggacgccggcagcccgcgtcgacctgcaacaggtatggccatcaaactcctcctcggctcctcctcgagacttctcgcgctctctggctcaggcctcgctcctcacctcgctgtgcctcctcgacgccatcctccgccgttgtggccctccctctcccacgtctcctcctccttttgacagtaccctccgatacctcacaagtatcatgcttgataccttggtaccaaggtctgatacctagatatcacccggtaccttaggcaccgggcatcaggtatcggtcgatacctagttggtaccaaaggtaccaggtaccaggtaccaaccggtacctaaggtaccaggtactaggggagcacatgtccctcacctcgccgtgcctcctcgacgccatcctccgccgttgcggcgctccctctcccacgtctccctcatcgttaccctctgataccccacaagtatcatgcttgataccttggtaccaaggtctgatacctaggtaccacccggtatcttgggcaccgggcatcagttatcggtcgatacctagttggtataggttccaaccgatacctaaggtaccaggtattatgtaccaggtactaggggagcacagaggaaagaaaaagagagagtcacttaaaatattccgttgcaacggtatccgccctcaataaattaatagtcacgtacttagaatttgggcgagcagtcagcaccaatcacgctgtttctgttgacttctactcctaccagatgctacagtacctcccgtgggcccccacactcctactgcttcccagtgggcccccaaccagtccaccatctgctctgttcctgtgcaagtctgtaaccaacgctactgaccaccatggacacttggacatatcacagcacaaaacattcctcgctccatcttccgctccagtctccattccccagctcgtagtagtagctgccttcctttacactataaattcccctaccttacacacagatgtgtccaagtgctcatcaacaccgcctgactcatccagtgtgaggccgtgagggtgagtgaaccctgtagcggcagtcatgaaggtaagccagcgagcgagctagctattctactccacaggacgcatgctgcgttgtcgtcgtcttgttctactaatagtttcttgttccgttttttcttcatgataatggattgatgctgtggatgtgcacgcgtgcgtacgtgcaggagagggtgaggcggcggcgcatcccggcgttcggggagtggaactacgacggcgacggcgaccttggcggtggcggcggctgctatggctacggctaccgcgacggcgactggccggtcacacagtacttcgactccgccatgcaggcccgcggcctggtcatctccctgccgccctcaccaaaaccacccaagaaggtataaacttgtctccgcatcatcgttcattggcaacacttgcaaagaaggtaaacgtaagtgttgttctgaggcggatatacatcatgtttttttttttataaaaaacaagatttggacaaaaatcgtgcttagtttcatttaatggctatcatggatctctgacagggtaaagaagtttttcaaaaagcacgatacatggcgtttgcatgttgcaacctgacagtttttcttacggtcaaactcacgcggtaaacagatgattggacggttgtcgctgttgatctctttttttaccaggcggtgaagtggattgacagcggcgcacttggggaggaggaggtggtggacgagaagcagaggcagaggcagcacaaggtggtggtggggctggcggtggcaggaggagagcacggggcggcgaggaagcaggggaagcagagcagagtggctgacggcggggcccatgcggcgatgggctacaaggggtgcaggccggcggtggtcaaggccgtggaccgggacctctacgagatcccacccgacatgctctgcaacaagccaagggtaacgcacctagtactccgtatctcttgatctctctctcgatggtggttagtagtactccgtaggggtcgcgttgcaccagcaccactccatttgcgagcctgcactgacatttgtgcttgtctcaaaccacaacctcgctgactcgtgtgataccattacatgaatcttttctactagtagtctatccatttcacagtgctgattttgttattcctaatttttttgggcctatttagttcgggctgcaggaat

SEQ ID NO: 64100 - DNA, 841 bp, Oryza sativa
acgtcgccggccgattcccacgcctcccggccacgactcgcccccccgagcctataaaccatccccggcccctcctctctctttttcgcattgcaatcgcccgctcccgagctcttctccgtcctagcgccacgcaccacccgccgccgccggtttaactgcctccggccaccgctcgccgccattagagccgccgccaagcgacgccattgcctccgtcgggttcacgagcccaagggccacgccgtccacccctcccctgtccaatttcgccgccggagccctccttaaatcgcgcgccggtgagctcgacattgtcgccgccttcgaccggcgtctctgcccgtctcactccgtttctccctctctaatcccttccggttcgttcctcaggtcgtcctggagcccgtcccatcgtcgccgccgttatccgccactcgttgtcgctcgtcatcgtctgttaggcctccctccttcttctctctctcccgcatcgccgcctagtgtccccgcctagccgcgctgccgccgctcgccgccgtcggctgccgccttgcgccgcctccatcggcgccgcgccgccgcgcgccaggccaccgggccggcttaagctgcccgcgtgtgcacccggccgcacgccgtctttgccgttctcaggtagatcggggccgtccatccgacgcccgcgtggccgccacgtcggtgccacgtcgacgccgcgtggtactcccatccccggtcccgtggactcggtccaccatggaccagcgcatctgaaaaatgcaaagagtccattaaaaattgttttgttctctgtttcaatagtcttatagcctgtttg

SEQ ID NO: 64101 - DNA, 2409 bp, Oryza sativa
  unsure (1)..(2409): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctctaacttatctggaagattagagcgttttacacctttcttgagattgaaagccgatcaagaattcacctggggggcagaagagtagaaggctttgaataatattaaagaaatatcttagttctcctccagttttaatccctccacatgaggggattcctttcagattatatctctcggccggtgagaagtcaatcggctaagttttgattcaggagcttgaagggaaggagagggctgtattttatttgagccacaggctcttggacacagaaacaaggtattctcctgtggaaaagttgtgtttgtgtttgtatttttcttacacaaagttaaggcattatctattgtccaatgaatgcattgtgatatgtaaagccgatgtggttaagtacatgctatcggctccgattttgaaaggtaaggttggaaagtggatatttgctttaacggaatttgatcttcggtatgagtcaacaaaggcgattaagggacaagctatagccgattttattgtggatcatcgtgatgactcaatcggctcagtcgatattgtgccttggactttgttttttgatggatcagtgtgcactcatggttgtggtatcggcttagttataatttcccctcgggggaaagtttcgagtttgcctatactattatgccatatgcaactaacaatcaggctgagtatgaagcagttctcaaggggttgcagttgcttaaggaagttgaggccgatgctgtcgaaattatgggtgattcgttattagtgatcagtcaattggcaggagaatatgaatgcaaaaatgatacattaatggtatacaatgagaagtgccgagagttgatggatggatttcggctggtgattttaaagcatgtatctcgggagcaaaatgttgaagctaataatttggctcaaggggcatcagggtacaagccgatgatgagggatatcaaagtagaagttgccacgataacagccgatgattggaggtatgatgtgtatcaatatttgcagaatctatctcaatcggcttctcagaaattgcattataaagctttgaagtacacattattggatgatgagttgtattatcggatgattgatggggtgttgcttaaatgtctgagtgccgatcaagccatggttgtgatgggtgaggtacatgaaggaatttgtggtactcatcaatcggctgataagatgaagtggctgctttggcgttgtcggagatatgggtccggggatttgcgaagtgtggggaatctaccttcctatcctgctgcgtgtccgtacagcctggccctgcccccgagcacgcgaaccgctggagcagccggggggggtcggggcctatgagtgccacgtaatgcccctggggcccttgctctgattctccccaaggccctcgcctagccaccatttggcggggggagcgagcgaggagggggcccaggctgagcttccattaatacgcgcaacgccccaactgccccgtgtcacatttaatgcagtgaggcctacgtgcggcgtgcgaatctgacgcgccataatcaagaatgaccggtctatgaccggtcatgacaccggtcacgtctgactagaccgacaaccgtactcccacgtcgcgtctgctcccggttgagtgggggtaggtatgacccgtcccatcggagggtcattcggacggcggccaccacaagtcttcatccattaatgggggaatgatagggctgtcccccgtgtcaggcgagggacggcgctgggccccactcaagaacaagcagtggcttagcttccaggcaaatgcacgggtcaagttccggtcaagatagggtgggtccccacccgaaagaagagtaggtagaggcggtgcatgtggtatccccttgagatataaaaggaggaccttccccaccgagaaggacgactctcagaaaacctgaactctaggagaagaagggcgagagtgctctccggagtaaaggaacccttgtaatactcatccataatcccaaacacaggagtaggtattacgctccacagcggcccgaacctgtataactcgattgtgtgcaaggtagctagcagcctagggggcggatacgtgatttctaagaggcgagcttcttcccccggccgaa

SEQ ID NO: 64102 - DNA, 4740 bp, Oryza sativa
atattacaaaaggtgtcaggattgtcagaagtttggagcaattcagagagcaccagcgtcgactatgaaacctatcatcaagccatggtcattcagaggttggggaattgatatcattggtatgattaatccaccctcgagcaagggacacaagttcatattggtggcaaccgattactttaccaagtgggtaggggcgattcttttgaagaaggttgattcaggggatgctatacaatttgttcaagagcatattatttaccaatttaggattcctcatactattacgactgatcaagtgtctatctttgtgtctgatgagtttgttcagttttccgatagcatgggtatcaaattgttgaattcttcgccatactatgcataagctaatgggcaatccgaggcatctaacaagagtttgatcaagttgtttcagagaaagatttctcattatcctcggcaatggcatactaggttggctgaagcattctggtcctatcggatgggttgccatggatcgatccaagttcctccttataagcttgtttatggacattagaatcggctcgaggagaacagatttgcagaatgcgttgtcagccgatgaatattataatctcatgtccgatgtgaaggaggatttggttcaatccagattgagagctctcacaaaagttactaaggataaggaaagggttgctcggcattataacaagaagataatatctaagtctttttctgagggagagcttgtttggaagttgatcttggcgataggaactcgtgataacaaattcggcaagtggtcactgtcacgtcctgataaattcatcccaaaataaaaatcattctctaaatggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcaccgaaaatatttattaagcaacaacaacaattaacaaagtttattaaaaagaaaactaaaaataatcctccttttcatttgggccaagcctccctctctctctctcgtcccgcacccgaagtccttctccctctcttttttctccccctctatgtcacgcccagaaattcacgaaccagaatttctaagctgaatgtgcattaaatccctgtccaggaccagccagggtacacaaacgacaattgttgacatacagatccacgtcttacaaaaatagaaaagattacaaatgcagcggaaaagataaaacgagctagacttggaaacttgacttctgcagcgaggcgactcgactccacaggcaatccttgacggcagcgacaaaccaacttcgacaagacagctcccactaggaagatcttcagctctggtataggggaaaagagagcaagactgagtactacccactgtactcagcaagtcataccggaagaggaggtatgatgcaggatataaccgaaggaggctaaaggttcttttgcacaaagcaggcatttaaaaataatagttgaaagcagtaaaacagttgtagtaattaatcaatattaaccaaacactgtccaacgctacaccacgttgcaacaggcccaaccaaccacctaaactacaccagttcattaagctaaactaggggtgagactaaccacggtgaatttggttgatcgcccataactgcgggcacggttcttcgaatagttttactctgatcagagttgtacaactgtacccacaagacacgattccacacatgtcgccatgccccgaagtatcaccatgatactgcaaagggggaaatcgtgacaagaccctccacataaccctcccctaaccatccacaccacgctaagttttcacccccacccgtcaaaaggcagtgggcggtcccctactgcgccgcggtgaatccggcagctggacaacctgacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccgtccagtgtattttaattagctaacaccattgcggtggcaccaatccaaagctatgctcatagttaaagtctatgtaataatgtgatccctatttgtgtgctagttgagctaagcatggctaagcatttcctaaaccaacatctaatcattttgatacccaggttatcaatggcatatggtaaacaataaatggctgagtaataggacccatcccagatgacattgtaaaagaatgcgacatttaatagaaatgcgggacatttgtagattgggtacaatatgatcaattgtaatgcatgacttgccttactctcgcactgatgagaccacagcaacgtcttcgagaaactgcggatcgacgaaacggccgaaatctacgcgacaaacaaagcacacaagcaaaacatgctataagactactgaaacaggaaacaaaaccatttttaatggattctagggatttttatgaatttactgagacttgaatggacttaaacggagctcggatgaattactaataaagaaaaagtccttaattatttattgcgtaataaatcccaagggctgacgtcacccaaggggggggcgccggcaagcggggtccgcatgtcagtggcacaaggggagagggagggggcgccggctggtggctcaaggggaggggtggtccaccagctggtggggcccaccgggcagcagcacaaggcgggaggggagtggatggtggttcggcacggctcaagccggccgaccatggcaaggcggcagcggccgcaggcggcctccgacgacgaccggcggacggcgaggcggcggcggccggcgtgaaggcgacggcgcacggccggaacagcggcgtggctcggcgctcgcgggaaggggaaggaaaggaggaaaggtgtcctcaccggcgatgcgagggaatcgggttccggcggtggcggatggcaatcgagtgggaccgaggtgcgggcgacactggcgagcgcggcggcggctttagcggtggtggcgcgcggccagaggcggtagtaggcggcggcgcgtgggaagagcggtacggcggtggcgaacggaaagcgagcggcggccgaggtagctctcacggcggcgaagctagcggcggtgattgcgcggcgaggcgacggctcttgcgatggcggcgtgcggccggaggcggcggcaagtggcggcgctagcggcgagcggcgcgggctcggtaggaggcacgggagggggcggcgagagcggaaaggggaagaggaggctcgggggagcaatttataggtggagggggaagcggacgtggccgggaaagcctccgattttgccggcgatgtggggtggagagagagagaatgggggggattcaaattcgaatcccgccccttgcaagcgcgcgcgcgggccgggagacgcgggagagagggcggcaacgtggggaggacgcgggagcggcacggcgtgggcgcgggaggagcggaggaggtgtgcgcggcggtttcggcgacggttgccgacgtggggcgggcggctggaggaaggggatgaccccgacaggtggggcccacctgtcggcgtcccagagagagagggagtgagggagggcttcggggaggggaagggaggagcgggccagcccagcaaggggcgcgcgggagagtgatgggccgacggcccatcaagagaaaaaggaaggaaaagaaaagaaatagagaaaaaggattttcctgggatttaaaattgcactttggggatttttagttggttaaaattatttatagggctctgaaaattccactaaaaatcctgttaatcgattgtgacatctagaatccaagaaaaatcccacaatgccatttccaattaataattgcatttattaattagggattcaactctaggttaattagaacaatttctccggacgatttacttaacaaatttttaaagcaaggaaaaggttgaaactttagggcgtgacactctgtctctcaagggccgccccgccctccttccccttggcccaactcccctcccctccccctcccgggccgcctccgcccatccgcccggcccaagccaggccgagtccctcccgcgcacgtgcgctgtgtgcgctgaccgcgtgctagcaggaggggcccacgcgctggcaggaggggcccacgcgcggtagtcttcctcctctagccggccgttccgctctgtccctctcccgaaccatagccacctccccatcaccttcctctctctcctgtgctgacggtcaactccggccgcccctgccgcagtgcctgtgcgccggccggccgcgccgtgttctcgctcggcctcacaggtgcatcatcttccctggcgccgcctccgattcgtggggaaatcgccggagacgcgtccccgccggcttgcagtggcattgccgctactataccatctccaaccatccctgccacctcgcctgagtgcaggccgacgtcgctgccacctctgtcggtgctgcagcgccatcctcttctccggcccggctgcggcgtcgcccgaagttcgctgaaac

SEQ ID NO: 64103 - DNA, 7179 bp, Oryza sativa
tcctctcgtcgttcccggtcgtcgtggtgttcgtccctctgtcaagccattctcgttcgtcatcctcgctccatcaagtgccacagccccgtcgtcatcttcgtcctcgcctccgcgtcgtcaagcattgcaccggccgcgtcttgccttcgtgcaaggatcgccgccgaagtcgttccctcgctgttcgcctccgtcgtccctgagccgtctccgccgtgcccgttcgtcatcatcgtgccacacctcgtcgcatggtggtaagggtctctcctctcgctgccccgccctcgtcctttcgatgtcgcccctgcccgttgtgcggttgtcgatcccgctacccgtgtaccggtgtcggtagtcgtttgtgtgtgcgtgtggtgaccgtgtttgtgtgcccgcttggtagccgcgtggtttccacatgtgcagcccgcatggtgtctagtggagtccgtatgtcagccactcgtctcggttgacacacgggatccgcttccatcgacccgtggactgtctctgtgtacccggtttgccatggtcccttaggttgacatgtggggtccgcatgtcaacagcgcagccttctcgtcttttctaggctagcgcttacacatgttttataattgcaaaacctaattataataatccgaaatctccagataacagcattaaactaaagaaccatgtgcttcctttttatgtattgttactgcttctttataggcttgtagctttgcttgtgtgcttcgtgtagcttctgtcgttccagaggttcctgaagcgtggttcgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatcatgtttgtttggtgtaccccagcttttcctgggacggggattaatacactagcgttctggaaaaggtatttttccgggcgcgacagtcaccgaattgggaaggaccgtttcaaatccataaggttgtgtccaaaggagtttatatgttacaaggacttgatggaaaagtttatggacgagcacttaatggcaagtacttgaagagatattacccaagtgtttgggttaatgcatgatcggttgggtgttgccgatgcatgatagccgatgtgtttacatcgccttgagatggccgatatagttatatcgcccttagttgttttactatcataatcggttgtgttttgccaatgtatgacggccgatatagttatatcgcccttagttgttttattatcataatcggttgtgttctgccgatgtatgatggtcgatatttaatatatcgcccttagtccaaattataattttatcgatgccttcatcattgcaaaattaggggggcacatatatacaaaagttgagaattatcggcagaaaggttcagtgataatcaaaaggagtaccaaagtttcttagccgattacaaaaattttctaagtcctattacaaagataatcatctagacaagttacgctggattgccgatacagcccgttggctaatttgatctacttcttcaatagcttggatatcttgggcgtcggttccaggaatgaccttgagagacttggtcaaatcggccacgttcctgatagccaattttagtctggacttttgttcttcgacagcctttgggatatcagttaacttcttctgctcaagagccatttcggcgttgcattcctctagttgagctatgagatctattctgcgagcctcaagccgatctattttagtttgaattggcccaaccaagagttgatctagcttagctttctcttcatgaacggtttgccgattggtttgaatagtggcttcaatatcccttcgctctcgccgatcggctatcctttgcttggccttttctaccttgaattgatgttgctcgaggtatacagctggagaaatggtatttgccagatcattcgggattagggattgaatctctgcaaatcttgcccggattgtaccgcagtcaaccaccaagttgtctaatgatgtctctagccgatgagatatgtcttcaagagttcttttgacatcgtcatctagagggactagagttttgcttgttattttttcttctacctcttcatcaaagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcctgcagccgatggagtacgatcactgggcgtcgactgcacaggaggcgaaggaggaggagaaggctgaaaaaaagacaagtgttaattaacatcagttatgatcatatttaaaggattttatagaggaaaccttaccggtggagctggtttagatggtgctggtgctattttttcttgacgacagttttttttttctacaaatacaaaattgataaccaatcaactctgcaagttttttcaggagatgatcaagatgggttatttccccttgagaagtgagctggagcagcaggagttggaggagtctatttgcgtgaagccgatgatgttttttctcctaagtcactcagttcggctgcagcttggtcgacatcttccttaatctcttcttcatctagggcttgttctatggatggatctaaggcaggcaagtcatcggttggcttggatttcttcttcttggcctttctctttggagccagagccgatggattagcggctgatgccttagttttcctattcctactggcatcagctagttctcttagctgcccttggagtagacttgaggtcctgggggcatggtagccgatgacgggggagttagtccacctccatttggtaagaggcctgaagcatactcgatgtccttgccgctgttgcttttgcgaggatgggaagattctattgtctgcaagacagaagatgagactagtacaggtacaaatcggctgacaattattttacaggattgacaaagtaaggatttacctgagggataacatctgggaatagatctgtcatgtacatggaagctgattggtggaacaagtgctgcttccattcaccccaccatctgtcaaagttcctgctcctgaactttgctagttctacatttttgatgctgcccaaagggggtcctgggatgttcaacagccgatccatcatcaatgttgatgagatttcgcctctaaattgaattttatcggcaaaataaaagccgattggcagctgtcccatcccaaactgcctggccgagctcattggatggtagaactcgtaagacacttgtatgtttcatccttgatggatgccaacaggaagaatacatggactgatagcagccaagaagacctctctagacttatcatatctttcagaattgatttcttcaaatctaaagtctgatggcagttcaaagctcattgagtcttcatatgcaaaccaaactcgagcatctttctggaagccctcatagaatctgcagaaccagtctttgagcagttcagccgatagctttgctccagaatcggctggtgttgatgcagcttctccatatgacatgcatctgcgatgggttagtacttccccatcgtcacttgtgatcagttctagtcttggaaattgggactctaacagagctggccgattcacagctttcttggcaactaagttaagccatgtttgcagtaaccacgatggtccacctgcacctactactgagcctgcggctatcttggccgatgcgttgttcaacatctgatacagatagccgaggaggattttgcccaaagggatttgcttctttgcttcaagggcttctgctaggaattgccagttggtagtagggccacaacttgatccacagaaaagaaatttctcaagccacattagtagaaaggctgtgtgctcttggggggtgacagatcctatgcccatgtttgcggcgatatagccagaccagccacctattgtttttgttttaaattcaaactggttcttggaatttagggtcatcagattggccgaataggtgacatctaaaccagtgatcatgatgacatcaagcagagtggggggtcatcggcccttgattgaataggaaggcattgagggtgttggaccagaaatatgttgcagaagccatcaggggttcgtccttagctgaatttgctaaagtaagagcaagggcttggctgattccgagttcatcccagtgaccttgcttgctagccaacacacgcttgtaccatacgggctaacttttctcaggagaacttttctcaagcgaaggccaagacttgaaagtatctttccagtgacctagatttgggttggccaatctgatgctcatgtgataggctaggaatcgcaaccagattggaaagatgctacggataaaaatagagaagaagaaaacaagatgagacaaggaaaaaccaatctattgcataaagaagaagatctagccgatggacacgtacctctgcatactcggctgatggcgctgcgaacgggctggcggaagtcgacatcgctgcgggtggaagcttggccggagggagaatcgccttgagatcaccttgcgcactgaggggatcactggggaaagagaagaaaaagtttgcttaagcggtgaaaacggaggtaacggtgtgaaatttctctggggtgacggttagtatttaaagcctacggttacagtcagaaaaacggcaatgagcgatattcttggagaagcagaaatggcaaatccgaaacattaccaaatattccggacttggggggcatgtgttatcgaccaaatttggtaattcaagtatcggagatggaaccgaagcggaatccaagatggagatcgttctggaaacagagcaagaatcagctaaagtccgaatcggccacgaccagaattggtagagttcgagtcggacaaggttagccgattgagccgatttcgacaatgtgactcggtacacgttgtcgggttgagttaatgtgcttcatatggattgccacgcacggattaagtcctgaaaaggcaattgtatctattagttaggacattttatgtaatttccttagagataagtttgggcaaaagtctgccgcaaagacttatggaatcttagagtttgttagagataagagtcgtgtccgataaggacatattttgtatctcgggtataaatatgtcccggacccatgtaatcaaataacacatgttcaatacaatctcggcgcatcaccaccctcttactttcatttacttttcacgagttattgctttcaagttgagctgcatcggtttcgatcttcagctacaggtaaaacttgttatggcggcttgcgttcttgggattagtgcttccaactttatgatactctaatcttgtttatgtaattcgtcgagttgtcatatatcttatataatctttgacaattttgttatttaaccttcaatcggctaacatctatcattggaaggcagccgattaggttaaataccaacgttgacctagattatataagatatccaccaccctatgaaacactgaacggcttgattgtctagatattgtccttcttttcatacttatagctgcatcagttgagtttgaccttataagtcatgattagaatctcaatctctagcctgctttttggttgcc

SEQ ID NO: 64104 - DNA, 8951 bp, Oryza sativa
cttgctttaatatcttaatatagagtggtatcggagtactagccgatacatgctagatctatctgatcggctatgctatgaatgcttataatcttcttgttaatatatatattttgatctaagtgatttatacagtctcagcatggcgaccgatctatcctaatcacttgatttaagtatatattgatggaagtattatataccattaatatctacagccgatcgaaaagatttagttctttcttgcttatttatgattgccgatcgattctaatatgacatcggctcaaagataaatgatacgtcatcagcgactagctgatcggctatcttttatagatttaactgctattttcctgtctttatttcttgttgattgtaggatcaaatcaactggcacactcacgaacctaaaggcaagattttttggaactgcaccgaagttaagcagatcttccaggcctcgtgtttttcacatcaacacgctgacaagccaatggagtaattcaagccgatgccgataccggccgatagtgaatggattttgagctatcggctatatggttgatgtagaatatgacacttgatgtaaataaagacaatcgactgatgataatgtgataaaacaacaatataatccagtagaaaccaatcggctaacaacgataagatagaataagcactaatccgaaggataaagcatatatcggccggaggtccaatgtcataatgcaagcgattagataaacggtgaaaactttgtcacgatcaggtcaatcaaagtcatatgcaatctttgtaagtcgatgcaacgtccagataactcatcggctggaacccgaattaaatccttattggcaatcaagagcaggctagggattttggttctaagcactacttaatagatcaaactcaactgatgcagtactaagtacgaaaagaaacataatatatagacaatcaagcccttgactaattttcagggtggtggatatcttagctaattcttgacggtcgttagcgcttgttggcggctgttaaatgccaattctataccgccaacatccgcataaattttagataataaaatatccaacatagtgataggtacttaatttcacatatttcacaagtgttggtgcatatttgtatgcagatgatagaccctacgtttttttgagggaaagcactataggggaagcccccacagtaatactttattaaagaatataaattacaaaagatttaaccaattcaaaagggattgtctctcagaaacatttaatccaaaaaccaaaagggaaagatcactcttaaagagagctttccaagaagaaattgagggtgctaaattctggaaaatcagagagttcctctgtttccaaatattccaggctgcataaagaattttctccacaaagtgcgtagacctataagaattcattgcctgataaaccctacgttgggaggaaaatcagactaaagtgagaaggaatatgtatccatacaaggatgggttgtgaacttcatcaaatactagagaatcagcccaaaatactgaagaatggataaaggaggactaggaggagccaggccaagggccagaccagggggtcccagcccaggttcagccgaaccccctggttcggcgaaaccctggagatcaccgttgatcccatgttttggcatggacgctccagatgcattcctgatggcggttgaggggcacttcggacctttccccttcaccaaacgtcatacctacctctatataacgacattactcttttacttcacatacacacttccaagtttcagctgaattataagaggctctattgtactatattgtatctaaaataggaagagagtagagtagaagaattcggaagaattccagagttgtcggtaatcttctctcatttcttttattctgttcattagtctaaattcaatataatattcttcttgagttagatttatctcgtgagaattatctcttggttagttcctaaatagcatacgggatcattgtcatttatttatagtgattgctttagtgtttgatctgcactagagtagttattaattgcgtagacgcggtgtctgggtaattaatttctagtggttgctgcgtatcccatagcacgtttaaggtaggtgtagaggtggtgacagccctcaagagtacttaagtcctccctgtccgtgtacgtagtagagcgatatttaggaacagcgggttgccagtgcctgaagtattgcattaggattaaagttaagctttccctagacactgtttctcactagtaaatcctctctatcctagcctatcatctgcttggtgtccttggatgaaccggaggaagatctgaccacacacgttcccttggattcgatacccctggaatactccgtaggggaagtgctacatcggtatatccgtgcgcttgcggattctatctatgatcgtaagaaataccaacaagcatttctggcgctgttgctggggaacagttgctgatcattcccaaaccttgctcatcctcgtatcctttttacttttctattctacctttacccctgctatcctagagaagtattcctgtgggtataccaagatcaagaatattctacaaaagacggtcaacagaatgggaataggatggaaggatagattgccagacgcactgtgggcataccggatagcatacaagacacccattggaatgtgcccctacagatagtctacggaaaatcttgctgactccctgtagaacttgagcacagagcatgttgggccatcaggaactggaatatgaactttgaaggagcaggagaatggagaaaaatgcaaattgctaaacttgaagaatggagagagaaggcttaccccaacgcaaagatatataaagaaaggacaaagcactagcatgataaaaggataaagatcaagcaattcaagctaggagacaaaatactgatgttcaactacagggttaagcctcttcggccacggaaaattgggtagtaaatgggaaggacagctcgtcgtaatcgacacctcttcgcacggggcaatcacaccccgcgacgactcaggaaatatattcaaggtaaatgatcaacgcttaaagattttccttgagccaaatgaaactgtagatgaagaagtggatgttattgaattaatcgattattaaccatgatgatctcatctaatgcatgcttaaaacattgtatagttgtcatttttatgcttagcttagggtttagtggacctagaaaaaaaattggcacctaacgggacccaccagggttcggccgaaccagggcggcgcctgatcagccccaatttggaacctcaatctccccgctcgtctataatccgttgtgatgcgcattcggaggtagatcagtcgtatcagacccagagctctgttcttcctcctctctcccactttaacaagcctcctctcattctcatctcaattctattgctccatcacctccaaatcactaatggctggcaaatcattgatcccattcatcggctcttcctccaactccacatacaaccttgacggagagccgacatgggcgaatcaattgatcccggtggaacactacaccatggaaggggtgaatgcactgtgggcgcagccccttgtgacagtgtcgggctcccctgcgaatttggagcacttcggcgaataccctggttcggccgaaccctctcggccacgttcggccccctcttcggcagcgtgatccctgtcccctcgccatgttacgaagaccaaaattcaggggggattcacctgcgcgacggctgacaacaggcaagctcggtctcttgaaggcacgacgccattgtcaagatgatgagaaggccgttccgcctccgccgagcgatatgtgggcaccctgttcactaaggcaggagatgaggtgctccacaagtacaccacatctactactactccatccactccaaaggaggatcggttccgcattcagggagtgcgaactcctggcggtgggtatggtaagggcttgctccggcctttgacggtgtcaaaaaaggagggggcagcagaatcccgtatccctccacctataaaggtgaagcgtcatttgacgccccctccaattgtaagggcggccggccaataccaaggagatgaagtgaagtcaccggagccctcggtctataagctcgcctcgcaagtgagggaactccgcaaggagaacatagagcttagagcttgcaacacggaactaggggtagaactcgctgaacttagaaataatgttgatacccttagtcgcggtttgtgtgctaaaataaagcatgcattcgtagagatggggaaggagaataaatattatgctaattagatgtctcctctcccataaataaagtaatagtaggtgcttggttttatttttccaatcatgtaagcacttgctataaataatgtggctcattggtgttaaccccaatgtttgctgaagtttgtttttgtttaataaaattcaggtttttgaataagtgtggggcagatatcgcagcttctaacgtgcacatactctgaatattgttgaatctctgaacacctggaaggcactgaactctgcagaaaattgcagaggaaatgggcaccagagtggttcggccgaactaccagatgcggccgaaccagagctggccccaatccctctcaattttcacaggtgagcatgtgagcacgtcttttatctgtatatctccaccatggtatagtactagagctgaaaatcagaaaacaattggttcaagcataagtaaaagataaaattttcaactaatgaaattcttcagatgattgatcttgtatattcattattctcagctgaacttgtgcttgtgaacagccatccatgtttagggaaccttatgcatctaagtaattgctttatgtgaggtgaataaagatgaaaggaattcttgcaacttttgtcatgactcttgggaatttgttttcaaaataaaattgttttaaaagctcattcctccaattgacttcattctttattcctaccaaggccatatgcaagtgcatctttgataaaccttattatgcgtatgactgcttgacattatattgagttttgtcaaatttatgtgactcgtcttagatatctttcatacactcatgatcaaggagtcatttccattttcatttccacatatataattaagctaatcttctacactggaagttgccttccaacaaaaattccattcaaataaactccaactttagaccatgctttcttctcctagaaaaattcttggcaaaaagaaaatgataaaaggagggaaagacatggctgtgaaaaaaaagagagaaaaaggaaataaagtttgctcttaaaacattgagcatgatgaaaacaaaatatagccatgccccttctatattcatgccaagaaaacaaaatggagagaaagtctagcaaaaggggagaattatttctttattccaccattccacaaaatattttacttttccattttctaccacaaataaagacccttgatctaggggtatgactgatgatcttcttgagtccatatctttggctttgcaatatatatgttgcaggtatgtcacaatttatccctaccgaactccacatatcagccttagaataggggtaaattctggcacattttgccttggtgaggatacaaaaagaaaatatacacatttccgacaattcacatgctctacaaccatcatacctgcctatttaaagagctctcatcctcactatcttcacacacttcaagcaagagctctctcatattctctcaagtttagtttactagtctcaagctagtggagtaggaatagaatagaaatcagagtctggaagtcttcggaagagttcgggtatggctctagttgctctcctttcttctttcataagatttgtactttatttagaatattcttctttatacaattctggtattgaaatactttccgagtatatgaatgccagctttactttatgttcaagttatactgattatactgctagcttatctgggagatgcataggtacaattataatgcttgcaattgcaattactctacgtcatgacaatgacattagagtagtatctggtagtttaggcatgatgtctagattatagggtaatataatttggggttatatgatgtggatgagaggtgggccactaatggtgacagcccaatacgggtattcctccgcgcgtgtatatagtcctaaattaattttctgggaaggggactcctacgtatttagcctcggttgtatggtcatgacgggctgtcgtaaggaactcggcagtcaggggtggcttctcaaagtaccaggagggcatcagaaagagggtattagaaggttaatcatataactaggatatatgtataatatgtattggaggtataccatgaggaccttctgtcacaccctgaagttcttttcccaagcctaaatcaaagtaataattggtctcaagaaattacctctgtaaaagcaagagagaaaccttaatttaattaacacaaataataatcgaaaatggcatgtggaatttttcttgggttcctcaagtcaaaatatgctaacaggatttttaatggaattttcagagctctagaaataattttaaccaattaaaatcgagcaaaagcattatttaaatccctggaaaaaaactttttctttttccttttctttttcccctcctttttccttttgggccaccggcccacttcccctccccctcccgcgcgctagctggggcggatcgaggccgaggcccagccagtggctgcccgcgccctcccctctccgagtcaccgacaggtggggcccacctgttgggcccattccctacctccggctggcgtgcccgcaatcgccgctcccgcctctcccgtgcgtccccgcccacatcgcctacctcccgcgccacctcccacacgccccacaaccgctgccccacctgcccgcccgcgcccgcgcccgcgctggagacggccgggattcgattttcgaatcacgcctctctcctcccacctcccccatgtcgctgttggtaatcttacgatcatagataaaatccgcaagtgcacggatataccgcgatttagcacttcccctacggagtattccaaatgtgtcaaatccaagggaacgtgtgtgatcagatcatcctccggttcatccaaggacaccaagcgaatgataggccaggatagagaggatttactagtgagaaatagtgtctagggaaagcttaactttaatcctaatgcaatacttcaggcactggcaacccgctgttcccagatgtcgctctactacgtacccggacagggaggacttaagtgatcttgagggctgtcaccacgtctacacctacctcaaacgtactgtgggatatgcagcaattactggataacaactacctaaacaccacgtctatgaaattaatatctactttagtgtttataaaacacgaaagcaatcactatattttagttgattatagtgaacaataatcccgtatgctacttaggaactaaccaagagataattctcacaagataaatctaaaatactcaacaagaatattatattgaattcagagtaataaacagaataaaagaaatataagaagattaccgacaactctagaattcttccgacttcttctactatactcttttcctattctagtatacaatatagtacaatagagcctcttataattcagctaaagcttgaaagtgtgtgtgagagtgaatgaagtgaggtctatttataggacatgtatgacagttataggaagggatatagtccgaagtgcaccttaaccgccatcagcaatgcatctggagtgtccatgccaaaacctgggatcaacggtgatcatcagggttcagctgaaccagggggtttagccgaacctgggctggccccccttgcctggcctttggcctggctcctctcctggtcctcctctatccattcttcggtgttttgggctggttctctggtgttcctatgaagtccacaacccatccttatatggatacatgatactcctcactttaagtctaggtttcctcccatataaatatacaccaataatgtggaatatgtgagatttaagaccttatcactgtgttggatgttttattatctgaattttatgcagatgttggcggtatagaattgacatttagcagccgccaacagtcaccggcccctcgagcctatataaaccatccccggaccctcctctctctttttcgcattgcaatcgcccgctcccaagctctcatctgccctagcgccacgcaccacccaccgccgccgctttaactacctccggccgccgctcgccgccgttagagccgccgccgagccacgccgtcgcctccgttatccgccacttgccgccgctcgtcgttgtcggtgcggcctccctccttcctctctctttctctctctctctgtgtcctgtgccaccgcctagcgccgccgcctagccgcgtcgccgtcgcgttgccgccggtcaccatcgtcagctgccgcctagcgccgccgcctagccgcgtcgccgtcgcgttgccgccggtcaccatcgtcagctgccgccttgcgccaccgctagcgccgccgctgctagagccgcaccgctgcatgccgcgcgccgcctctgctgtccgaactacgtgagggtagatcggggccgtccatccaccgcccgcgtggccggcacgtcggtgccacgtcagcgccgcgtggtactcccatcccctgtcccgtcgactcagtccaccatggaccggcacatccgagccgatgacatgtgcggcccgcatgccggcgccgccccc

SEQ ID NO: 64105 - DNA, 7890 bp, Oryza sativa
gctgacgtcatccggggttaattaatgcgcaataatccaattaaggttttttcttttattgtaaaaacaaagtgaatcttctaaaattcatagaaaattcatctgtgctccgtttaagcccattcaagtctcagtaaatccagaaaaatgcaaagaatccattagaaatggttttgttctctgtttcagtagtcttatagcctgtttgcattgtttgctttgtatgtcgcacagaattcggctctcccgacgctccggtgtactttgagataatccgcagagcaaggcaagtcatgcttgtctcttgaacatgttgatcccatattgcaaatgctctattgttttcctttaaatgttgcactgttttataatgttactatgggatgtttacctactgtctcagccttatcatttgttatcctgttccgttgttagcttggggatgtaacatgttagccttatcatttgttagattaggggttgcttagccatgcttagttctactagtacacaatgggggatttacattaatgcatagacttcagattctagtattgatgttggattagtgccaccgctctagtgttggttaattaaaatatattaaatggtgggctgtgggtgtatggttttgatggtcacacccatggcaattaaggaccggttcgcgggaaaccctggaagaattcctcgtatttaccacaagccatcgtgggcaacggctgggcttgtagtgtagctttcctctagctgacacatccaggcaagggtgggcgtgatggagcgggatgggccctgcgacggcctttgtcgcttctggattcacctaggcacgagaggggacttcccgctgccttgcgaggagtgggggtgaaacctaaggtgtggtgtgtttggttagagggggttatgccaagggtcctgtcacagcctctatccggtatgtcgtggtggcatgtcggcgcacgggaacatgtggtggggctgtgtcttgtggctatagttgtacacctctgatcagagtaaaactattcgaatagccgtgcccgcggttatggtcggtcaaccagattcaccttgattagtctcacccctagttagttaatggaactgattagtgcaagtggtggtttgggcctgtctcaacgtggtctagcgttgagcagtgattggtttaatattgattaattattacaacttttttttctgctttcaactaccgtttataaatgctagctttatccaaatgatcccctttagccttcctttggttatatattacatcataccctctgttccggtatgacttgctgagtatagtgggtagtactcagtcttgctgtatctcccaaccctcagagttcgagtatgtgttcgatggtggtttctccaaggagtaggcttcgtctgtgccgtcgaggatgcctgtggagtgttgttcccgctgctatccaagtcaaggcttagctccagttatcttttaatttccgctgcatttatgtaagacttttataatgtttgtaagacgtggatctgtatatcaactttgtcgtttgtgtaccctggccggtcctgaacaggtgtttaatgcacattctgcttgaaattctatttgggaatttctgggcatgacaagttggtatcagagccgacctttacagtaggataagccaaatagaaaccctaagagccctcccaatccttttcattggcatatgttctttgcaattggatttgtttcgggaaaatttggatttgttccttgggttcatggaaaaattcatgatcgctcgtttcattgaaatttgttcaaatgaggtcagcctatggttttagtaaaattatctgggacatatcgggatttaatgggaggtatgccttaggtcctaactaaggaatatgggttgcaggttatttatgctcttgttattattattattattattattattattattattattattattattattattattattattattattattattattattattattattattattattactattattattattatgtatctaattcctcattattttgttgctatgtatgtcagtcttatttatttgctctcatgcaaaaatgatctatgcacaaaattccgctcttattcgcttattttatttgagtcctttaccgttaattttataattgggtttgagcatgcattgactctccatcctttgtcttctatagatggccggctgtcccctaacacaccaaggtcagactatgggaggattcatcgcagagctgtcccgcatggcgtttgtgatcggttttccatgggagccgcagcacagcagcatccaccctctcagtggcgagttcccacaccaggtccgcttggagcttcacggcatcccctcctacctacccaacatggaggtgacagcttgccggggcacatttgagcatgcttgtgaggaggccgccctcaggatgatggcccatttgagggagctgcacgacgacaccctgaacaccaccgcctactgcttccacccttgtcgcggttccagctccaacaccggcaccttcaagtcagcttggcgagagaacgacgtcaccttcggccacatgagtgaggtgatggaaggctacaacaagctgcacgctatgcttcaccgggcgaccaagaggctcaacgacaagaagcttgtgaggatcgccgagctgcaggatgagaacagttgcctcaagaagcaggtagccaggctgcaggggtgcccaccgccaggaggagcccgcatccgcaccatgccaaggaagttggccacagctcccgtgcgcatccagctcgcgcccaggaacccgcctccacctcctcccgcagctccagctccagtccaagctcctgctccagcgccaactccagcatatgccctctcctttgtgccagcttcagcttacaggggtccagtaggtggcagtggagtatggctgctagcttctcccagtggtggtcgtgcatcagcagttctagctcagaggcatgcagcggcgacacctaccagctagagtactccaggagccactcagagggaccaggcgacaagcaggaggacgccttagtagttgtttgtcgactgcattccgagcaattgcaatttaaattcctatataataaagcttagttcctgagcccctatttttcttcttttccatccgctccgtctgttcttccttcagatggtcaacaccaggaatggcagtcgtgcagcaggtgagggcagcagcagcaaagaacgcaccgatggtgggcaccccaacagcccctctagcaatggtccgccaccgctccccgagaacccgacgcttgcacaagtgatggcccatcagacccagatgatggcggccatgatgcagcagcggcaccagcagatgcaccagaggatgcaacagcaggccgatcagcagcagcagtttggtccccctacccctcagtccaagctgctagagtttctacgagtcaggccacctatattctctagcaccaccaaccccttggaggcaaaagactagctccatgccatagagaagaaactcaaccttctgcagtgcaatgatcaggggaaggttgcctttgccacacaccagctccagggtcctgcgtcagcttggtgggacaaccacatggctacccgtccaccaggcatagaagtcacttgggcggaattctgtcgcagcttcaggaaggcgcaggtgccagacggggtcgtggcacagaaaaagagggaattcccggcactcaaccagggaagcaagaccgtgactgagtacctgcatgagttcaaccacctagcgtgatacgcaccggaagatgtccgcaccgacgcggggaaacaggagaaattcctggcaggcctggatgacgagctaaccaaccagctgatctccaaggattacgctgacttcgagaagctggtggacaaggcaatctgccaggaggatcagctcaacaagatggacaggaataggaaggccgcttagttcagggcacatcagggaagtcaccagaggccgcgtttcacttccggacagcaaggtggacccaccaccatgattgtttgacaacaccacccctaccctttcgacaacttccaccaaggcgccagtggcagccagaaccaccagggaggtcagcttaaccgcagcatagctccgcgcccgctaatggcaccagcacagccagctccaccagctcaagcaaaggagaccggggcaaagccagggccctgctacaactgtggcgagcatggccactttgctgacaagtgcccaaagccgtgccgtgccgggccaaggtttgttctagcccgcgtcaaccatgcgtctgcagaggaggcacaaacagcaccagaggttgtactaggtacgtttcctgttaactcaatccctgctacagtactttccgattctggtgcaacccactcattcatttccaagaagtttgttggggtgaatgggataagaagggaagaacttagtacaccaatgagggttcataccccgggaaatagttcaacctctgtctattatagcccctccgtggtaatagaaatccagagatcacaatttctagccaacttcattcttttttaatccaaagacctagatgtcattcgtgggatggattggctgaccatgttcaagggcgtcattgattgtgtgaatcgcacggtcaccttggtcaatgagaaaggagaaacagtggtgtacaagtctccagcctcacccaagcaaggagcctcattgaatctggttgaggcgaaaagttctgtgaccgcagaggagaagagttcgacgaaattggaagatattcctatcgtctatcaatatccagaagtgttccccgaggacctcactaccatgccacccaagagagagattgagttccggattgattttgcactgggaactgctccaatctacaagaggccgtatagaatggcagccaatgagctagcagaggtgaagaaccaagtcgacgaacagcagcagaaacgatacatccgaccgagtacttcaccttggggtgctccgatcatttttgtggagaagaaggacatgacgaagaggatgttcgtcgattatcgcgcacttaatgaggtcacgatcaagaacaagtatccgttgccgagaattgatgacctattcgatcagttgaaaggagctaaagtgttttccaagatagacctgcgatcaggctatcaccagttgagaatccgggaagaggatattcccaaggttgtttgagtgcactgttatgtcctttggacttaccaatgcaccgactttcttcatgaacctgatgaacaaagtgttcacggaatttttagacaagtttgttgtggtattcattgacgacattcttatttattccaagtcgggagaagagcatgagcaacatcttcgtctggtactcgagaagttgcaagagtaccagctctatgccaagttcagtaagtgtgacttctggttgtcggaagtcaaatttcttggtcacgtcattactgctcaaggagtggcagtggacccatcgaatgtggagccagttacaaagtggaccccacctaagacagtgacccagattcgaagtttccatggacttatgggttattaccgtcggttcattgagaatttctccaggattgccaggcctatgactcagttgcttaagaaagatgagaaatttaagtggacagctgagtgtgataagagttttgaggaactcaagaggaaattagtgtctgctcaagttctgattctgcccgatcaatcgaaagatttctaagtctactgtgatgcattccgccaagggctaggatgtgttctgatgcaagaaggccaagtggtcgcacacgcctcgcagcaggtgcgtccacatgaaagcaattatcctactcatgatctagagttggtagcagtggttcacgctctaaaaatctggcggcattacctcatcggtaaccgttgtgaagtttacacggaccacaagagtttgcagtatatcttcacccagcctgacatgaatctcagacaacgaagatggttagagttgataaaagattatgacatggggatacactaccatctaggcaaagctaatgtggtagcagacgctttgagcaggaagaactactgcaacgccttgggtttgaagacatgagcgtcaaattgcaacaagagcttgaacatctcaatttgggaatcgtggaacataggtacgtggctgccctaaaagcacgacccacgctcgtggatcaagtccgagcacctcaggtaaatgatcctgaaatagctgaactgaaaaagaatatgaggttcggaaaagcccgtgatttccatgaggatgagcatggcacaatctggttgggagaaagattttgcgtacctgaagacaaggagttgaaagacctgatactcaccgaggctcatcagacccaatactccattcatcccggcagtaccaagatgtaccaggatctcaaagaaaaattttggtgggccagcatgaggagggaaatggcggagttcgtcgcagtctgtgatgtttgtcagcgagttaaggcagaacattagagacccgatggactgcttcagccccttcagattccggaatggaaatgggaagaaatcggaatggatttcatcactggtttgcctaggacatcgtcaggacacgattcaatatgggtggtggttgatcgcctcaccaaggttgctcacttcatcccagttaacaccacgtatacggggaagaaattggcagagctgtacttaggaagaatcatgtgtctgcatggggtacctaagaagattgtatctgatcgaggaagttagttcacttcaaagttttggcagaagctgcaagtagaattggggacccatttgaatttcagcacagcctaccatccatagacagatggccagaccgagagggtcaatcaaattttggaagatatgctaagagcttgtgcacttgattttggcggagcctgggacaaaagtctgccttatgctgaattctcttacaacaacagctatcagaacaatttgcaaatggcaccgtttgaagtattgtatggtcgaaagtgccgctaataaccgctgaagggagctcacctttgaagcaagggattatgtgtatcttcgtgttccagacgaaaggtaagttggcaccacgcttcgtgcaacatacaagatcttagaacgaagaggaaaagtcgcatatcagcaagagcttccactcaacatggctggcatccaccacgtgttccatgtatcgcggttaaaaaagtgttaagggtaccagaagagcaagccaattcggagcacatcgatattcaagaagatccgacttatgtggtgaagccagttcgcattcttgaaaccagcgagaggagatctagaaacaaggtgatcaggttctgcagggttcagtggagccaccactccgaggaaaaagcaacatcggaaagggaagatgagttaaaggccgcccatccgtacctcttcgccagctcctcccaatctatgggtcgagatcccgtttaaggagggtaggtttgtcacaccctgaagttcttttcccaagcctaaatcaaagtaataaatggtctgaagaaattacctgtgtaaaagcaagagacaaaccttaatttaattaacacaaataataatcggaaatggcatgtggaaattttcttgggttcttagcgtcaaaatatgctaacaggatttttagtggaattttcagagctctagaaataaatttaaccaattaacatcgagaacaagcattatttaaatccctggaaaaaaccctttttcagtttccttttctttttccccctccttttt

SEQ ID NO: 64106 - DNA, 23149 bp, Oryza sativa
gaaaaatgcaaagagtccattaaaaattgttttgttctctgtttcaatagtcttatagcctgtttgcattgtttgctttgtatgtcgcatagatttcgaatctcccgacgctccggtgtactttgagatagtcgccgaggtccctccagctgcaaagcaaggcacgtcatgcttgtctcttgaacatgttgatcccatattgcaaatgctctattgttttcctttaaatattgcattgttttataatgttactatgggttgtttacctactgtctcagccttatcattcgttatcatgttccgttgttagcttggggatgtaacatgactagatgttggattaggggttgcttagcgatgcttagttctactagtacacaatgggggatttacattaatgcatagacttcagattcttgtactgatgttggattagtgccaccgctctggtgttggctaattaaaatatattaaatggtgggttgtgggtgcatagttttgatggcgcacccatggcaattaaggacaggttcgcgggaaaccatggaagaattcctctaacttaccacaagccagcgtgggcaacggctgggcttgtagtgtagctttcctctagctgacgcatccaggcaagggtgggcgtgatggagcgggatgggccctgcgatggcctttgtcgcttccgaattcacctaggcacgagaggggactgcccgctgccttgcgaggagtggtggtgaaacctgaggtgtggtgtttttggttagagggggttatgcgaagggtcctgtcatggcctttttccggtatgtcgtggtggcatgtgggcgcacgagaacgtgtcgtggggatgtgtcttgtgggtacagttgtacacctctgatcaaagtaaaactattcgaatagccgtgcccgcggttatgggcggtcaaccagattcaccgtgattagtctcatccctagttagttaatggaactgattagtgcaggtggtggtgtgggcctgtctcaacgtggtctagcattgagcagtgattgatttaatattgattaataattacaattgtttttctgctttcaactaccgtttataaatgctagctttatgcacatgatccccttaagccttcctttggttatatattgcatcataccctcctttccggtatgacttgctgagtacagtgtgtagtactcagtgttgctctatctcccaacccttagagttcgagtatgcgtccgatggtggtttctccaaggagtaggcttcgtccgtcccgtcgaggatgcctgtggagtggtgttcctgctactatccaagtcaaggcttagctccagttatcttttaatttccgctgcatttatgtaagacttttataatgtttgtaagacgtggatctatatgttaactttgtcgtttgtgtaccctggccagtcctggacaggggtttaatgcacattctgcttgaaattctatttgggaatttctgggcgtgacaccttcggccaggcctaccgaagccaaggacataggcaaaggcacttgctggaggcaagaggtgaaggtcgaagggacaacataggagaaagccaaatgaaaaaagccgtggcatcaagttgacaagctttgccaaagaaggaccctgccggaggggcgtacggtcaaaggccatgaggcgaaagccttgccacgaagggcatgggtttcgccaagtatcgaaccttgccaggtgaaggcccagcgagccgacacgcctttcagaggcttaaccaaggactgggccgagtcacttggcccattaggagcccttcgagcaaaagacactgtacgcccatgaagatgtccctatcataaaggcaaccatgtaaattctcctgtaaagcctaaaccctaaagggagagtctgtaatagggctataagtagccccctagggccatataacagggggatctgagtaatttttacaaagcaatacaattgtctttacttccaacaactgttaaacgaaccacgtccttcgacatgaggcagttgtcgattcgacaacagctggcgccgtccgtggggacctccgagcacaaccattgagagtaagagcgaaaccactgatgccaccgaagaagatcgctaaggagagagtagccaagcgaaaggaaggaaacagcgagggggagatggttggcgaagagggagcagagccttcggcttcggacgccgaagcaggagctgcgctgcttccggtggcagcgccttctctcccatcttcggcgccgaccacttcgacagaccaggagacggtgaaagcagcggccgcggcgaaggcgctccagattagggacgtaatcctttcatctcaagtgctaggggcgtctcaagccgccgcctcgtcgcagcatgctaccacttcgaccgcactcaccgcctcacaagccaacgctaaccttgaagcccaagccgaagccgacatgggggctatgcggcagaacatggccaagttgtaggacacgcttcgccaaatgcaagatcagcagcaggcgtacgaagcggcaagacaagccaaggctaatgcctagcagttttcgacagtctacacacagccccaagctttccctccgcatgttgcacaagttgtacaggctccaatgtacttcgccaagaccgctctggctatggccgcgcgccctacccctcacatgacttcggtgccggttcgcctggtagcacctcaagtacagtacttgaagcctactcatacgccccaagcaatgatggaggcagctttggccttgcaagcctagtttcaagcattttctacagcagctcaatcaacccaacaacaatgtaccaagaactttgcctccggtccaagtcgagggaagtccaagtcagggtgctccggccgggcaactgttaggccagttcaccatgccaagtcaggcgaaccagctagctcaaggtgctacgcctcgaagccaactaccacagttcaaccccagcgccacgattcaagcacccatgaccttcatgcatgtcgtgcctcccgggtttggaacagttccaccgccgaaccaagcctggaaccgagccatgatcgacccaactatggcggcgcaagccgcttcgacggttcagcagacccaggcgttggtgttcggcacggggcatcaatcaacacccgcagccaaccccatgtgcaagccgtaacttcgccattcgcacttccataccaacagataagctggtcctcccagtatcgtgcagtgataaagccgtgtggcgaaaagggtttgccactaagctggggaatcaagagtcatcccatttccccacccaattcaagtaccctcccgtcccaagttactcgggagaaacggacccaaaagagttcctttccatctacgaatccgcaattgaatctgctcatggtgatgagaatatcaaggcaaaggtaattcaactcgcgctcgacggcatagccaaatcttggtactttaacttgcttgttaatagcacttgctcatgggagcaattgtgcgatgtctttgtccttaattttcgtggtacctgtgaggagccgaagacccaacaagaccttggcattcaccaaaggccagggaaatcgacgagggattacatgcgccggttctcgcaggcgcgttgccaagtgcaagatataacggaagcatctgtcatcaacgcagctttggccagcttgcttaagggtgaactcacaagaaaaatcgctcgcaaggaaacaaggacgatcgaacacatctttcgcataatcgatggttatgctcgaggtgaagaagataccaagtggcggcaagaaatccaagccaaatacgacaaggcagctgccaccgcaaccgccaccgcacaagctcaagcttaggcccaagctcaagcaagccattagttcgacacctgtgatggttcgcccttcacctccggcgaatcaagggcagcctccaaggctgaaccaagttccgatgacctagaaaaagttcagaatagatcgcgccggaaaggtagtgatggctgtcaaagaagtgcaagccctccgcaaggagttagacgcacagcaagtagtctgccagcaacaaccttttcgcaagaaagtcaagaaagatttgtacaatgcctttcacggttgctcttcacacacaattgagcaatgtccaaatatccgatagcaaggcaacactcaagctccaaggaagcagacagtcagagccgaagaggtgcctcgcgaagctgttcatgtccaagcaccccaggccgaacagcgccaagatgcacaatgaagagtgatccaagtcatcacaagatctgatcgcccttcgtaggcgtcgaaatgctagaaaaagatgcaactccgagcaatgcacaacattgcttcggcaggcgaaggggttccaaggtacttgacgcagtagatatctttcggaccagaggatgccgaagtagttctgttcccacacaaagaccagctggtggtatcggtacaaatgggcggttttgaagtttggcgtatcttgatcgatgggggtagctcagctgatgtcattttcgccagaacgtatgccaagatgggactaccgaccctggcgttgtctcaagtaccaaattcgcttgggtgttcggaggcgaagcagtgcaagttttgggtcaagccctcttgaaagtcgccttcggcacacaagaaaacaagagagaagaagagatactcttcgatgttgttgacatcccgtacaactacaacgccatcttcggccgaggcactttgaataaattcaagggaataccacatgcaccgtcttacacagtccatcattggatgggcgcccacatgtcttaggtcaagacgccgtccatgccttcgaccggaagcaaggcggtcgttcgcccccaggtgggtcccagtgccatcctccggctgacacgggggacatccctgtcattccctcttaattccatggagacttttgtggattcgtgtatggggggcacgctcgactgcgtgccgatgggacggggcatacctgcccccactccgcctgacagggggcgggacgtgggtgcgctgccacccatcccatgcgcctgtgaccggtcatagaccagtcaaacccgattgacgcacgtcaatcgggcggcgcctcacgtccgcccacgccacattaaacgcggtgagggacggttggggcaccgctcatttaaggcgtttggcagtgcctctccctctgcccactcggccgccacgtggtagctaagtgagggccttggggcagtgcgctccaagggcccgaggggtgcaacagggcaccccgaggccctttggccgcttcacgagcgctcgttctcccctgagggggtaggaacaggccatgcagccacgtggccaaatgaaaggattctttccctctatcttgcgtaccaccgggcccatatcaccgacagtagcccctagcactacatctgaccgtaaccctaccagggcggtctggcgcggtgtctcataacttcctgttttgtgatggtgggtcccatggggagtccaaacggccgtcatcggtttgcctagcttgagcacctaccatgatgatgacttgaccgctaataactgcgccacacacggggacgcgtagggcaggaaaaccgaggggtctgctagaccgcgctcggaatcattacttgccatcacctcgactgcctgactatcaggcacgcgaggggacggaactaatggtgggcccgcccaaccgcaaccgtaatcattgcacgtcccacatcgattttgccgctgacaggcgcattaaacacgggacgtggatttagtaggggaagcaggacgagtgggcacgaaaaacgaggaggcgggcgcggccgacgcgagaataaaaagtgagggaggaggagaattcatctacatcctttcgccattctttctctcacactcgcgctcctcagcgccctatcgttgcaacctccgaccaccgcgcttcgcttactcagtttctcgctcatactcaccggccgccatggctcaacacgccgggaatgttgttctcccgtcttcgcacatcacggaagagcgacacttgagcctcatccgcaagatcatgccggacggctccgtcgtgagggcaagggaaccgcagccgcggccgcggtacctggatcggtccgtgcaccttctgtccttcaccatggcagggctgatcccacctttctcccgtttcttctacaaggtgttgatgtaaaaacacgaggcctgggagatctgcttaactccagtgtaggtccaaaagcttgcctttaggtgtgtgagcatgccagctgatttgatcctacaatcaacaagaaataaagacaaagaaaccgcggttaaatccataaatgatagccgatcggctagttgccgatgacgtatcatttatctctgaaccgatgtcatatgtagatcgatcggcaatcatgaataagtaagaaagaactaaatctactcgatcggctatagacatttacaatatataattcttatgtcgatatatacttaaatcaagtgattgggatagatcggtcgccatgccgagacagtataaatcacttagatcgaaatatatattcacaacaagactatatatgttcataacatagccgatcagatagatctagcatgtatcggctaatactctgatactactctatattaagatattaaagcaagttgaatatactaaacaaaagcctaatatacttaaatgcaacaagatcgtaatataaagggcagatttaacatgtcaatcaagcatatagagtacgaagtagttaaattaggtaagatcggctgaaaccctgatactaccgtaatcggcaaccaaaagcaggctaaagattgagattctaatcacgacgtataagatcaaactcaactgatgcagctataagtatgaaaagaaggacaatatctagacaatcaagccgttggatgtttcatacagtggtaaatatcttatataatcaaagtcaacatcagtatttaacctaatcggctgccttctagtgacagatgttagccgattgggggttagataacgatattgccagagactatataggatatatgataactcgacgaattacataaatgagattagagtatcataaagatggaagcactaatcccgagaacgcaagccaccataacaagttttacctctaattgaagatcgaaatcgatgcagctcaacccgaaagcaagaactcgttgaaacaaaatgaaagtaaaagggagtcgggcgatgtattgaacgagtgttagattgattacataaggctcggggtctatttatacccgagattacaaaatatgtccgtgtcggacacgactcttatctctaactaactctaagacaccataagtcttgcggaagacttttgcccaaacatatctccaaacatatcctaattaatagatacaattgccttctcaggactcaatccgtgcgtggcaatcctcatgaagcacattaactcaacctgacaacgtgtaccgtgtcacattgtcggattcggttcaatcagctaacctagcccgactcgaactatgccgatcttagtcgtaaccgatccttactctgttcccggaatgatttccatctcaaactccgcctcgatagcatcttcatctccgatacttggattaccaaatttggtcgttaaaacatgccccccaagtccggaatatttgataatgtttcggattttccatatctcaactccgagaggatatcgcacttgccatttttccgaccgttaccgcatcgctttaaatactaaccgtcatcccgacaaatttcacaccgttaactccgttttcaccgcttaagccaactttgtcttttctctctccagcgaacccctcggcgcacaaggcgatctcaaagcgatttcctttccggtcaaatcttccgcccacagagatgtcgtactacgccagcccgtcagtcgcaccatcggctgaatacgcggaggtaagtattcatcggctagatcccctcctttcgcaatagattggtttttccttgcctcatcttgttttattcttctctcttcttgttcacatatgtagcacctgtccaatctggttgcaatcccgagtttgtcacacgagcatcattattttcttgggctgatcggcaatctcaaccccactgaattcattattgccgaaaccaataggatccctttcagattagccaacctgaatctaggtcactagaagaacaccttcaagtcttggccttctctcgagaaaaccgctcttgagaaaagtggggctgtgtggtataaacgtgtttcggctagcaagcatgttcattgggatgagctaggaatcagccaagcgcttgctcttactttggcaaatttggataatgacgaacccctgatggcatctgctgcctatttctggtccaatgcctttttgttcaatcaagggccgatgaccccaactctgcatgacatcaccatgattactggattagatgtaacttcatcagccaaccccatgagtttaaacaccaagaaccagtttgacttcaaaaccaagagcataggtggctggtctggttatgtagcagcatacatgggcaaaggacctgttacccctagggagcacacagcttttcttctgatgtggcttgagaaattcctcttctgcggatcaagttgtggccctaccaccaactggcagttcttagccgaagcccttgagacaaagaggcagttccttttggccaaaattcttctcggctatttgtaccaaatgttgaacaacgcatcggctaagattgctgttggctcagttgttagtgcaggcgggccatggtggttgctgcaaacttggataaactttgtagccatgaaagctgtcaatcggccagccgtaacagaagctgaatttccaagattagagccgattacagatggtgatggagaagagcgcacccaccgcaggtgtatgtcctatgaggaatatgcatccacaccagccgatgctggagcaaagttattggctgaattactcaacgattggttctgcagcttttacgaaggcttccagaaagatgctcgggtttggttcccatatgaagatttagtcaatttggatctcccagccgacttcagatttgaagatatcaactccgaaaaatttgacaaatccagagaagtcttctcagctgctattacccatgcatccttcctgtcggcattcatcaaggaagaaacatacaggtttcttatgagttttaccacccgatgagctctgccagacagtttggaatgggacagcgaccaatcggcttgttctttgccgataaaatccaatgccgaggagagatttcatcaaccctgatgatggattggctactcaacatcccaggacctcctttgggcagcattgataacatagagctggcaaagtttaggagcaaaaactttgacagatgctggggagaatggaagcaacacatattccatcaattggcctctatgtatatgacagacctatttcccgatgtagtccctcaggtacatctttactttgtcaattttccttaaatgattgttagccgacttgaatcttgactaatttctctctataccttacagacaacagaatcttctcctccacgcaagagcaacagtggcaaagacatagaatatgctccgggccttttgcgaaatggtggtggattaactcctcctgtcatcggctaccatgcccccaagacctcaagtttgcttcaagggcagatgagagaaccagccgatgttggcaggaagagaaagaccaaggcaccggcaatcgatccatcggctttggctcccatgaagaaggccaagaagcacaaacccaagctagccgatgacttgcccaccttagatccatccattcagcaagctctggatgaagaagaaattgaagaggacgttgatcaggcagcagccgaattgagtgatacaggagaaaaaacaccgtcggcttcgcccaacaaactcctccaactcctgctgtcccggctcacttatcaagggtaaatcactcacattaatttcctcttgcaatcattttattcatagccgattacttatcaatttcccatttgccgaaaaagaagatcgctgaaaagaagaaatcagcagcaacaacgcttaaaccggctccaccagtaagattgtcatatataaatcctttcacttatcctatcacagccgatatttacttaacactttgtctttttgcaacctcctcctccttcaccacctgtgcaacagatgtcaagtgactgtaccccatcgactacaggaagccaccatgttgaagaagaagaacaaccagccgctcctgccatcccggtaagtctttcattgacataagatcttagatcggctaaaactaattgatacctaactatcttcaaatttctctttttgcaggccttagccgatctattttcttttgacatcaaagattactttgatgaagaagcagaagatgaatccaccagcaaggctctagcccctctggatgaaactgtcaagaaaatacttgaagacatatcccttcggctagagtcatcattggataatctggtggcggactgtggttcatttcaggcacggtttgcagaaatccaagcccaaatcccagacgatctggcaaacaccattactccagctatatacctcgagcaacatcaattcaacctgaagaaggctaagcaacggatagccgatcggcgggaccggaaagatatcgaagacactatccaagccaatcggcaactcgtgcacgaagagaaagctaagttagatcagctctctgtcaggccgattcaatcgaacatagatcggcttgaagctcgcaagattgatcttatagctcaacttgaagaatgcaatgccgagttgtatcaagtagggcagaagctagccaatctcccaagtgctattgaagaacagaagtctagattgagatcggctatcaaaaatgtggctgacatgaccaagtccctcaaagtcatctctggaaccgatgccgaagacattcaagctatcaaagaagtagatcaaattagacaagggactgtgtcggctatccagtgttacttgtctggatgattggtcttgtaataggatagctcattttgtaatcggctaagatactcattttgtgactgaattactatgccgattaatattgctcaaaaaatttgcaacttttgtatatatgtgcccccctaattttacaatgacgaaggcattgacaaaattataaattgaactgagggcgatataacaatatcagcaattgtatatcggcaaaacacaaccgattacaataaaaaacaactaagggaaatatatctatatcggcaattgtacatcggcaaaacacaaccgattacaatataaaaacaactaagggcgatataaccatatcggccatctaaaggcgatgtaaacacatcggttgtcatgtattggcaacaccagcccatcatgcattaacctaaacgcttgggtaatatttcttcaaatatttgccatttaacgctcgttcataaacttctccatcaagtccttgcaacatgtaagctcctttagatacgactttatggatttgaaacggtccttcccaattcggtgaccacttgccgagtttgatatctcgagtccctatcggcaaaattaatttccaaacaagttcacctttagaaaaagacttgggcactactttcttgttgtaatgtcgagcaacgcgttccttatccttagtaacttttacaagggctctcaatcttgattgaaccaagtcttccctttcatcggccatgagattataatactcatcggctatcaactcattttgcaactccgttcttcttcagccgattctaacttcccatgttaaacagcctcatgtccataaacaagcttataaggaggaacttgggtcgaactatgacaagccatccgataggaccacaatgcttcggccaatctagtatgccattgccaaggataatcggaaatcttcctcttaattagtataatcaaattcttgttagatgcctcggcttgcccattggcttgtgcataatatggcgaagaattcagcaatttgatacccatgttatcggcaaattgaacaaactcctcagacacaaaaatcgagacttgatcagttgtaatagtttgaggaataccaaatcgataaataatatgctcttgaacaaattatatagcatcccccaaatcaacttttttcaaaggaatcacctctacccacttggtaaagtaatcggttgccaccaatataaacttgtgtcctttactcgatggtggattaatcataccgatcatatcaattccccaacctctaaatggccatggcttaatgataggattcatagccgatgctggtgctcttggaattgctccaaacttctgacaatcttgacatcctttgtaatatttgaaacaatcgtccaacattgtcggctaaaaatatcctgcccgccgaagcaaccacttcatcttatgagccgattgatgagttccacaaattccttcatgtacctcgcctattgcaaccttagcttgatcggcactcaaacatttaagcaacacccaatcaatcgtccgataatatagttcatcatccaataaggtatacttcaaagcctcatagcgtaatttccgagaagccgattgagatggattctgtaaataatgatgcacctcatacctccaattatcggctcttattgcggcaacttctactttgacatcctttatcatcggcctatatccccatgcctcttgggccaaatcattagcttcgacattttgttctcgagatacatgcttcaaagttactagcagaaattcacccatcaattctcggcacttttcattgtaaaccattaatgtatcattcttgcactcatattccccggccaattgactgattaccaacaaagaatcacccataatttcaacagcatcggcttcaacctccttaagcaattgtaaccccttgaggaccgcttcatactcagcctgattattagttgcatagggcttgacagtataggcaaactcaaaacttgccccacgaggagaaattataaccaagccgataccacacccatgagtgcataccgatccatcaaaaaacaaagtccaaggcacaatttcgaccgagccgattgagtcatcacgatgatcaacaataaaatcggctatagcctgccccttaatcgccttcgatgactcatgccgaagatcaaatttcgtcaaagcaaatatccactttccaacccttcctttcagattcagagccgataacatgtacttaaccacatcggctttgcatattacagtgcattcattggacaatagataatgccttaacttcgtgcaggagaaatataagcacaaacacaacttttccacaggagaatactttgtttctacatccaaaagccgacgactcaaatagaacacaactttttctttcccctcaagctcttgaatcaagaccgagccgattgacttctcaccggccgataaatataatctaaaaggtattcctttttgtggagggattaaaactggaggagagctaagacattcttatattatccaaagccttctgctgctctgccccccaagtaaatttttggtcggctttcaatctgaacaatggtgtaaaaggttctaatcttccagacaaattagagataaaccttctaacaaaatttatcttgccgatcatctcctgcaattctgtcttgtcctccggaggttgaatcttttttattgcattaacattcctctgagttatctcaatccccctttcataaacaagaaatcccaaaaactggccagccgatacgccaaaagcacactttgtcggtttcatcttcaggctatacttcctagttctctcaaaaaccttcctcaaatcggctatgcggtcctctatttcctttgacttaacaaccacatcatcaatatagacttcaactagccagccgattagatcatgatatatgtagttcatagcccgttgatatgtagctccaacactttttaggccaaaagtcatcataacccactcaaacaagccgattgcaccaggacatctaaaagctatcttatgaatgtcttcttctgccataaaaatctgattataaccagcattaccgtccataaaacttaatatcttgtgccctgaagcagcatcaaccaattgattggcaaccggcattggatgctcatccttttgtgtagccttgtttaagtctcggaaatcaatgcacaccctgactttgctgtttttcttgataactggaactatgttgaaaacccactcagcatatcggcaaggccgaataaaaccagcatcatagaaacgtttaacctcagccttaacgtagaggtgtcgaaacgtcttgagagctcatcgaccaatcccctttggcaagtcttgggaagtcaacaatgtgatcgcagctatgttgctccaaaaggcccaaagcgaaggtggccgacacccgagcgtagcaatcgccataagcgacggcagtctcagccatggcgctgcccgcctgttgggtccactccatgaaggcaaggacggaggcgtccccggtaggaacttcactaaccttggcccccaaatcagttagcgccaaccggagggtatggcaggcggtcttcgcctcgtcggtaacatccttagtggcggtcctctctgactccaattcctggcgaggagccttcatcttgctctcggaatcattatagtagtccacaaggccctgagtttcccttttttttcctcttgagctcaagcctaagtcttttgatcttggcgttcgcatcctttagtgaactcacaagcgcctccttttcaaggtcttttcggcccagctctccctccaacgaacgaagctgggacttgtagctatccaggtagaccctcgccatctactctattgagcattgagccgaaagagcctgcttaaacaaccaagtagtttgataaatgggaccacgtataacaaaaaggaaacagagcaatcaacgttcgtacccgaacgagcaggcttttgccgcagtgcatccttcatcaaactcgttcagctccgtaaaaggaacgaggccgcccaccggcgaaataaggtgcaacacccccttcacaaaaggaacaagctccgcccgggtctcgaagttagacgagacaaagcggggggcggacagcgagttgtccgaacccaaggtctcagtcgctgcctgttttccccatgggggttcaagtggcgaaaggcgggggccgggaagagggggttcgaatgccacaaaggccgcttccacgacgccttcggcagaagcagaagcacctgcccggagctcccacccacctcaccggcagaaccagctgcggtggcggcggccggcagactcgggcttcacccggctggcgaagtgggggtgtcctgtgatgagtcactgtctctaaacgcgttgccaacttagacaccaccctcgtagccctcttcgcacccgctccgacatttaacggagcaatccccgcaattgcggccaaagccttcgcccactccagctccttctgcgaagaggggacgagctcgaagctgcccccgcctcgacgtgctcatggcctgggtcgtgtctgggggagaacagatattcacccgtctcatccacggcatcctcctccccctcttcttcgccttcggcctcctcctcgtcagcatcagagtcagcaaaggatgccggtctgtgtttccgcggtgcagctttccctcttgcccgcttgcccttcctagatggttcggcatcatctgcgtcgatgacgacgaccttgatagggtttgcacggctcggcagctcgccagaaaaaatacggtttgccgcctgtctgacgggtgagcagctggctaaacttgtttatgatgagctcctcgatcattatttgggcctcgatttcagcctgaggcagtgaaagcactgtcgaagtaagggaaaaggaatgagcatagtacaaggtggaagcataggcaaaagcaacaacatcaaaaaataacgatatcacgagttaaatagaaaactcacagttcaccccctcagggagcaccagcctcggcaagccatccgcctcctcctccttgtcaacttcgacttgccatgtccatgaaaggggaagaatctaaagcatacaaaactcttccaccaagacacgacagctaagccaaagagcagtcttccgaagtggggcgaagtgagcctccattgcactgtcgatcgccactttgggcttccgaatacgcacgatggccctacgctgccactttatggccctggctgcatccgatgcggcctcaaaaggaatgctgttgtaaaaccttttcggcatccaatggcgatcccacttaggcatcgatgcattcacgggccacaaatcggagagctcagggcggaaattaaagtttgtgctcccgaagaccgtcctccaggtgccggccagggtgaccaccgtcttcgagttgacaataacataaaagatcgccccaaaaagctcagcggtcggctcgaaacccgcggttcgacatgcccagtcgaagatggcgacccgaaccagagcgcacgggctaagttggggcaattcgatctcgaagagccgaagtatctcaagcagcaagatgttgcacagaaatcgaagccccgcatcgaaaatgcagcaaagaccacggtttggttgtccccaagcttcaccaccaccttgccaggagcgaaggcttgtccttcggccacgaccctagccaaaaccagcttcgtcaactccgtctcattgataagtgaagcgccgagatatccggtgtgatctctgccaatcttccccagatcaggaccaatggccaaagcaagagcaggtttatgaggggccatgggcgaaaagtccggaaagcccgatgtaagagccaaggtcacgctggccgaagtaggtgacaaaagcccgtgaacgcaaggagaaacaaagcgataccagccacagaggagatggaaaaagtgactagaggtaaaagtgaaagtgacgccgggagggaagtatatatataacccacccgtgcgacggttcgcctaccacccagtaagggactgccacgttaaggcaggccgaacagtgaaaggccgaaagtaacggcagaccggctcatctagcccattactgttcacgagaatcccaacatattcaaccatttcaccaataataagcgaggaaaggaaagaacattgatcaccagatctgctaatgcaaaacgccagactttttcgcaagtacaaaatataggtttcggcaggaacatcggccggaaggaggcgcctcatggtataccacacgatttgcacagcctcggccgaagctccctactcacccttgccgtgaggggcttgttggaggtataccacgaggaccttcgaccaggcctaccaaaaccgaggagataggcaaaggcatgggacggaggcaagcggcgaaggtcgaagggacaacataggcgaaagccgcagcatcaatttgacaagcttcgccaaagatggaccctgttggaggggcgaatggttgaaggccgcgaggcgagagccttgccacaaagggcatgggtttcgccaattattgaacattgccaggagaaggcccagcgggccgacacgccttccagaggcttcgccagggacaaggccatgtcacttggcccattaggaacccatacgagcaaaagacactgtatacccataaagatgtccctattaaaagggcaaccatgtaaatttccctgtaaagcctaaaccgccatgtaacagggggatttgaaaaaaatttactaagcaatacaattgtctttacttccaaccactgttaaaagaaccacgtccttcgacgtgacgcagttgttgattcgacaacaatatgtatactagaagtataggaatatattcttttctattttcttcccacttagcttagataacttaataggagaatgagaggtcttatgcttatgtgccatgctaccctttgaattatattaacccctgcttagactatgattattacaagtaacatatgaattattagtaaggttctgtctactataatcttcccacgggattaaataaatacgatacccttggaatactctcgggtgaaatgctacaatggtatatccatgcgcttgtggatgaactctataaccataatataccaggagtatttctgcgccattgctgggaattatatttctagtaatgtcgttaagaaataccaacaagcatttctggtgctgttgccggggaagatttatagaagagattaccaatactaatactttctatttacctctgtataatcactgtcctttgtaggctaaccttggttgttatcacttttgttgtggaaacagggtagtgcatgactggtttcaacttgccgaaaaacttttaaggaaaatccagaagctttctttcggagcgtcaagccgagagtcgtcgctccacaaaaaactctcccgataaagaaaccagccataacaatgccactaaccttcaagactatggctgacaagaccctccgtgaattcgttgctccctctgctgacaacgtggccattggctcgcaaatcaacatgggagacgtggattttgatctgaagtctagccttatcacaatggcgcaggctagcccgtactgcggcaagcctaacgaggatgccaatgcttacctgcaacaattcctggagatctacaacacgtacactatgaaggaagtcagtcctgacgccatcaggctacggctgtttccagtttccctcctttggaacgcgaagcagtggttttatgccaactgtgctacaatcaacacctgtgacaaatgctctacggcattcttattaatgttcttcccgaggggcaaatccaacgcccttcgtggaagaatttcaagcttccagcagacgacggacgagtccattcctaaggcatgggaacgacttcaggaatatgtggccgcctgtcctcatcatggaatggacgactggcttatcctgcaaaatttttatattggattcactcccatgtctcgcgaccacctgaacatggtagctggaggagcatttttctctaagacggttcgagaagccatcgatttaatagagaaaatggtctccaatatgggttggagcgaggaacgactccagacccgtcagcgaggagtgcacaccatcaaggagatggagattcttgctgccaagctggacttcctcatgaaacgcttggacgaccatgacaagaggccacaaggcaccgtcaaggccttggactcacacgtcacgtgtgaggtccgcggcagcacgggtcaccctaggaatgactgcccggagacccatgaagaggcgatgtacatgggcaacaacaataatgggtatcgtccacaaggaggtcaggggtggaaccagccatgcccatattaccaaggaggtaacaacaacggtaacttttctaaccagccctccttcgaagatctcgtctttgcgcaagctaaaacaacatatgctcttagcaaaaagctagctgctaatgacaaggacttagagaatataaatgttaagctagatggctttgcttctgcattccaaaatcagctgagctttaataagatgattgaaacttagctggcacaattagctgtgttagtacctgcaaatgagtctgcgaggattccggggcagcccgaatcttccgtagaaatgttaaggtgatcataacgaggggaggtaagtctactcgtgatccgccatatcctaaccttacaaggactagcagtatcaccagagaagcaccatccggtaatacgactgacgaagaggttcagcaagagaagactatgccgcaggagtactacgacacccggttgctgccgtttcctgaaagaagcaggaaaccgtcagtggacgagcagttcactcattttgttgaagtaattcagaagatccatatcaacgtgccattgttggatgctatgcaagtgccaacatacgcgtgttatctcgaggatatcctcaataacaaaaggtcgcttccgacaactaaggtggtcaagctgatggagcagtgcagcaatgccatactccagaagctcctagaaaagaaggatccgggtgtcccacgatcacctgctcaatcgggacacagcaattcgaccaagccctctgtgacttaggagcaagcgtgagcatcgtgcctaaagacgtcttcgataagctcaacttcacgatattggaaccaacaccagcctgtagttggctgattcgtcggtccattacacatctaggatagcggaggatgttccggtcaagatacgggatttcttcatcccggtggacttcgtggtgctggacatggacactaaaaaggaaacgccgctcattctggggcgtccattccttagcaccacagaagccaacattgacgtgggaacggatagcatccgtttccatatcaacgagaaagaagagaaatttgagttctagccgagaaccgaacaatgctccatggtccggattaagtacgggcaaacccgcagaatattcaagtggtcgaagtggagccacccaagatgaatattctggtaaaatttatgcagaatatctaggaaaaggaaacaacgattcccaggaaccgttattggaagacgctagtaaaactcaatacaccggctaagaagctagagaagccggctcagaagaagccgtctcccgcacgaaaactaaagaaggtgtggaagcaagagccaaagacacccgctccaccactcggcagacgggcagaaaatccgcgatctgaactgaagggaggtacggtcttgcacgttggacccaaaattacgcgatattcgccaaaaggtaaattggtatgtatccgcatatttattttcaacaatttgaacttttgcatcaatgcatgtttgaatttcaaatttttgcatttaagattgatttttgaggaaattctttcaaatgatttttcaaacaaaaataaaattttcaactgaaaatttattgtgccacgaccacactgaccattggaacccaacggccaaaagtggggccggttaggcccactaggggttcggccgaaaccctggttcggccaaaccggttaggccaagaaagaaacctttctaaagataaaaaggaaacataaagtccttatgggacactaaacacaccttcctaaagataaaaggaaacaaaaagactcttcgtaactaatagataaactgtcatgttgcatcctccttgaactcagtcacttctggataaacttcctttagtagattaatttccttaaccaaatacagcaataatctgactattggcgacttgataattcccatcggccgattccaggactatgaagccgataatgattttaggccgatgacgtcttcggggcttgccaaatttcactgttaattgataggtaggtaagggatattgaaggaataaatttttttgatttatgacctgatagtggattagaatgtagaagttgatttattttaggacaaaatttgaattccagaagcagatttattttgggatggagggagtagattactgtagcagattaatcctgtagcaaatgctagcaaacggtatactctgggccggtttggcacagctctagctcccaactccaacttatatagagccggagctgtgccaaacggtccagatcctaagttttctagagtggagtttgtagagttgctcctaaaaaatgaactaagggggtggagctgggtttttctgctccacagctccactcaaccccaaaggacccactaccctttaattatttgacatatttacgtgaaactgccactaacctacccccacctcctcacctccctcccgtaactctccaagtcccacccatcgagcgaggcggcagcggcgggcgaataggcggcagtggcgggccaaccgtagcgcgcggccgagcaacaaggcgacgagggcgcttcggcggtggcttggcgcgggcgggcagaaggccgcagcgctctggcggctgctcggcgacgcgtaggcgggcagcaagccgcggtgctccggcggcggcttgacagccgggtagcagggcgacggcggtgctctggcggcggctcggccaaggaagagcgctgtaaggatggcagcggcggcggccaaggaggcgacgggggtggaggcgtgcatcagctcgagaaggagcgccgcaagatcaagatgttcaggcgggcagcaggtcgcggctctccggcggcggctcagcggacgcgaccagctggccgacggcggcgcacggccggcggctagggctgtgaggagctaatcccctctaccattttttcattttttttccaatttgaaatctagaccaaaagaacaataggtgattttgcatgtatgtcatgggtgattcttgttttataagaactatgtagaagtgaaaaattatgtgtttatacaaattgaagtgagaacaaaatggtagactatacaaatttcagatctaaaccaagaaaacacttggtgctttcactaattatgtcaattattttgtggattaatttttaaccttgcattttgttgctgaaattgtaaagaaaaataaacagttatcagtcatacatcacaaaaacagaaaaaaccacaagggtacttttgttaacctccctcatatcctctgtttctagagttctggagcagaccaagcttgccaaacacttttcacataacctccagctccttggagtttggagtcctaccaaacagggcctacgtatatcctgatcgttggatcctttgatctaacggcactgaaggtctaaaactgctaagcttgcagtccctattcaaacagcatgggatcccacattcaagcatgaaaagttcgaagagcatggatttacccggccacgcagtcaagcgaac

SEQ ID NO: 64107 - DNA, 2334 bp, Oryza sativa
aggggataccacatgcaccgtcttacatagtccatcattggatggggcccacatgtcctgggtcaagccgtcgtccttgccttcgaccgaaagcaaggcggtcgttcgcccccaggtgggtcccaacgccgtcctccggctgacacgggagacatccttatcattccctcttaattccatggagacttttctggattcgtgtacgagggacacgctcggctacgtgccgatgggacaggcatacctacccccactctgcctgacagggggcaggacgtgggtgcgctgccacccatctgcctatgaccggtcacagaccaatcaagcccgattgacgcacgtcaatcgggcggcgcctcacgcccgcccacgtcacattaaacgcgacgagggacggttggggcaccgctcatttaagacgtttggcagcgcctctccctccgcccactcagccaccacgtggaagccgagtgagggcctcggggcagcatgctccaagggcccgaggggtgcgacagggcaccccgaggccccttggccgcttcacgagcgctcgttctccccgggggaggcggggggacaggccgcgcggccacgtggccggatcgaaggattctttccctctatcttgtgtaccgcggggcccatatcaccaacaaccgggtacaggcaaaagacatcagccatcaggttgggagcgcgtcaggcggcgtatccctgatgcgagcgaagacggagacagaccatgggcgtatcgttggcgtatctcacgtcatgcacatgtgtttttccttccatcccgaaccaatgcagtatgccgatgtcagttatattttattttgtttttttacaatcgtgaatatgtgggatacgtatcagtatccgtggccgtatctgatacgggacgcgactttatagccatatcagcgatcatcccagtccacctatagcgaggaattagttttttaaacggaaaactctgataggccacacccctttcctttcaagtattcagcattggtattaattgcttttgagcttgacaatactacttagtatagcaattaaatgtgcacgttacaaatcaaaagtgagtagggaaaagaagcccttgcaaatacacggccgaaagcagaagtataacttggaagatatgattatggctgagtttagttctcaactttttcttcaaactctaacttttctatcacatcaaaacttttctacacacataaacttttaattttttcttcaaacttccaattttagtcaaacttccaattttgaggtgaaactaaacacagcctttatcactgaagtagtcctaacacccaggataataatcgcacaatcacactgtcacatcaatgacagaaaaaggtgctatcagcacagtgccggaatatcggtgcgtttagttcacgccaaaattaaaagtttagctgaaattggaatgatgtgatgaaaaattataagtttatgtgtgtagaaaaattttgatgtgatgaaaaaattaaaagtttgaagaaaaaatttaaaactaaactcggcctatataaacacatatttgtagtagtactagcaagacatggatcaacagaaagctttcttcctttctttcttttcaccacgggcggcacaagtcccctgagctgagactacagcgttccattacatcaacctttttccactgctactcatcagtgtcgagtgtccaccaaggcaccaacccatataaccacatttcaccgagctgcctccgtaatttcatgggacaccaaccaagcagaggctacaaaaaaaaaacacatcggaaaaagatcaaaaggggagagagagagagagagagaggcagcactcgagtggtctttggcacgaggaaatgacgctgccggacacatcatgtccatgtccatctcattttactactactcctaaaacgcacagagagacaccaaccaaacactagtgctgctgagacaggtgagggagatagatgaatgggaaagtttgggccgtgcgaccgtggtgacagcatgcatcgatcacgatggggtccgtccatgggtttctgcttcactttacaacgacacgcaaaacaaggcaggtttggtatgtgtgatcgatcgatctatctggtgagatccctaggcaacgcagctgagtcccaggcaccccatccacaggctcctggtcaccctcttctgaaaccacatgaaacgaagaaaagcacaagcatcagtgaactactcttcattaagtataattgcacaagcatccgtgttgggttgtccataaaaaaactttttttactgaacatgatttttttttcag

SEQ ID NO: 64108 - DNA, 2615 bp, Oryza sativa
gcagttgtacataattaattatggaaataaagaaccttatacactggcccgaatccaccttcgcctagaatattttgagaactgaaattgtctgtggctagctttagctcagcataactaaaaacgtcaggtcgtccaaccaggttgtatagttctgcatgttatttttagcacagatgagaagagtaaaccagataattttgatgtttgaattatatatgtcctgatatataataccttctttctgttgtgccaatgctctccgcttctttactagtgtaaacactccaaataatgctgctaatactaaaactattgcaccaatcaatattccggaaattgcacctgctttacttttcctttttggtatgccgtttcgaacggtaggagtaaaatctgcaaaggaaaaatattatttatcggcagcgaatataacacttcctgctgttgttttagtgtggtgcttacttggagtgacgctcaatgctgagatcattggcccatagtaattatctttagtaggtatgtcaacagtgcccttgccagcccagaatagatggatctcaaggaagtttttagacacagttaccatgaaactcctattaactacggtaaaagattttccacctgctgttttccttatatcgaaatccttttgttttagagcaccctatgtaaatatcagtaatacttttagataaatattggtaagattcagtagaaaaacattatataaaatgcacaaaatttctacctggatatatatgtcaaaaactcttctccctaagcttagccaagtctgtgagtctggaaaagctaattctgcgaattggagcaaaacagtgtaatttccattctcaagtccaagtccatagtacctcagagatgatgatgacatccttgcagtttcaaacaactctgaatcaactacattttgaaaaggttgggagctatatataatattctttgcatctatggcgttccctacactactgacaccccatcttgtttgaccggtaacataatatgttgcagctccaagatttgtaggatctgcttcataaatagtgtcatctgagcctcttatggatgcattactgccacagtcaactgcgaaggaataatctgcaattaagattaaaaaaattgtagccatcattcaaattcgtaagttcatgttactgtttagttttatgaagaatgagaaatatacattctggagatccacggaaacaaggggtgtcttgttggaggcagtttattccccaaggtagcgtactgtgcacaatttgaattgaaaatttaaagttaccagcaagattttcatatagttcactcgccaaattagaactaaatgtcacaagtacctttcactggtggtatcgagtaagaagttgtttgccaccaaattcctttcaaaaaacagaatattagtatttatattttttctcagcgacacaaatatcacacttttacacttacaactgtaaattgttttgtctagcccaagaaggaatgctcccagtgagttggttgtacgaaaaatctctgtcaacattccagaattatgttatacaaaattagtgcgtactattatgaatgtagtttgtgctatactgccatgtcaattgtatttgacatacatcacttttaatgaagagcttataccatccggcaactttcctgtaaggctattgttcccaagaaacctgaattgggcacagttcaagattataaaatatactcatctgcttaatacaggctcgtatgaacaaattgatgtaaagaaagaatttcttacaaagaattgagatttcccaaattcaagatggattgaggaacttctcctgtgatattgttaaaactcaagtccctgtgccacatgactatcatattacttgaacatatggtacacaacatgaggaaatgagtaataacgtcatcagttggcaccatggcctgtaattgaaaacttacagcaattttaactgtttaaacatggaaaattctactgctccgagatcactagatatcttgcagttcctcaatattctgtaacgaggaaatacaaccttggtaacttgcaactagacaatactgtaagctttatagctaaaagcatcacatacagtgtgctcagggatgccatattactgataaatgccaacggagagaccccatttataatatctccaatccatctgctcatttgagtttttcataaattagttatcagccttgacattgtcaaccttcaagagttcatgccacaaaaagagtatacttacaatcttgttaatttggtcagattagacagactttctgggactggtccttcaaaggagtttccgtggaaagcactacaagctcattattttagaaaaaaagttagggacattcaacctttataaagtaagaaaaaaaatctctgtgtgagcattcttaataagatctctaggtatgaacatgccatgtggaccgcttactgtgatgcagatatctgcatttatattgagtgaggactgaaatgtgaaaaaatgcttttgtttaagtctgaatggagataatgtgatatacagacagtaatttatcttgcacagattcatctatctctg

SEQ ID NO: 64109 - DNA, 8837 bp, Oryza sativa
gtgtttctgtatcaaacgtttgaccgttcgtcttatttgaaaaaattatgattgtttttaaaaaaataagtcatgcataaactactattcatattttatcatctaataacaattagaatactatttataaaaatatttcaaataaaacggacggtcaaatgttgagcactaaaacccacaactgcacttattatgggacgggggaagtagaacttatgcgattgctatttcatgtattattatattagttcgtgcagtccaaatatatactccactcatttcatattatctgtcattctacttttgttgtaagtcaaacattatatttctaaccatccatttttacatatttatatagtttaacatttagattcaacatgagaaataatttcataatttatagttcgtactccctccgtaaaaaaaaatacaacttctagctaacaatttacacataagctatgctcagattcgtagtcataagttcaactctctctctatatatatgtgcgcgcacgcgcgtgaaaactgctaggaattgacagttaaagctgaaaggatgagtggtttgtagcagagggagcagtggaagattaatccacatgtgagaaaagatttcttacaatgaaagaagattggtgaggtttcctagttcctttggaagtagtccagatagtggattgaaagataatgaccttgagatgattagcaataattaaaaaaaaacaacgaccaatagatggaacatgatctagaacaaacatgtaactcatacaagtattgcattgaagtaaattttccgatgaacgacggaatgggaccagtcaagtaattacggaataagttcctgaaaagatcacaaaaataaactagaacaattagccaacacaaaaataatgatgaatacctgacaagcatttgttggtgttcacagaaagaaccatgggattgaatttatattttgtgcaaacccttgatctataaattattagtacaagactctttagtagtgccacaccctgattttgtttcaggaatttataaattatttaataaaatacttctagaatttatattaaagtgtacattaattaagaaaatgaattaaagtgggaaataaagtttcctaaataaaacattgctggatttaatttttattatattctccatgattagtttacactctctagaattttttcggatttttcagagctcaattactaattttaacaatacaaacatcaattcaatggttatttaaatataaaataaattagaaacccctccaaagttctgggtcgaattgagcccatgtctctctctccgcgctcagcgcagctagcgctaggccgctagcctaagtcaccagcccaccgcctccctcctctcactcctgccaacatgtgggatctggtcccacatgttagtgttgtccccagcatccagccagaatcacactgtctgcgttcctctccaaatccagccgcctctctagatcttttccaaaattagttgaggccgtttgttccctatctcctctttcctttccccatgaaatccccaaaaatatctaagtaaatcgtgtggaatcgagctcgaactcggacactctctatccggtagaaccctagtttttcccagcgctgccatagccgtcttaggcccggatacattatctcgtggctacaaacaggatccccctccctctcctctttccgctgccaccctcgcctgcacaaatcggagcctgtagccctagcttcgccgctagcccatagcatcagcactgctgccaccttccagtcggatcacgtcgttgctctactcgtcgccgctctacttgtcgccttcgcccactgtcaccttcgccgggtgcgcaaggaggaggcgcatttcatctgccggtcctccatcaccctatactgccagaacaccgctattgacgatgacccgagctacaccgtcatttccacctcgtcgccttcaccgtccgtcgtcgcaacgcctctcgatgagttcggctcgtcacactcaacctctcggtaccctccgttcatgctgccgtgcctgattcgccggcgatctttgggttccgagcaggtcgtcgccggtgaggtgacatcatcaccacgccattgctattgtgttatcaccaaaagttggtaaggttccttagtggatttggttgaaggacaaatttgatcaaccaatggaagtctatccagaagataccgaattcaaaaaggattgtgaagaccatggcatggcatattaattctatctgttgatttagtaactttcctttaatctttaggaagttttatctaatgtctgattaagacttgtattttttccttttatgtttagcaaacctatgtcttgtctgattaggacttgcatcaacctgaggagataaatatgtaccacagggtctttgtaaactttctccacatattaatacaattactttcggcgcattgcaaccttttgttctagcaagttcttactttgagttgggctgcattggttttgatctccaatgaggaagtaatttctatcaacttttcatgtatcgccgtggcaagaactttctcgattaagtcaggtattctttttgggttgacgcaagcattacatatccgatatattgattctatctttaactgcattgccgtttagagttgcatcgacttagttaggactttcttggttaggtccgatattctgatttagttgatatttctctaattatactattgttttagatagatttgttatatccatcacgtctgtgtagatttatcggataaataggttttttaggggcaattgcttatttgaccatgtttaaaagcataactactaatttgaccctacaattttcagtttgcttatttgaccctgttcatcaaaatcaaatgaaccgtctgaccctgttccgttaaggcgggttaacactgttaaataagaggcaaatagtcccttttgcccttgcttatttggccctcttgtatccaaacattcatacaaatggatcttttaacaaatcagaatcaatttgacaaatttaatacacagtagctggaggttgatgctgggtgccgccgccgaccaccctttgcacgccactgctccccgcgacagcgccgctgcggacaaaccgatgcctccacaagcgaattaaacggcccatcgaatgaactcgcgagggaattcttatactcttgcatgcccccttcacttgtagagaaacgtctaggcgcagcaaattaatcaagtgctctgataatcaatatctcatcaaggttatccaagtagtagccagatcaatatctcgataataatccggaacacgttcaccatggtcgtcggcgcacccaccgtggcgttcttcttgagagacctgagtaggtcgtcaacgaaacgctccatcctcctccacttctgccgcggtcggccgctgatgcgacacgggaattccgagatacctacacgcatcgcgtgatgccgcggccgctccgtcgcgcaatggcgtttgcgccgacctccctatccgtgcggcagccgccgcttccccatgcgctgccgacgctgctgctccctacctccacgcatcggcggtgctgctagccactccctcgacgcaccgccgccaccgcagatccatttctccatgtgccgcttgtaagagatgagagagacaaggtgggatggatagggttgaagtgccttgatggtattttggtcagtttaaatagtaaatagattttttttctttttctagaagaaaccctaatgatgtagtggaaagagggtcagacggagtgttcaatttaaaaaagtcaaataagcaaactaagaaaaacatagtcagattagaagttaggcttcaaaacagggtcaaataagcaattatcccattttttatcatcttcaatcttatactgtctcgtttaggtttgatttattagattgttgctaatatgtaattatattctactaagccgataagtttttatgcaacattttattagagttctagccaattagttatcttgttactacttctaagtgttgtatcgtcttatactcaaacttgtataatcaatagttaaatatctctttatcaacttcaatatcataccgtctcgattaattaggtctgatctatcaagattatctttgattaggaatggtttattgacgattgatgaaaaccttatatacatcggctagccttgctacatcacatcagcctattggctgatcggctctttgatcttatacaatccatctatctatcttcttaattgtacgatcaaactaaccgccacgccctacacccgattgatacgacgagctatgtggatctctcaggccttcgtgtgcgacaaatttcacgtcaacatgttgccacgtggttccatctaaaccctagattgaatcggtttgagccgtcagatcttggttaactcttggttaactcttggtcaagatcaatctcggttgtccatctcagtgaacatgtggtcaatctctgtggacctactctacggtggactgattgctgatgacatcataatttatctttttcttctttaaaataattataaattatgtaataaatctatttaatccttttaaataggctttagttgaattaaatcttgtaaaattcattactaattcatatgaagtcgaaatgaggcagttcataattcatctaaaataaagctctaaatgtttgtttactttttatgtattgtttatttggtttttattagtcttttttctcgttttgcatgttagcttgtagtttccatcctttttatatattgtttaattgattattgtaaggcatgtcacacatgtcccaaacaatccctttgagcatgttgataaaatatttaaattcttcttttattttaaatgtgcatttaatttcgaatgtcattaggtggtgggaacctttcctttgaatagctagtttgtattgataatcctgttccttgatatcttgggatataatttgactagcttgagccatatatattggttcgactagatattagtgtaattgcttagccatgctaagaaacattagtatcattttacatgcaataactaatgattcactcatgattaatgatggttaattaatggtatgttgtgatgtttggtcatggttgattaataatatgctaactaaaacttgactaatggtaggttttgagcacatggatgtgatgatcatgctcatcacaattaaggaccggttttgtatagcatgattcatcatggagcaccacactaagaagtggtagagataggcccatgtgggtcactgcggagtctattccgggctatggaaagacgatgatccgggaacggtgaactactttgagttgagctatgcgaagagtcacaattttgcacgtggtgacatattaagcgtgggcacacgataacatggtgacatgttgtggaattgtcttgtgggtatattggtacacatctgactagagtaaaacttttcaaatagccatacatgcggttattggcaagcctagcaatgtttttttggtgattagtcacacactactcattaatcataaataaattggtcataacaatttgtttgcattttgtatggactttagatctgtgtagtcgggtttggttgtttagagatggttgggcctacgcagcataggtatgctattcagagttgattttaaattgattaattactctcaactatttactgaatgttgcttttgcaaatgaaccctactataccttcctttgtatccccatgcacctgcattttttctatgtggcttacggagtattctatttactcaccttgcaataatcatcaaatctcagttgaagaaagttttcgaaggagaagacatgtggcttatacctcagttgaactgtctgtgagagtggagctgaagctaatgttagattgtttgttacctgttgttttcttttcatttataagtaatatctaacgtaattataatattggatctgtatattcaattgtcaattttagtatctcagctaattagtagatgagtgtattatatgcacaacttagttcggaaattactagtgaatttccgaatgtgacaggtagcaagataaattaagaagagaagtcttcgataccgtacaggtccactagatgggtgagattctgtagctccgcaggtatttgaccaactacatccaaataagttaccctcctacataacaaacaagtaataattctgataagagaactatgttcaggatacatatatacagccggaggaccaaatgaatacctccgtttgggtccagcagatatgtacaatttttctttagggaagatctgtaccaaatttaggatagacttttctgattcctctatatgcagccttggagatactaattaatatcaataatctggtgtgtgtctatatatatatacacatatatatgtatgtatgtgtgtgtgtgtctatatatatatatatatatatatatcttaatttgcatacttgcatatacgtgtatatgggctagcacacacgatgaaaccacgataaagataaagagagtgtgcgtacagtctcgtaatgtggcagagggtgttgttgttgaatgtgcaatcgcacttgatgaacgggttgatgtcgcggtagttatcccaatcggttttatcagctgcgaaaccgctgcagagctcaccgctgatgttccactccggtgatgccttcttgccccatctccctagtatcgtgttcagagcagccgctgcatggttaatttattaactcaccattagtaatcatgcggatgaaagctacgcaatagtgaaatcagacttcatgaaactcacgggttgctgcgtaagttttatacagtaataatagaaataacatataatcagtaggcataacattatataatttcatctttatcgactgcagaaaaaaaactatatacaattaggatgttatttataataatttaaactagattggccatttaaaatcacaacaatagtgatgtggctaagtacatcatcttaaatataaaacaaaggtgatacggcttaataacaaaagaaaacgtgagagataatttgaacaatatacctatctcaactatcatagggataaagaaacaatttagatgatgtggcttaataagaaaagatataaatagcattaataaccactgtagaaatgaactttatataaatatataggatttctctaactctttggtttcaacgcggcaagagcggacacactatcaaagttattatcaaccacaaattagtactcctgcgatcaaagtacatggagggaaaccaaacaagagagacatgcatgcgtggaagcctgccaatggtttgaaatccaatccacaaccagcccaaaccaaagcagtaagctacacaagtccaaaccactctaattcatttgtcttctcttagaatccaaaccaatccaacccatatcatatttcaacccaaatcaacccaacccatttcatctatatggattcagttcacttttccagtccatttcaccccattccaaatcgacaccaaccacatgtcggcgacgaggtgggcgaggagcatcggcggcgagccgaggaagtcgcagcgcgactccgagcaggagcagggcgcgtgcgggcaggcgcgctggtggccggcgacgtcgtaataggcgacgtagctccagcagccgaacaggtcgttggggcacaggatcttggcggcgccgccgcacgcgtggcactgcttgccgggacgtcgccatggcagctgctgcacgccaagtgccccgccgcggactgcacgccaagaaattgccactagccgagccctcacgaatcgaatgaaagaacaacaacaagaagaagaatgtcagatggattggatgaacagctaggaaggaggcagatagggcaacggagcacggccaagtcgatccgcttttcttcttcttctccggctccggctgcagctccctcgccgcgcgccgcttccaccgccttttctcgcttcacttggccgttgggcgacaccacccacgccgccttcttggcgccgctctgctcgtcgtgctgcctgtacgccgcactgttcgcgctcaacttggccacgtggttcggcgacggcgtggacggcgagctcgtcggcgccatgcgcgccgtgcagcaggagttccctccgcttcctcccccgcgcccgcgtcttctccaccttccagaaggcggcgggcggcggcggcggaagctctccgacggcgaacctagtgcggcggccggacatccaaacgcggctgcgcggcgaggtcgaggcggccgagggcggtggtgatggagtgcctctgtgtctgagacgacatcatctgctatttggggatgaatccaattgaaatccatggactccatccattttagacccaaaaattatgactaaaaaccaatccaatccaacccaaccatccctcatccaagctgctccaatccattagttatctcaacccgtttacacccataccaagtgaatccaaattgaaaaccaatccattagacccattccaatccaacccattggcaggctacatatacgtacgcgtgcattcttaattaccttcgactggatcagtttttggtgcttgttgatcctgagcagctgcaacccgccatgagcacaaattagcaccagccacgccagatggtggcgaatgacacctctgatgctgcaagaacgcatatctctccctctctctctctctatctaacaacactgtgtgcat

SEQ ID NO: 64110 - DNA, 3874 bp, Oryza sativa
cttatcaccattactacctttactactattgatgagggttatttttgtcatttttactcctcactaaatttgttttgggatgctaggaatctcactaaatttattttgggatgctaggaatcctcttttagcaagcaagtgttttggtcaaattaaagatgacattaacaagagcatgaggatgaccaactagtgtatgcccggtgagttcttaattaaagattagttatttttcatatatatctaaattcaagaaaacagcttgaaaaattctttttagtttttgcactttgcgtccttttattcagttttacttcgttaaagttttgtcccatatgagtacttgtttaatgctatcttaggttacgttcagcgacaatacacagagagaaaaattaccttctctttcaaaagcatacgcttaccgaaatactagacaatatttttttacaaaagaaattacaaaaagttgtatttttaatttttaagtttaaaataattaatattaattatcttattttgtgagtatgttttaatttttttttctttcgtcaactctcaatcataatgttaaaaaaaactctcaactagtatgttttaaagttttatggtgttagtcgtgtcaaaaacattgacttgtccacccgccgttgttttgactgcctgccgcgggaagggaaaaacttgccgtggaaatctgatgctgccacggcatcctttgcgtcaggacggcgttccccgttcttcaattttttgtcgatcagctctgttgaatcgtatgattcatatgctagctgtgtctataggatttggtgcttgcagaatgtattcttttcaccaaagtgcatatacacacacctagttgcatacatgcaatctagatagctatataaaatttttaaaattttcacaaaacgagtcctcctggtagatatgtgagcgtttgcacgattgtgttgtgtgtgcgttagacttgtactgacaaaaaaaaagaaatattaaattgataagatagatcatgaagatgtaaattactaaacaaatagatctaaacttagtctatactcactactgcagaaaaacccatagaggtgcacccttttttatttttataggtgctaaaaaaacatgaaaaaatatttggtatttttattacttccctataacgtcacacttcgcttcccacatatcacatgatttttgcaacccatattcatagacatgcttctaaagattcttaccatgctattgttttgtgattattgttatccaaatttataatgctcaactgaaaattttagcgactacaaaattgtagacgtcatctatacctacaacgttcatatatgttttgtctccatccgagatcatttagaaattttaaatattcacttatgtaaatagatctgaaacattataacacattttcggacatcagaaaaacattaaataaaaaattcatcacctacaaagttatatgtctcgtcaactacaaatttgatataaagtttatcttcatccaactttatatgaaaatgttagatagaaaatattgtgtcattattggtgccgattttagttgtaaaccaacatctatgagctcataagtactagtttttattaagaatcaacacatatatgatgcctataagtatagtttttattaagaaccaacacatatatgatgcctataagtaacggttcatgataaaaaccagtacatatgcttatagaggtgccattttattataagaatcatcgacacctatgtgttgtttataggtatgtaccagtttgttatagcctgatagaaaccgacacctatgatttgatagattattggtgctgacttttgttacaaaccaataccaataagtgattataagtaccggttcttaattttatactggaaaaaggtggagaaagcttcataggcgccagttttaggcaaaccgtcatatgtaagtccagtctttatgtgctgttttataatagtggctggataaatataaatagctagcaaactgtattgatgtgcacttattcatagttgtagcattttattattttagaatgttcaggcatatggctgtgttcgttgggtaggttgggaactcattccctccacacggaaaacggagcggtccactagcgtgtgattaattaagtattagctatttttttaaaataaatagatcaatatgattttttaaacaacattcatatagaagcttttttcaaaaaaaacacaccgtttagcagtttgaaaaatgtgcacgtggaacacaaggaagaggggttaggaaccctgaggaaataacacagcctatagaatacatgagaaagtccagagcaagtaaccagctaaactattaaaaacaattaactttactccctaatggcatttgtatgtttttttctccttaggcactaaaatttaggactatcatatatgtattacaacttatatcttaatattctcaatatttttttagatttttttatagttatttacataggttagaagcatttaagactgaatcaaatatcaagatctcaaagttaagcaaacacttctgaaaatattgaaaatattttcgaactttgataatggtgtatctatggctataaaaagtgcaacttaaaatatagagcttatataaagaagaaaaaaaaggtgaaatgtcacccgagtaccattttcaatatgctttatggagtcaaatgagtaaagaaaaggtttaggggttgatctaatgaaatagtttgagagattaaaaatttagtcttgaatgtttctatatataattaatctaaacttattattataccacaatcagtattactattttgcaaactttacgcaacttatttgttaggtgcacgcctgggtggagcacctatgctgtgatgtcacgcccataaattcacaagtaatttccaaactaatttgtgcattaaaaccctcgtccaggaatcagccgaggtacacaaactgacaatttaatatacaaattcatcaaaataactaaaacgataaatacttacataagaggcacttagtcctcaccatgaagaaaactgcagcggaaagtaaaatctagcgaagcttcagctccactcccacaggcagctcaactgggatctaagccaaaggtcttctcattctggatccttttcttcaactgaggtttgatgattattgcaagaatgagcatatgacatactcaacaagccacacagcaaatatgcaagtgcacaaggataccaaaggatggcataatatagggttcatttacgaaagcagcatttagcaaagagttgagaatttgtaaaacagtagagtaattaatcatcaatattaatcaacactgaatagcacacccatactgctcaggcccaaccaaacctgaacaaccaaccccggtcgtacagatcaaacctccaaaccaggaattatccattccaaaccataagtcaaattaattatcacattattatcattaatgagtagtgtgggactaatcacgaaaaacattgttagacccgcccataaccacgggcacggctattcgaatagttttactctggccagagatgtaccactgtacccacaagacacgattccacacatgctgccatgccccgaagtaccaccacggcactgctaagggggaaatcgtgacagtacccttcacacaacacaactcaccacagtgtactatttctggatcataatcaccccctcaataaccaaggcatggactccccagcgaccccccacggacttctcgccgcttcacagtctggcacaccataatgaatcatgctatacaaaagataaagtcgttgcccacgctggcttgtggttggc

SEQ ID NO: 64111 - DNA, 2927 bp, Oryza sativa
cccagtgacattctaaagtaatgcataagttgaaataaaacaatagctttaaatggggtcaacatgctcaagggattgtttgggatctgtgtgacttgccttgcaaacaagcgtcttcaattcgtcttcaggaatttctccaacgaacgaacgatcctccgaaacaacggaaaactaaacctagaacgcaaaacaaggaaagaaactaataaaaaccaaataaacagtacaattaaagttcataaataggtagagcttgaatttagatgaattatgagacttgaacgacctcattccgagttcgtatgaattagatatgaattttacaagatttaattccaattaaacctattaaagaaaagactattccaaattgattaaacaatttacaaatgacttatagctgagacaaaagattaaaacatcctccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacggcagcggcacaacagcggttgcggtggcacacatacagcagcagcgcgacggcgacgtacagcggctaaacagcgacacggcggaacaaggcagctagcgcagcggcgacgctagggcagcagctagtgacacagcaacggctacgctagggttagagcaacagcggcggtgacacgaccgagggattgaaacctaacccgaggggacacggatagaagtctcaccgaaccaaagcgaccggagagggagggtcgacgatgacgatccggcgacacacacggaaacgatgacgacgctagggccaaacaacagattagattagattagattagattaaatccctagggataaactacaccggtaaatgacatgggagagaggagagctcaccggagaagacgacggcgacgaccaagacgacgacggcgacgaccaagatgacgacggcgacgggtgacggctagcggcagcggcgagctagggcagcggcggctagggtattggagaaggcggctaaacaggaggaggaggaggctaggggcggctgaaaaaaacaggaaaaagatggggaggggttggtttaaataggggaagattgaataggattaggtggggccaaaggaggcacggcagagggggagagggagggactcggaggggagagggcaggggaggcgtgcgcggctgggagagaggagaggcgcacggctgggaggaggccgagagggggaggggaaaaagatacgggaggaggggttgcctagaaaggaaaggagggggaaacagatgcggtgccgttttgggaaaagaagaggaaacggaaccagaaagagaataggactcggctcgtcatacaaaatgaaaccgcggtggcaaaagaggtcggtggatacaacgaaccgcagacagggagagtgaaccgggaatgattcacaaccaaaggaggaaaaagaaagaattattaattacttttctaattaaattaatcactgaatgatctttcatttattaaaaatacttcctatcctgaaataattctgggaaaaatccagaaaatacttggacattaaaaatatttaatacaattttatctatatcaacttaatgttcaaaattttcatagattttattcacacacttactttaattattaagtaatttctaaaaattcctttttcacaacgatttataatttagcgattttcagggtgtgacatgtgatatctcgcagcacctatcataaacagttgagcaaatcggtcgatctgcattatcctttagtttgtgccacagccaacagggaaagcggtggtaaaccatttgcatgacaagtggaactgtggaccagtctatttttttcttacccaaaatttttacttcaaaaataaaaagtttgacccaagcccgtacacttgtgaaaaatggacatgtgaagtgacagatcgcttcgcttatcctaacactactggagaaaccctcaaaccgggagagaatccgagactaaatatgtgtgtgtatgtatgtacgtacatacgtacgtacgtatgcatgcatgtatgtgtgtgtttaaatacatattatatggatgtatctacacagctagtggtagctggtttgtctaaaacagctaccactctatctataatagggaccatccacctatacttcaaatacaattttctcttaaactactcatccgattttcgatccgattacaccgttgtgttcacaacaattaaatctttacaacaagatctcacatgattatattttgatgaaaaatcacaaattacttttatgatatgtctaaattacttttagatttcactaagttacttcttaaatataaaaaagtaatttacatatattatagaagtaacttagaacaaaacgaaggtaactttagcatgtcatttgaagtaaatccgttttagagataaaaacatgactctatctagaaattaaattaatcagcacaaattatggaattaactaaaaaaataataaaagtaatcacctcagagcattatgaatgtataggaagtattttaataaaatctgaaagtaaattatatatatatatatatatatatatatatatattgaatctattctacaccctctcccatgggtcaaacccaccaccccaccctcccttgggcccaaaacccctctcccacctcggtcaaagcgtcctcccgccggtcaaacccgctcaccactccttcccccacccaccactttgctgctctcgtcttgcaggaattgtgcaataacagaacggtcatcgtgcagtaacaagacaatattatcgcagtaacaacgtcaaaaagtagtcatgatgg

SEQ ID NO: 64112 - DNA, 15125 bp, Oryza sativa
ccttccaattgatcaaataggtcatcaattctgggtagaggatacttattcttgatagtaacctcattcaacgctcgataatccacgcacattctctgagtatgatctttcttctccacaaagatgactggtgctccccatggcgaagtactgggtctgatgtatcctttctgaagcaaatcttccacctgtctcttcacctcaactaactcattagctgccattctgtatggtctcttatggatagggttggttccaggtaccaagtctatccgaaactctatctctctcttaggtggcatgcctggcaaatcctcgggaaacacgtctgggtagtcttgtactatggggatctcttgtagagcaacttggtttaagatcacaccatgagatttaggagaggacataaagaaagaaactgtttccccattgctactggttaaagtcaccttacggttggcacaatctataactcctctgtgacaagataaccaatccatccctaagataacatctagatctttggattctagcaagataagcgaggatgggaaaggaacttcttctatttctatagtagcggaaggacaatactgtgtcgaaaatacttgattgcctggggtattaactagtaaaggtctctcgagactaataacttccatcccatgattgctcgtaaaacttttagacaaaaaggaatgtgtagcaccggaatcaaaaagcacagttgcgggtatagagttaacagggaacgtacccaaaaccacatctggtgcattctgagcttctgctgctgcaacatgattaacacgtgcctttggtgctggaacattggagttgttcggggctggagcgttcttcacgcgccgaggcttaggacacttatcagcataatgtcctggatcaccgcaattgaagcatatcactggcttgcttccctgttccttcctgacaggctggttctgagctgaagttgctgcaggacgagcaaccacgttgcggttgtcattgccacgattactagtattgttgttgtagaactggcgttggggacggacaactgatgaagatcctccttgagggtacgatggaacttgaggtccagtaacgagacgcggcctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcattcagtccctccaagaatttctcctgacgctcttcatcggtgcgaacatcttccggagcataacgagctaaacggttgaaatcatggaggtactcggtgaccgatcgagatccctggttgagtgccctaaattctctcttctttagagctacaacacccgacggtatgtgtgtcttcctgaaagcggccgtgaattcctgccacgtaataggctctccttcagccctgccttggcgaaaatgatcccaccattcagcagcaggaccatgcagttgatgcgaagcaaaagaaactttctcctgctcagtacactggatcaaatccaacttcttctccaccgcatgcagccaatctcctgcttctactggattggtggtgctggaaaaggtagggggtctcacgcgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccacttccacttccacttccacttccggtgcgcgtgttcaccatctgacgataagcagagactcatgctgttacatcccaccaatgatgtaagcaacaactaaaacccacacactcacaagcaaacttaaacaagcaatctaacacagcgatctacggcaacgatctaactaagcgactaaacccgccttgtgtcggaacgaagcgatggatcttcttcctctggagtagctggctctctttcttcagggtcttcctcctcttcctcatcacttatgatgtctatgacaggttcagcacgatcgggcacagcttcacccatcacgcgaatcttcgaagctaactggagacgaggtggcggacaggttctttttctttgagtgaggcgatgcttgggtgttggcggcggcgtttctcctttaagttcagctaattccttttgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccgtcaggacaggtataggttccatagtcttgaccatgaggcttgtgaggatgatactggaaagctgatgaatccaactcttcttcaaagcgttgacgcaactctccaatggccaccaaagctgcctcttgacaagcatggctgtacgatcttcctccagcttcgaacttaaaagacggaaggtcatcactatcactagccaacgtcacacgaacacgacacttctcctcgtcggggtcatgggaaatttggcgatactcgggagcaacttcatagcctacctcaaaagccatcaacctcagctccctgacgaaccctaacaccttgatcaaatttctcggtgaatggggtggcatctaaagaaacatagaagggaagaattaatgcatatttttaagttagctgcaccaactagacttaactgatttagaccaaaaaggaagaaaataaaagaaaagacacatacaaagctactttatatatttttctttttgaatttaacttttgaacagagacaaatcagtttgaacaagtgaataaaataaaaccaaaatacttaagacctactataagcacggtacaatgtcaccattaaaagggatgagtagtactagtgccaacatgattaaatcgataccataatagatgtacagtgccgaccaatccataagatttagtaaagagaaaaagaaacattttgagaagaacaactttttgctttttaaaagaaaagaaattgaattaaatgaattttgtgcataaccttgcatgtgctgccaacttatttaatttgtaagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgataataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccatttaatataatcatcattattaataataatataacatagtttataattaatccctttagttagctaatgtttctaagcatggctaagcaaacctatatatagcatttagctgaaccaaaccaatatataaggttcatgctagtcaaattataacccctaggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccaaagttttaatctattagaaaattggaaaaaaagaaaaaagaaggagatgatgacgtcagcatgacgtcaccccacggcagccggctagggtttgcgagctcgccggagatagagaccttggccggggatttggagggcatgtacacgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttcccctcaccacggcgcacctaacggcggcgacggcaagcggcggcgacggcggaggcggcgcggcggcgcggctggagaaggccgacggcggcggcgagctaaagcaacgcggcggcggcgctacggtgcacgggagaggacgagagaggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttgggccgcgcgggagagagagagtgttgggccgaattcggcccaacggcttaaaggaggggatttttgaactttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacatcacgcccggaatttctatccaaaattccaaacgcttacatgtgtgttaaaccctcgtccaggaatcaaccgaggcacacaataacaaattgataatagagtacaaatgaacaactatagaatattcgcaaataataaaatattacagaggtagatagttcctctcaaagaatatccttctacgcagcgaaaaaaaataaatctataacaaactacggaacagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaggataacaaaggatgacataatatagctcatttgcagaaacagcattaaataaatatttaagagaatagtaaaacagttgtataattaatcaatattaaataacaccatacaacacacccgtgttgcataggcccaacctcatatgaacaaccaaccccggttgtacaaatctaacctccataccaggaacgtaccattccaaccaggagtcaaattgattatcacaattaccattaatgaataacatgggactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcataacacaactcaccacagtgcaccgtacctggatcataatcaccccctctacaaccagaggcatggactccccagcgacccccacggacttctcgccgcttctcagtctggcaccccataatgaatcatgctatacaaaaggtaaagccgttgcccacgctggcttgtggttggcacggtaaaagtttcacaacagtagctcgcgaaccggtccttaattgtcatgagcacaaccatcaataccatatgctcacaacccaccttaaccaggttttaattatcaattaattaacctcacacgatcaaccatcgtgagctaccattaatgtaaccataattaaaataataatgtaacatagtttataattaatccctttagttagctattgtttctaagcacggctaagcaaacttacatatagcatttagctgaaccaatccaacatataaggttcatgctaatcaaattataacccataggaaaataagatcatcttcggccgttaattaattgggaaggttcaccacccgatgacattcgaaaacaatgcatagttgaaataaaataatagctttaaacgggttcaacatgctcaaagagttgtttgggatctgtgtgacttgccttgggcttccgcaaacgcttcggagccttccttaacggaaacgctctcctccggaacgtcggaaactaaagcaattaaacaaaaatcaacaaaacagtacaaaaacaagcataaacagtacatgtggatatttttaacatgtagaccttgattttagaaaaatttagcaacttgaaccacctgaaacggatctacggttatttagttatgattttccgaagatttaatctattaaaagaaattggaaaaaaggagatgatgacgtcagcatgatgtcatcaatggcggccggctcgagttggtgacctcgccggagctagagtggtcggccgggattttggagggcatctacacgtagagaacgacgagacgaacgcaacggtactcaccaatgcgtccaacgacgaccgatggtggccggcgacgagaggaggcggcgcggcggctcggtcgacggcggcgacgggtctccggcgaccggcgacagcggggagagggcggccgaggttcctcacctccgtgcgcacctaacggcggcgaaaggaagcggcggcgacggcgaaatcgaaggcgcggcgcggctggagatcaccggtggcgacggcgagacaaggcggcgtcggcggcgagctacggggcacgggagaggacgggaaaaggggcaaacgaaagaggggaactagggggtcctatttatagccttggattgaagagatcggactccaaacgagaggaatcgaaaccggaaaatcttcgggttagtttggagagataaaatcaaaacgagtttgattcggacaagatactcaacgatttgctccgatttttgcgggtaaagatagaggaggatatggggattaaaacccctctaatatccggactcggggtggccggattggggcggatttgagggcgcaaggtggcggctcgggctcggcatgcacggctcggccggctgctagaggaaggggaaggatccgacatgtggggcccacatgtcggtctcccgagaggagggggcggtggcgacgggttgggccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagttcaggagcaaatacccccagccgaacaacgccaatatacacaacaaaggataatccaagtgattacaagagctgacccgccaagccagttgtcgaaacggcagaggaagatgcagatccgtacggtccacatcatcacttcggcaggtgagggggcgccacagtacgtgaaccagctgatccctttcgggccagaagacgccgaaggagtcctgttcccgcatcaagatccactagtaatctcagctgagatagccggttttgaagtccgacgaatcctggtcgatggagggagttcggctgacgtgatcttcgccgaagcatatgctaagatgggcttgccaacccaagctcttgcaccggcaccaacgtcgctccgggggttcggcggagaggcagtgcaagttcttggccaagcacttttgctgatagctttcggctcgggagaaaacaggcgcgaagagcaaataccgttcgacgtcgtcgacatcccatacaactacaacgctatcttcggccgtgcaaccctgaacaagttcgaagccatttcccaccacaattatctcaagctcaagatgcctggcccaacaggagtgatagtagtcaaggggcttcagccttcggccgcttcaaaacgcgatctagccataatcaacagagcagtgcacaatgttgaggccgaaccgcatgagcggcccaagcacacgccgaagcccacccctcacggcaagataacaatagtgcagattgatgatgccgaccccacaaagctcgtatcactggggggcgacatgggcgaagaagaagttgagagcatcctagaggtactcaaaaagaacatcgatatcttcgcctggagccctgatgaggtggggggcgtcccggcggatctcatcatgcatcacttagcagtcaagccgaatattaagccaagaaagcaaaagttgcgcaagatgtctgtcgatcgccaagaagcggcgaagaccgaagtacaaaaattactccgagcgggggttattcaagagattgaccatccggagtggttggctaatccagtgctggtgcggaagtcaaatggcaaatggcgcatgtgtgtcgatttcacagacctgaacaaggcatgtccgaaagacgatttccccttgccgcgaatcgaccagctcgtggatgcgagctcatgagtttcctggatgcatattccagttaccaccagatccacatgaacccgctcgacatccccaaaacatccttcatcactccattcggcacattttgtcaccttaggatgcctttcggcttaaggaacgcaggagcaaccttcgccaggctggtgtacaaggtccttggcaagcagttggggcgaaacgtggaagcttacgtcgacgacatcgtcgtaaaaagccgcaaggctttcgaccatgtgttcgacctgcaagagacgttcgacagcttgcgcgcggcaggcataaagctgaatccggagaagtgcgtattcggcgtccgcgcaggcaagttgttgggtttccttgtttccgaaaggggcatcgaggcgaatcccgagaaaatcgatgccatccagcaaatgaagcctccgtcaagcgtacatgaagtacaaaagcttacaggccgaattgcagcactcagttgattcctctcaaaggcggccgaaagaggtttgcccttcttcaagaccctccggggcgcgggaaagtttaattggacaccagagtgccaagcagcattcgacgagctaaagcaatacctacaaagcccaccagctctgatatgcaatggttcgccacatctagcgaacaccaaaagaaaactatgaaaatttaagagaagggcggagagcctcacacctctgggtggtcccgggcatcgcctccaccccctccggccgccatgccttcatcttcacaaaggtccgccgcctctgctttcgccagctgcgccaaaaggcgcgccttagcggcggagcggccgtccttctgccaaaattgttttcgccatgcacgaagcgcgggcgaaatgtcttgcgcactgatttcccaatcccccttcgcgtacttggggaactcggcgatgtgctcgcagccgaactgctgcaggaggcccatggtaaaggccgctcatacgcgtgcacagcaatcgccgtatgcggtggcgcagtcggaaaccgaaccaccagcctgttgggtccattcggagaagtcgaaggctgatgcatcttcggaggggacaccccgcactttcgtgcccatgtcagtaagggtgaggcgaagcgtttggcacgctgtccgcgaggactcggtggttttccccatctcccgtgaaaaccgccgcgactcctctgcagcacttgcttcagccttgtgaacctcctgccgaagagcctccatcttcggctcggtgaggttgtaataatctatgagcacggcggtgtgggctttctccttctccagttcggccttcaagcgatcaacttcggccctggcttctttccctttctccagttccgattggagccgcttgttttcagccttcgcctccttaagggagttggcaagggcctccgtctccaaatttttgtggcccagttcgtcatcctttggcccgaagacggcttttgaacccatcaagtcgagctcgcacggttcgctccgttgagcagtgagccgcgaggatctgggcgcagaatacgagcggcgaagagaacaagtgtcaaatgtaaaaacaagatagaggaagaataaagataaaaaaagggggggaaaaaaacgtacccgaacagccaggcgagcacccctcgtcgaactcattcagttcggtgaacatgcttggggcactggcgggcagtacaagattgcttaccccctccacaaaaggaaggaggtccgctcgcgtctcgaagtcgccaggggcgaagcggggtaccgagagcgaatattccaaagcggacgtctcagcgaccgctctctttcccttcgcctccatcagcggcgatgcaaccggctgatgcggaggattgccgaatactttcgccgcggccgtcacaatcctttacgcagaagccgaagccccagcggcggtactaccatccactccagcggcgccaattggcggaatgggggcggccgaaagatccaggctgcgaccagtgggcgaagtcggagtcccgtcggaggactcgttgtcgctaaaaacgcgagcgacatcgacgagtcctttcgttttagccacctttttgataggacctcccttcgccgccgcgcccgaagagaacgcaactagggccttcgccccttccaaatccttccgacgaaggggggagctgttcgactccaccccggtttcgttgttaccaggacttggggtaggagtgtaccctggggtgtcggcgcggtttcgaccgcctcacccgcggccttatcagccacagcctccacctcctcctcttcctctccttcctcctcgccatcacattcttcggcatcatcctcgtcgtcggcgtcggagtcagacgaagcaggaacccttcgcttcttgggggcaagcttcacttgtccacgcatccgctttcgcgaaggccctgcctcgtcattggccttttggggattcgcccggggaggcagttcgccattgtaaacccggttcgcccgcccagccgcttgacgcgttaacagctgactatactcgacaaccgaaacatcgccgatcatcctgcgggcttcggcttcggcctgatcgagggtcaacactgtaaaagtaaagcgtgaagctacgtcaaaagtcaaataaggcgaaataacaaagcacagcagtatatagcaaaagaacagtcttactgttcaccccctcaggaagtatcaggttcggcaaaccgtcgacttctttgccttgttcaaccgcgacttgccatgactgggagaggggaaaaatgcgaagcatacaaaattcctccaccaagtcacgacagctaaggcgggagcaaaccttccgcagtagaacgaaccgcgcctccatggcgccgttcacagcaatattgggtctccgattcggcgtaatcgccctacgccgacaccggagggatttcgctgattcagaaccagccttgaaggggatggtgtggtagaaccacctcgccatccaatggcggtcccacttcgacatagcagcgttcaccagccagagatcggaccgctcggggcgaacattgaagttcacgctcccgaacacggtttttttcgttccagccggggtaatcaccgtcttcgagttcacggtggcgaaaaatatggcgccaaagagctcggcgttgggctcaaacccaaaagtccggcacgcccagtcgaagatagcgatccgaacaagcgccgatgggctcagctgcggaagttccacctggaagaggcgaaggatctccggcaacaacacgttgtagggaaaccgtagccctgcctcaaaaaatacggcgaacaccaccgtccggttgtcgacaggtttcgtgtcacgtcccaaaatgactctaaaatacatcctctaaattatgcctagaataattaaaatccatgtgaaagcctccaaaaattaaaatgtgcaaagttaaaagtcaaataaggcttggaggatttttgtatatttcctaaaagcctaaaatgtgtaaataaattttagtggaattttcagagcacaaataataattatgaagaaataaacaaagttaaaataattttataaaaagaaaaaccctaaaaagtcccccttccctcccttgggccggcccggcccatctctccatctccctccccctctctctcctctccccgtggcccattcggcctccctccccgcgcgcgcgccgctgacgggcgggcccgcccgccaccctcgctgacgcgtggggcccacccgtcatccccgacctcccaccgctcccgccgcctcccccgagccctagcgccgccgccgccgcgaatcccgccgcctcccgccgtccccgcgtgcaataaagtggggggaatcactccccgtgatcccctctccctttcc

SEQ ID NO: 64113 - DNA, 6971 bp, Oryza sativa
gtttccgtccttctccgaccgccctctctcgccccggccctatttaaaccctccccgcgcctccctcgcccgtttccgccccttgccgcaccgtctctccgccggaatcgagctcgcgacgtcgctctctctctccgccgtcgccgccgagctccggtccgccgccgtcgtcgccccggacagcctcccacctcggcgccgcctcctccggcatcgccgcaccgccgtcgaccccgtccaccccctcgccgggtccgccgaccgccggaacgccgtcgaccccgtcgacccgagccgcgccgccgccttcctccgctccggctgcctagggtgagccgtcgctccgccgtgcctatggccgctctctctcggcctcccgtgcctatttcccccttcccttcccctctctcggccgccgctccgccgtgcctatggccgtcgccggagaccataggggcgcgggcaccgcctcccgccggccgcgccgagtggccgccttcgtgcgcaccgagtggccgccgcgtggggcccggccgtcagccgcccgcgccctcgggtgcggctgacgcgtggggcccacggcgccggccggtgcgagcccgggtgcgcccggtccaccgtggaccgtgaggctgccgtgtgggccccactcccgtggacccggtacgcgcgccccctcccctcggctgacgcaataaaccctttttaaattaaattttaaatgaagaaattcgcaaatattcatttaaagagcatataaacttcaaatggccataacttggccatttgaactcagaattggaccgttcaagtctctaatttttccttaagaagtcaagaacccaattttgtgctttgttcctacttgttatatggagtttattagagtaaaagccttttcttttccgttggtcgtgtagacgctgcagcttcggaagatccgctcttcgtggaggttgaagccgacgtttgggaaagcgagcaagacaagtcacatcatccttgaacatattgaatcccagtttataaaattattttgatttaaattattgcattatcgctttgtttaaattcccacgttatcactgttttatctagccatgcctatttacctttgttatgaccttattaatgttattgttattattaccttgttcaccctagaataaacaaaaccccaactagtggacaactctagactttgggaatattctcatcacctggacactatggaatggatggattattgtggaattggattcacacctccccctctattcaaaaccctcaaaatggttttaggctgggctcggggtgtatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcgtctcggtagtcgaaatgtcatggcacaggaccggtgtcctgctgctaggggctcagtcctgcctacctgtcccgggggttccggccgtaggtggggttgggtcggtactcttgtctatggctaggatgggttggaaactatgtcacgtcttccgtccgtataccatggtggtatgtggcatgtggttacacgtgaggaagatgtgtcttgtgggtaaagatgtacacctctgatcagagtataacctattcgaatagctgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttaatgctgtttactgcaaaccctaaccccctaatttatggctcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccatcaagcgcctgtggtcgtcgccctagtcttccgctgtttttcgtttgtcttcttgtgtgctgggtcttcgccgcccatgtaattaattaattaggcttccgcttgttaaactctgaattgtatcaacttttggtgtaccttgcctcctgggacaaggaataatgcacgcacttaaggaacgcccgttgggttatttccggtcgtgacatttcggcaccacggttttccctggggcgaaagcctgcccctcaaccaacgctccggagctgaccagcttcgccagctcgacgtcatccacaagagagacccccagaaaggcggtgctgtcatcatcgactcggctaggatctggccctttcgccgaagtagggtttggctaacgtggggccatggcgaacggtgcgtttgcggtggcgaaaagagagattcggcgaaacgcctgaagggtcgaaagatgctgtgaaaggaagagacggagaaagagagcgcgcacggtaaaatggcaagtgtggcggtgaaaaggaaagagcaacgggaatatatagcccgcccaagcgaccgtttgcctacccaccagtaataaagcgccacgtgtcgcaagggtaggcgaaacggtaaattcccgtcgaccgagcggcacagtaaaaagcccaagaaaggaaggcccaatactgttccgttcggcccaggaaaaaagaatatatataaccatcaatcgcacgaggcgaagcgcggcaaaataatactagccgcacaagtaacaaacttcatttgcaggaataatgtaggtttcgccaggagcatcggtcgaaagggggcgccacataccataccacatattttacacggtctcggccgaagctccaatctcacccgtgcccgtgaggggcttgttggcggatggcatgaggctcttcgaccagatctgccgaaacctgtggcgaaggctatggagcaagaacggcgtgaggcgaagagtcgcgcgagggccttgtcaggccaggggcatctcgggcgaagggtgcaaggcgaagactatctgccgaaggaagacgacttcgccatggcaagttcgccctcgcaagggccaaggaagcctttccggcccatcaagcctaagggccggcgatcgctagacggcccatcaggggcccatgagaccctataacattatgtacccctgtaaatgtccctttcataagggtaatcatgtaaattcccctgtacaacctagatcctagtactaagagcctgcaacagggctataaatagccccctagggccatgtaacgggggatcccaagtgaaattaaaaatttagtacacttcattttcccaaccactgttgagtaaccacgtccttcgacgtatgcagttgtcgtttcgacaacaggaatggacggctaggaatcaaggagaaaatgtaccttggttcattatatataatatatatatatatatatatatatatatgataatttgttcaatgaaaaaagggttactttattttgttataagttacttctataatatatgtaaattacttttaggctttactgaatttacttttatatgtctaagaagtaacttcgtgaaatctaaaagtaatttagacatatcataaaagtaatttgtgatttttcatcaaaatataatcatgtgagattttgttgtaaagatttaattattacgaacacaatggtataatcggattgtaaatcggatgagtaatttaagagaaaattttatttgaagcatagatgataggaatatttcccctacttgctcaatggattaatagcaaccaaaactcctaaagttctagcacgtgggtgtctctggttaagactaattggagaggcctctccaattagatttaccgatattatatgcatatgcatatattacaattctttcggactttatatttattgtttctgtcgtatactgcttcatctcagaagaagaaggaccggcttgaagaagagactttccgtcgtaatagaattctcccgcgggatcaataagctgcacattgatgaatctcatcagttgttcttgaacagccattatgaaatctgcgtgagtgaggtcttccctcatgtaaatcacctatcatttgaaaaaataagatataaatatatgaaatcaataagctaatggagacataattaatgtatgaataattttacatacttccaggtccctgtcagtgctgatttggtgtgctaggcagtggatatacttgcagacgtagttgccgcataagttagtcctctgatcctgctttgcacactaaaaaagaaatgacaagagatttaatatacatttctattttagaacaaattaatgattcaatataatattggagcatttactcactagaaaagtaaacctttcatggaagaacccattcccccaagaaacaacaccacgtggcttgttaattaaacatatgacgtgtacgtgtacaagtaaacgttaaaaattatggtcaactaactttgcgcacacaacttcagtaacccctcgtgcgaacatgataacgatatgtaaacaatttaatcagttgctagacgacctttcaaattaatacgtgcttttataaatcgttttgtatctaacttacaaaaaatgaggtataatgccatgaagtatttggctaatgcttctataccgacggtaccgtcacaactcactaccagaacccaaaatttagttttgctccacagtaacaagggtgctatgatttaaactctaaaatatgtaggcgttaaatctataaatttatgataaatttagtgttaaatatatgtagttttctaatagtttgatcaaaatgcctatagattagggaaatttaacgacaacacaatgatataatttttttgagaggaatatacaatgatataattgatcaaagattggataaaaaatttaggaaaaagaacaattgaagagctagcattttagctatttaatgttgtatatttgttttcattgctgtgtggttatcttgttatcctacacccaaacatatatatgagttatactattaggtgaagtaatattacaagcaaagtggattaaagaccaaaccatgcgggcaaaacggcaattaaaaagcaaatgtttaatagtttcctcttcgtgatagaaagaacaagtctttcttcctctctaattcatttttatcatgatatcttttgttaaaactgctaccggacataagtaccataaaaagatattaatctttaggggcctttgatcttctaaattcttttccttcttttgggaacactggtctgcaccaatgcaagatcaagagatttaaccgagaatctcccatcattggttagattccatttaaactcgttggtcgtgagataatataatattagcgatacatgagagaagatgattcaatgctactaacttagagcgagtaaggttcctatgccaagaaaaaattagacgactagtatgaaaaaattttgtaatagacacaagggtattgttctcctatacatgcagtctatttagggagtttttatggtccatcaactagtacctccaggtactggtaccgctaggtaccaaatgaaatccaaccgttaaatcaagaggggtatgattgggaaaaaaaaagaaaggaagtagtggtggggaacattgttagtgatatgccctagaggcaatcatagtgatgattgtgtcacatactatgtttacatatttatccgacattgtttagataactccttattggttaatgaatatgtgattctttcatgagactctttatgttgtttgttactatttctaaaggattcctgatcaaatatcatatgtggaacaaatatgtttatatgatcagcacatctattaattgatgatcatgtctcatggatcatggtatagagataccaaattaataatgtgacacatgttggtgaacatggtgttgggttagaccccaccaataagccactaccaaaagcaatatgtgttgtgtcatcattgatctcattgagtattggtgttgaatccttagacctaagattatcatgattctcaacatgtgtagtagcttacttagggactgctaaaagctactccgtaattgggtagttctaaaagtagttttcgggtatgctatgaaacatgtagtgggatatgaataatcaagatgggatttgtcgcgtcccaaaacaactctaaaatacatcctcgaaattgtgccgagaataattaaaattcgtgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtccttttccccccccctttccctcttgggccggctcggcccaattccctccctctctctcctctcccccgcggcccatcggctctctccccgcgcgcgcgccgctgacaggcgggcccgcccgccaccctcgctgacgggtggggcccacccgtcatcccctacctcgcgccgcagccgccgccccgtccgtgccctagcgccgccgccgccgcggattccgccgcatcccgccgtccccgcgcgccataaagagggggaaatcactccccgtgattccctccctctttt

SEQ ID NO: 64114 - DNA, 5436 bp, Oryza sativa
ccgtaggtgggattgggtcggtactcttgtctatggctaggatgggttggaaactatgtcacagcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgtttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgtttaataacattgtatagttccaggattgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggcctttgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaggatttgcctctcctatggagagatatctttgggcccctcgatgttgtagattatggaagtgcatggccatgacaaaggtgattgaggagtcaatcacaagttatataatctatcaacaggttcgagtgaatgttagaggatggcacatatctagccttgagcttaatcgatatcgtgaggcaaaggggtttatacaagtatacacaagaagttcagccgatatggtctttacgtatgcccggtgggtcaatacgttcttctaggagccgctgttgatgtgtggaccgaaatggagttttcgggttacagcctagtatatatgaacctacagggtcgcacgcttaatggggcggaataaggggattggatagagatccaatatgagcttaattcagatagggatccgaataggagttctacgggccttggaggcccgagtgatggatcttatatattcgtgaggggtgtgaccggtggagctattgcatcacgtgagaaaccctagccgtcacttccctccccgagcaaaaccatagccgcgcgcaggtgctaacacatcagcgcgtggcgttccgtccctgtacgtgtggataccggtagaggcacagctggtttgcggtgctgatcggtgtgggagtacggcgaggagaatgcacgaggaggagaaggtcgagccggtgcgatcaactacttcctctatatcgacgcgcgctacttcgcgagagttccttcgacttctcagcatcttcttccgctgcgcagcgcgtcgagtggtaacgatctatgatctaataaatgcatggttcctggtttacgcgatagaaaattttgattaatgctatcgtagcctgcgcgtatcccaacagtggtatcagagccgccttgtatagtttatgatctagatcattgcatataattgatatgcgaatgtagtagatgagatctattatgttgtatatgagttcttaggtgatcggaacatgagatgaaccgatagctgcatgggttgatgagatcaatcggtatgtgtgttggtgacttcactggaatgtctagtactcaccaaggccgagcgcgattgtgttcatcggatagtccgatgtccactggaaccgcacgccaatgagaaaatcgagccaatgagattgactcggtttcggcataatttgattacgccgttaaggttttcacatggcgaatcgtagatgagatctatgtaccccgtgttcgttgccccttagatttcgcttggggtttttatgtctatcttactatattgctgttatatatttgatatgacatggtaggatagattcccttagaaaaattaagtgtaatttatgctcttccaataattgcacctcttacggttgtgatcataagtgatgggtttgccatagcaaagtgtcactttttatcatgataaaataggatagatgtcggacatctatatgcggagattattggtttacttgacaaggttatcaaaacagttttggaccttggggtataggttgagttggacatggagatgtcaccccaacagcacaagagtcacatatgatgtgattagtaaggtgtttcttacctattttgatagttttctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgcttttgcatacacatatttctattgtagatcatggcagctcctgcaccatccaattttaacttgcggtctattcttgagaaagagaagttgactggaacaaactttcatgtattggtatcgcaacctgagaattgttctcaggcaagagcacaaagagtttgtgcttgcacagccttttccagctgacttgcccaacaatgctcctgctactcaacatagagagcatgaaaggcgatgcaatcaataccttgatataagctgtctcatgcttgctactatgtcccctgagcttcaaaggcaatatgaggcattggatgctcatacgataatcatgggactacgtaacatgtttgaggaccaagcaagagctgagaggtttaatacctcaaagtccttgtttgcatgcaggcttgcagaaggtaatccaatgagcccacatgtgatcaaaatgattggttacaccgagagtctagataagcttggctttccccttagccgagagttggctactgatttgattctccagtcgctccctcccagctttgagccattcataatgtatttcagcatgaacaatctgaataggaccttcgcagaattgcatgggatgataaagacttgtcacgtcctgataaattcatcccgaaataaaaatcattttctaaaaggaataatagaattaattaaaatttgaaaagaaattggcaaacactaaaatacgtacaagaaaatttcgaatgtggcccggagaatttttgttaaattctccttggtctaaaatgagccctcaaattttacttgaattttcagagcaccggaaatatttattaagcaacaacaactatgatcaaagtttattaaaaagaaaacttaaaaataatcctccttcctcctttgggccaagcccagcccaaagtctccctctcctccctctctttccctcctctcccgggcctctcctcctcctcccggcccacctcttccctccccctcccggcccagctccctcccctcccctctctctcccaggcctgcctctccctcctctcctcatgggccgcctctgggcccaagctgagcggcgccctcccgcccatgccgcgcacgtgcgtgtgctgaccgcgtggggcccacgcgccggtcgtcttcctcctcccgcacagcctcttctctctcccgtgcaaacctagcgccgttcctcctccaaattcgccccaatcaagccggctctttccaaattaattggggggttttaatccccattgattcctcttcaattccccccaatttcccccttgaatcgtgcccccaatcgccgggaacggacgcgccaaccccggccaccttccatggccgccgggcgcctattccgccgccgttccccgcctctcccgtggccggctccctctcctcccctataaaatggaatccccatcctccgttctatcgttttagccccctcccgcatattcccgtggcctcaccaccccttcccgccgtcgcccttctctttcccccgcgccggccacctccagccgcctctccctcctcgccctagcgccgtccggccgtgccgtcgccttccccggcgtcgcagccgcgtcctcttccccggcgctgcctccgatccgtggggaaatcaccggagacgcgcccccgccggcgtccagtggcgtcgccgccactacaccgtctccggccggctgctgttcatcgccggtacgccgaccgacgtcgccgtctcctccgtcgacgtcgcagcatcgtcctctcctccggctgctcctcggtttcgccggaacaccgccgccgccgcgccggcccctcctttctcctcgtcgacgtcgccttcggtagccccttccgccgtgcccgtgcgccggccgacgttgccatctccacctccggcatcacagcggcaaggtcgtcctcggcctcgcctcccctccacccgaacaccgccggtgtccgtcgtcgtcttcaccgttcatcctcgccggctcgtcgtctcgcggcgccgcctccgtcgtcggcatcgcagcggcgtgttccacgccgtcctcgtctccgtgcagccgctgccggctgccatcgtcgtctcctcgccagccccggtcatcgtcgtcgtcatcctctcgtcgttcccagtttcgctcgtcgtggcgttggtccctccgtcaagccgatcgcgttcgccgcccgtggttcatcaagcgagccgctgcagccccgtcgtcttcgtcctcacctccgcgtcgccaagcgttgcgccggccgcgtctcgccttcgtccaaggatcgccgccgaagtcgctccctcgccgttcgcctccgtcgtctccgagccatctccgccgcgcccgttcaccgtcgtcgttcccacgcctcgtcgcgtggtggtaaggatccgtcctctcgctgccccgtcctagtcctttcggtgtcgcccgtgcccgttgtgcggttgtcgaccccggtacccgtgtactggtgtcggtagtcgttcgcttgtgcgtgtagtgtccgtgttagtgtgtgtcgcgaccgggagaattgccttttcccgaacgctagtgtattaatccccgtcccaggaaaagccggggtacaccacacaaacatgatataagagacacatctttatatatcgataatatttacattataacaaaggcgcttcaggcctggcgatcaaaaataaacagcagcggactagcgggcctacggctccatcttcacaggcgctcaactggggtataagccaagactccacctaagacttcttctccaaaacttctcttactgaggggggagaaagatagagcaagaatgagtacaaccacag

SEQ ID NO: 64115 - DNA, 7801 bp, Oryza sativa
ttaaatgctgctttctgcaaaacttaacccctatattattaccccttgtacccccttgcattaatcatgcatccccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaatgaaattttcccggtcgcgacaaggaggaaggagggttatttttaggttttttctttttaataaactttgataattgtttttgtcgcttaataattatttccggtgctctgaaaattcaagtaaaatttgagggctccttttaggccaaggagaatttaacaaaaattctccgggccacattcgaatttttcttgtacgtatttttagtgtttgccaatttcttttcgaattttaattaattctattattccttttagagaatgatttttaattcgggatgaatttatcaggacgtgacaaatccaccccccttacaagaatctcgtccccgagatttgaggaggctagcaagaagataggttgggcggtcctctcttcttgtctgacttctcccgctccgtcttttataacaaacttgcctagcacaacttctccactctggactgctcggctcgatctcctgttgcagatggaatcttctcttcacctgacttgtccctggttgaacctttagctgacttcgactgggttgcggcacttgaagatggggcctcagttctagaacttcgcatagttcatatctttggagtcaacctcatacaagttacccacttcatgtcatgcgtcgagatcagctcgtcattactaggataccatgtttgtcatcataagaatatcatgcttgtcatttgcttctaacttgctaccaactgcctcatattaactttcctggtctccgggtgctagctacttctgttatttgacgccagggtcgataactttgcctttaaattatgtttctcaacagaaccaacttatcccacttgacatgctttgacgtcttcccaaatggctttactgctggacttcttattgtttgatcgttatcctgccaaatctgaagcttcgttgttaggtgtgattttaatctgacctctatagactatcttcgaacatatcacttggttcataactgggaatagctcccacgaacagacaactcggattcaccttcttttcattcggtttacttcccactattctcttcatgttgtcatcatttagcattcaaagtattcctttacacattcaaccctgacgtattcttttcagatttctcttatcaatcacctttcgacctacttctttgcctgatagtaaacacctttgctggtatcttctatcaataacctcttgaactttgtcaaccaagtaatcttcactccgagagttgtggatgcttctggtgacgatgtggtcctttggtctgctgcctttcagtgaaaccttgaagtgttttgccaaaagctgtactgactgtctttgtctttgatccgaaaaagacacatctgaaactcttagtccaaacaaatgtctctttggttaaacgcttgattttcttttccatcatcaggttggttattaactcgaggttagaacatagtccctctgaaatgagaccctaggtttccttcgacagtaaacaattatacacctaatcccatatcggcatcttctgaaagagtcctcatagaacttgtttttattacacatttctcccatattacatgaatacgaggcactgccttaaacaaaaagggaaggtgcttaacatcggtacattgcatcctcaacatgaatcttccataaacataacaaactcattgtttataatcatgaatatatttatttattacatgattgctgcaaactcccgattacagtgataagtagcgaactgaaaatcacaaacatggatacatagctggcattgttctagtgactgcatccttgattggttctgtgatgatgtgataggactgcatattgctatcattcacaggagaagcttccttctgattgctggttgaagcgaataacggtcttctgcttggtatcgccctcctgaggttgattgcccttcgctcggcctggagtaggtcggggagagacacaacttcttccatcgacgacaattctttgctgaggctgtcggtgcagagaatggttggtgctgaaggtattattgctatgattcattgcagagtcaggtgcagcaggaggagcattggtgctggggatgatatcgtcgatgttgctgttggagctgactagctgatgagacaatcgtagggttgttcgttggatttctgcggtcttggtcaacaacacactgagttggcaatccttgggtacatggtttgtaccttcgcacagaaaacatgtgaccttgcgggtgggacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcatcatccgaggagacttgatctgacccttcactatcagatactctgccaccatgacttaggaggtgctgggtcaactgtcgtgcacctcggaaagtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctacaatcatgacaaaaggggacctgctcttctggcattggaagctcattgacctgggtggcaaaggctcgatcaaacacatactgattttggtcttgacttccaaccaatggtagctgtgaactaagcagcatgcttggaatggaccaagggtgtgccctggttaactctcttgaggccagtggtggattgagttggaaacttaagttacttgaggcatacccgctgacattctttcctttttctctgttatacatctgttacagggattgaggtgagagaggaaacaagccaggaaagaatagaccagaactagggaccagaccttaaaagaactaactcttcttattgatgtattgtttgtttcacttattctgcaagttgattaagcaaacaacctaacatggttacatcacaacccaccgatgcaaaccacgcgctacacacacaagcaaggaacacacgactaacaacactaccctacagggtggcttaggttctgcgacgggttctccaagatcttcactgcttcctccacttcgctagcagaccctgcggtcttccggagcttcggcagacaattgacgacatcttcttctccgcaaagctgaccatctagtactagttgaaatttgaagaaggaagaaagagtaaatattttgcaaatagcacaggggaaaggaggaaaaagggactttcggaaatagtttcatttataaaatatgtccttaggttttatccacttggcttatcctacagtcgagatggctctgataccagcttgtcgcgaccgggagaattgccttttcccgaacgctagtgtattaatccccgtcccaggaaaagccggggtacaccacacaaacatgatataaaagacacatctttattatatcgataatatttacattattacaaaggcgcttcaggcctggcgatcaaaaataaacagcagcggactagcgggcctacggctccatcttcacaggcgctcaactggggtataagccaagactccacctaagacttcttctccaaaacttctcttactgaggggggagaaagatagagcaagaatgagtacaaccacagtactcagcaagccacatcggagatgcataattaatgcaagcggggggtacaaggggataataatataggggttaagttttgcagaaaacagcatttaaaagccacttagttgaccaaagccatttataaagacgatcctagcgctacacaatattattaatcaaggccgtgaaccttcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaaccccacctacggccggaacccccgggacaggtaggcaggactgagccgctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataatccaacaattccatagtgtccaggtgatatgagtattcccaaggtctagagttataaaaccacctaatgttgcctaattaatccgcgaagcatctacctaaattcatactagtggaaccatgaatagagtacccactagttggggttttgcttaatctagggtgaacaaggtaataatatcaataacaataatattaaggttataacaaaggtaaataggcatggctaaataaaacagtgatcacgcgggaatttaaataaagcgataatgcaataatttaaatcaaaataattttatgaactgggattcaacatgttcaaggatgatgtgacttgccttgcttagagagaacggccttccgaaccttcggcgacgaccgcgaaccacgcttcgggaacctccagaacgacgaagctacgcgaggcacacaagcaaagctacaagcctataaagaagcaataacaatacataaaaaggaagcacacggttctttaggttataacaaacattaagagacttgaacgggtcgattcggagttcgtatgaccaagatatgatcatccgaagtttaatgctgttatatggggatttgcggattattataattaagctttgcaactataaaacatgtgcaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacggctaccggggccgacaaccgcacaacgagcacgggcgacaccgaaaggacgaggacggggcagcgagggagagggatccttaccaccacgcgacgaggcgtggggacgacaacgacgaacgggcgcggcggagacagacgggcgcaacggagacgaacagcgaggggacggcttcggcggcgatccttggacgaaggcgagacgcggccggcacgaggcttgacgacgcggagccgaggacgaagacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacggcgtggaacacgccgcagcgatgatgatgacggaggcggcgccgcgagacgatgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcaacggggcgactagccgacgaggaggaatgggtggttggcgcggcgccggcgttccggcgaacttcgggcgaggaggaggtgatgccggggatgagggcggcgtcgcggaagccgagggaggtggtggcgacgtcggccggcgcacgggaaacgcgacagtggcggccggaggtggaacagtggcggcaacgccactgttttgccggcgaggacgcgtctccggtgcttcccccgcgaaacggagggctgaccgagggagaggaggtggctgcgaggccgagggagaagacggcgcggccggacggcgctccggtgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggctggaggcggccggcggcgtgggagagagaggagggcggcggggagagggctagggaccacggggaggctcgggatggggttaaaacgatagaacggagtgaggggatcccattttatagggtgggggcgggagccgggctcgggagagggcggaacggcggcgggaataacggccgacggccatggaaagcggccggacttggcgcgtccgttcctggggattgaaggaacgaatcaagggggaatttgggggcaattgaagaggattcaatggggattaaaaccccccaattaattttggaattggccaattgaatcaagcggatttggaggagggagcgagctatggttcgcacgggagagagagaagccgggcgggaggaagaccacgcgcctggcgcgtgggccccacgcggtcgggcgcgcggtcagcgcgcggcaacggcgcgcacgcgcgcgcacgtgcgcggcacgggcgggagggcgcccctcgggttgggccgagcggccggaccaggaggagaggagggggaggtggcctggcccgggcacgccgggagggggggg

SEQ ID NO: 64116 - DNA, 6994 bp, Oryza sativa
tgttgagatgcaatggtacaatgctaagcacctttctttttaggcaatgcttagtattcatgtaataagggagaaatgtgtaatacaggcaagttctatgaggattcttttggaagatgcggatatgtgattatgtgtataattgcttactgataaaggagacctagggtctcattccagaggaactatgttctaacctcgagttaataaccaacctgatgatggaaatgaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaattgcatctaacaacaaagcttcagatttggcaggaaaacgatcagacaataacaagttcagcagtaaagtcatttaggaagacgtcaaagcatgtcaagtgggataagttggttctgttgagaaacataattcaaaggcaaagttatcgaccctcgcatcgaatagcagaagtagctagcacccggagaccaggaaaactaatatgaggcagtttgtggcaagatagaagtaaatgacaagcatgatattcttatgatgacgaacatggtatcctagtaatgaccagctagtgttgacgcatgacatgaagtggtaacttgtatgaggttgacgccaaagatatgaactatgagaagttctggatctgaagccccatcatcaagtgccacaacccagtcgaagtcagctaaaggttcaaccagggacaagtcgggtgaagagaagattctatccgcaacaggagatcgagacaagcagtacagagtggagaagttttgctaggcaagtttgttataaaagacgcgatggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtgcaagaaaaattcgaatgtggcccggagaatttttgttaaattctccttggtctaaaaagagccctcaaattttacttgaattttcagagcaccggaaataattattaaacaacaaaaacaattatcaaagtttaataaaaagaaaaatctaaaaataatcctccttttcttttgggccaattttggcccaaagtccttcctctctcccctcggcccgcggccgaagtctccctttcctccctctctttctctccctctccttctctccctcctcttgggccccccttcccctcggcccagctccctcccccctctctctcccgggctgcctcttccccccccctcccctcccggcctgcccggcccaggccgcctccccctcctctcctcctgggccggccgcccggcccaacccgagcggcgccctcccgcccgtgccgcgcacgtgcgcgcgcctgcgcgccgttgccgcgcgctgagcgcgcgccccgcgtgggacccgcctgccaggccggtcatcttcctcctcccgcacggccctctctctctcccgtgaaaaccctacttagttcctccctcgaatccgcgcgatttaagcgttggattccaaaattaattggggggttttaatccccattgaatcctcttcaattgcccccaaattcccccttgattcgtgccttcaatcgtcgggaacgccgcgccttcctcggctgcctcccatggccgccggccgccattcccgtcgccgttccgccccctcccgagcccggctcccgcccccatcctataaaatggaaccccctctttgcgttctattgttttagccctttctcgagctcccccgcggccacagcacccctccccgccgtcgccctctctctcccgtgccgctggacgcctccagccgcccctaccgccttgcctgagcgccgcccggccgtgccgtcgccttcctcggcctcgcagccacctcctctccctcggtcagccctctgtttcgcggggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgcccgaagctcgccggagtggcctcctcgtcggcgtccagtacctccccgcctccggccggctcctgtacgtcgccggtacgccgatcgacgtcgccgcgttgtcctctcctccagctgctcctctgtttcgccggaacaccgtcgcccgtgctggcctctccatcctcatcgtcgccgacgtcccttcggccgcccgttcatcctcgccggctcgtcgtctcgcggtgccgcctccgtcgtcggattcgcagcggcgcgttccacgtcgtccccgtctccgtgcagctgccgccggctgccctcgtcgtctcctcgctggccccggtcgtcgtcgtcgtcgtcctcccgtcgttcccggtcgtcgtggcgttcgtccctccgtcaagccgttctcgtccgtcgtccgcgtttgtcaagtgtgccgctgcagccccgtcgtcgtcttcgtcctcgactccgcgtcgtcacgcctcgtgccggccgcgtctcgccttcgtccaaggatcgccgccgaagtcgtcccctcgccgttcgtccccgtagttcccggccgcctccgccgcgcccgttcgtcgttgtcgttcccacgcctcgtcgcgtggtggtaaggatccctccccctcgctgccctgtcctcgtcctttcggtgtcgcccgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcaacccgtgtggtgtttagtggagtccgtttgtcagccactcgcctcagttgacacacgggatccgcttccgtcgacccgtggaccgtctctgtgcactcggtctaccgcggtcctttaggttgacatgtggggtccgcatgtcaacagcgcagccttcctgtcttttctaggctagcgcttacacatgttttatagttgcaaagcttaattataataatccgcaaatctccatgtaacagcattaaacttcggatgatcatatcttggtcatacgaactctgaatcgacccgttcaagtctcctaatgtttgttataacctaaagaaccctgtgttttctttttatgtattgttattgcttctttataggcttgtagctttgcttgtgtgcttcgcgtagcttctgtcgttccggaggttcccgaagcgtggttcgtggtcgtcgccaaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccgaccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctccagggcaaatgaaggctacacgagctgcggcccggtagtcgagatgtcatggcacagggttggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggtcaaggcaggttcgtgtgggttcacggccttggttaataatactgtgtagctctaggatcgtctttataaaatggctttgggcaactaagtgacttttaaatgctgtttactgcaaaacttaacccctatattattaccccttgtactcccttgcattaattatgcatctccggtgtggcttgctgagtactgtggttgtactcattcttgctcaatctttcccctcttcagtaagagaatgtttggagaagatgtcttgggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgaaattttcccggtcgcgacaagatggtatcagagccatctcgactgtaggataagccaagtggataaaacctaaggacatattttataaataaaactatttgtgaaagtccctttttcctcctttcccctgtgctatttgcaaaatgtttattctcttttcttcctccttcggattttcaactagtactagatggtcaggtcagtgaagaagaagacatcgtcagttgtctgccgaagctccagaagactgcaggatccgctagcgaagtggaggaagcagtgaagccagctatgaagcaggagtgaagatcttgggaacccgtcgcagaacctaagccaccctatagggtagtgttgttagtcgcgtgttccttgcttgtgtgtgtagcgcgtggtttgcatcggggggttgtgatgtaaccatgctaggttgtttgcttaatcaacttgcagaataagtgaaacaaacagcacatcaacaagaagagttagttcctttaaggtcctatccctagttctggtctattctttcctggcttgtttcctctctcacctgaatccctgtaacagatgtttaacagagaaaaaggaaagaatgtcagcgggtatacctcaagtaactcaagttttcaactcaatccaccactggcccccagagagttaacaagggcacacccttggtccattccgagcatgctgtttagttcacagctaccattggttggaagtcaagaccaaaatcagtatgtgtttgatcgagcctttgccacccaagtcaatgagcttccaatgccagaagagcaggtccccttttgtcatgattgtagagagcaaggacactatgccctgaattgtccatgggtatatgtcaaagaagccccttccctggtttagcagggcagacatcgctaaaccagcctcctcacaccaagtcaagcttgcagcctagtgtgcaaagtagagagctcaacggagagaatccattgaatcccgggaaatgctttcctcctagcctctcgtaccacgtggggtcacatactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaatactttccgaggtgcacgacagttgacccagcacctcttaagccatggtggcagagtatctgatagtgaagggtcagatcaagtctcctcggatgatgaagatgagtctccccgacatctcggcgaggaagagatggaatcaaaggcatgcacccgttgcggggaaattgaacacgttgctagcgtgtgtctcacactctgcactcattgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctctcgctgcacctgactctgcagtaagtcatagcgataataccttcagcaccaaccattctctgcaccgaccgcctcagcaaagaattgtcatcgatggaagaagttgtgtctctccccgacctactccaggccgagccaaggacaatcaacctccggagggcgataccaagcagaagaccgttattcgcctcaaccagcaatcagaaggaaacttctcctgtgaatgatagcaatatgcagtcctat

SEQ ID NO: 64117 - DNA, 10395 bp, Oryza sativa
tgtagccttcatttgccctggagaatgtccatcgacccccgacttcatccacctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtgtccaagtgatatgaatatttcccaaagtctatagttgaaaaaccacctaatgttacctaattaaattgcgaagcatctacctaaaatcatactagggataccataagtagagtgtccactagttgaggttttgtttattctaggttgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcgggtcttccgaagctgcagcgtctacacgaccaacggaaaagaaaaggcttttactctaataaactccacataacagcagaaacaaagcataaaaatgggttcttgacttcttaaggaaaaattagagacttgaacggtccaattccgagttcaaatggccaagttatggccatttgaagtttatatgctctttaaatggatatttgcgaatttcttcatttaaattttaattttaaatcggatttattgcgtcagccgaggggaggggcgcgcggaccgggtccacgggagtggggcccacgcggcagcctcacggtccacggtggaccgggtgtacacggcttacgccggccggcgccgtgggtcccacgcgtcagccgcacctgagggcgcgggcggctgacggccgggccccacatggcagccgcggggcgcgcccgaaggcggcctcgccggcacagccgactggaggcggcgcgcccgcgcccctatggtcgccggcggcggccataggcacggcggagcggcggccgggagaggggagggaagggggaaacgaaatgggcggtccacggttcaccccgggtcgacggcgacgacgggaacggcgaccggagcggaggaaggcggcggcgcggctcgggtcgacgaggacggcggtgttccggcggtcggcgggcgaaacggaggggtggacgaggtcggcgaggacgcggcgaagccgaagaaggcgacgccgaagcaggagaaggtccggggcgacgacggcggcggaccggagctcggcggtgacggcggagagagggagcgacggcgcgagctcgattccggcggagagagagagcggcgagaggcggaaacggcggagggaggcacggggagtgtttatatagggttgggagggggagagagcggccggatgagggggaatcggccgcggaagatccggccgccattgatgcgctggcgaggtttagggggaaatgattccgagcgaatccgagggagagagagagggagaaatggggggaaagggggagggaatcacggggagtgatttccccctctttattgcgcgcgtggacggcgggaggcggcgggattcgtggcgacggcggcgctagggcacgggcgaggcggcgggagcggcgcgaggtaggggatgacgggtgggccccacccgtcagcgagggtggcgggcgggcccgcccgtcagcggcgcgcgcgcggggaggaggctgattgggccgcgggggagaggagagagagggagagggaggtgggccgagccggcccaagaagggaaggggggaaaaaaagactttttagggtttttctttttataaactcattttaactttgtttatttctttttaattattatttgtgctctgaaaattccactaaaatttatttacgcattttaggcttttaggaaatatacaaaaatcctccaagccttatttgacttttaacttagcacattttaattgttggaggctttcacaaggattttacttattctatgcataatttcgaggatgtattttagagtcgttttgggacgcgacatcaccgcccgcaagagtacctccaggcccgagcttgttcgtcagtccctggcgtggacatgcttcatggagacccctcgcgccgagcccacgcccttggttcctcaggaggagggagcctctggcgttggtagcacggaggatgcgctgctgctcaccttccgccctggcccgtcgcagaagtagacgagcagttagtaggcttgcgcgtgtattcttctcgtttgtttttctggttgagtcatgtggggcatggttataccggtgtgtggtataactgtgtcgaagcctgtctttattttatttgcttaagcaacttgaaccttaatgaaccaatttaatagcagaaataaattcaagaattatggtagtcgtgggtggttagttttaatagtcagctctctctgtttgctggttctgtgtggtattttcagatggtgacaaccaggagaagttctgctaccggtgaaggcagtcaccccgaaggcagcaaccacaacaaccaaggcagcccacctccacctcctcccccgcctccaccaccaccaccagacaccaactctatcctcacccaaatcctcgcccaacaggccaacatgatggctgctttcctccatcacatccaaaatccgccacagcataatgctccacctccaccaccacccccgcaacattctaaactcgccgagttcctccgcatccgtccgcctaccttctctagctccaataaccccgtggatgccttggattggttgcatgccgtggggaaaaagttggataccatgcagtgcaacgatgaggagaaagtcatcttcgccgcccatcaactgcaggggcccgcatctctatggtgggaccacttccaggctacgcagccagaaggacagcctattacttgggcccgcttcaccgccgctttccggaggacccatgtgcccgccggagtcatggcccttaagaaaagggaattccgggagttgaagcaaggcaacctctccgtgatggagtatttgcatgagtttaacaacttggcccgatatgccccggaggatgttcgggaagatgaggagaagcaggagaagttcttggcaggaatggaccctgagctgtccgtgcgtctggtctccggggattatccggatttccagcgtctggtggagaagagcatccgcctggaagccaagcacaaggaactggagtagcacaagcgtcgcctggcgaatttccgcaaccaacagggggctaaccaaagggtccgctataccaatccctacccagggggatcctcctcgcagcagcagcagcaaccatgctccgtgccccgacctcaattcgtggtgcgcgtcccacagctgcagcagcagcagaatcagcaagggacccgtgcgccccgtcctcctgcgcccgttgtgcagcctggtcaaggccgcagagacgctcaaggttagaaacgtttgtgcttcaattgcttcgagcccgggcactttgcggttaaatgcccaaagctgaggcgccagcaaggccaaccgcctccccgccccaacaacggtggtaaggatgtcattcggggtcgtgtgaaccacgtgactgccgaggatgtgctgacaactccagatgtcatcgtgggtacgttcctcattcattctattcctgctaccattttgttcgactctggagcttcccactcgtttatatctgtgccattcgtggggagaaatcagttgggggtagaaaggcttaggaaccctctgctcatcaccacccttggcgggttatgacagcaaagtactatagccctgccgttcctatagaaatccagagaatcccttttccctcggatttgattcttctggacaccaagaacttggatgtgatccttgggatgaattggttggctcaattccaaggagtagtggattgcgcaagacgcactatcactctgtaccgagggccggaacaactggtggttttctttgcacccccaacctctgtcggcagttcagaacttcatcagataggactgtcggaaatccccatcgtcagagagttcggagatgtgtttccggaagaactacccagtatgccacccaagcgagagattgagttccggatagatctcgctccacgaaccactcctctgtacaagcgaccctaccgtatgacagcaaatgaactggccgaagtcaagagacagttggaagagttgaaagagaagggatatatatggccgagcacttccccctggggtgctcctgtgatttttgtggagaagaaagacaagacaaagaggatgtgcgttgactacagagctcttaatgaagttactatcaaaaacaaataccctcttctccaaatcgatgatctgttcaatcagcttaaaggtgccactgtcttttctaaaatcgatcttcgttccggatatcaccaattgcgtattcgtgaagaagatatcccgaagaccgcattcaccacgcgttacggactgtatgaattcacgatgatgtcgttcggtctgaccaatgctcctgccttcttcatgaacttaatgaacaaagtgttcatggaatacttggataagtttgttgtggttttcattgacgacattctggtgtactcacaatcagaggaagaccatcagcagcatctccgtctggtgttgggaaagttgcgggaacaccaattgtatgccaagtttagcaagtgtgagttctagttgtccgaagtcaagttcttagggcacgtgatatctgctaaaggagttgctgtggaccccgaaacagtgaccgccgtcactgattggaagccacccaagacaatcactcgagtccgcagctttttgggtttggccgggtactaccgaagattcatcgagaatttctccaaaattgccagacccatgacgcagttgctgaagaaggaagaaaaatttgtgtggagcccgcaatgcgagaaggcgttccaaactctcaaggaaaaactagggtcctcgccagttttaatcttaccggatactcgcaaggacttcctggtgtactgtgacgcttcgcgccaaggattggggtacgtattaatgcaagaaagtcatgtggtagcctatgcctcacgccagctacggccccatgaaggcaactaccctacccatgatttggagttggccgctgtggttcatgctctaaagatctggcggcactatctcattgggaatcgctgtgaaatatatactgatcataagagtttgaaatacatcttcactcagtcggatctgaatcttcggcagaggagatggttagaactcattaaggattatgatgtgggaatccactatcaccctggtaaggccaacgtggtcgccaacgctttaagtcggaaaagccgttgcaacactcttggcgtccgtggcattccaccggaacttaatcaacagatggaagccctgaacctaagcatagttggtcgtggattcttggctacgctggaagccaagcctaccttgctcgatcaaatccgtgaggctcagaagaatgatccagatatgcatggactcctcaagaatatgaaacagggtaaagccgctggtttcacagaggatgaacacgaaaccctatggaacggaaatcgggtatgcgttccagacgatagagaacttaaacagttgatacttcaggaagctcacgaaagtccttattccatccaccctggcagtacgaagatgtacttggacttgaaagagaaatactggtgggttagtatgaagcgggaaattgcagagttcgtggccctttgtgatgtgtgccagtgtgtcaaggcagagcaccaacgaccagccggacttcttgtcacacccagaaattctcgaaccagaatttctaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaggcaaaccttgacgacagcgacgaaaccaacctctctgagatggctccaactgagaagaacttcaactttggtgtgggggaaaagagagcaagactgagtactaccccctgtactcagcaagtcataccggaagaggaggtatgatgcaggatataaccaaaggaagctatgggttcttttgcataaagcaggcatttcaaagcagtagttgaaagcaataaaacagctatagtaattaatcaatattaaccaatcactgtccaacgctacaccacgttgcaacaggcccaaccaaccacctgaactacacaagttcattaagttaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagacccttcacataaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtaagcacggtaagtctcccaggtttcccgtgaaccggtccttaactgccatgggtgcgaccagcaaaaccatgcactcacagcccgccattcagaatattttaattaactgacacccttgcggtggcaccaatctaaagctatgccaatagtcagagtctatgtaataatgtgatccccatttgtgtactagttgaactaagcatggctaagcatttcctaagccaacatctagtcattttgatacccaagttatcaatggcataagataaccaatatgtggctgaggaataggacccatcccacattacattgtaaaagaatgcaacatttaatagaaatgcgggatattggtaaattgggtacaatatgatcaaacgtattgcatgacttgccttgctctcaaactgatgagacctcagcaacgtcttcgagaaactgcggatcaacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccggggctgacgtcagcgaggggggcggcgtcgacaggcggagcccgcatgtcagcggcacaaggggagagggagggggcgccggcatgtggaccccacgggcaatggctcaagggggaagacggggtggcgcccggttggctcggctcggcttcaaagccgaccggcgaccatggcgaccggcggcggcgcgcgagcgccggtaacggcaagcgacggcgcgggaggcggcggtggacggcgcacaggccggcggcggcggccgaaggcgatggcgagcgcagggagcggcagcgcgtgtgggacagagggaaggagggaggagaggagctcctcaccgtgagcacggcggccggcgcgaaggatgaagacgacggcgatgaccggtgatgcggaggcatggacgggcggcggtgacaccctaggagaagatggagaggcgttaggataggagacgacgaccacggcggcttgaattgccggccggagatggaggggagggaaaaactcaccggctcgcgaggggagaggcgctccggtgggattccggcaacgcgaggcggtggctgggaaagctcttgcggcggcgaagctaacggcggtggcgggttggcgcggcggcgactctagcagcgacggcgctagcagcgagcggcacgagcacgataggaggcacgggagagtgcagtgaatgagggaaatgggagaggaggtttgggggagcgtttttacgggcgagggaggggcggaaacagccggggatggcccctatttggctggcgatgtggggagtggagggagagagagaggtggattcgaatgcgaatccctcccatttttgggcgggcgcgagagcgggaagaggtgggggaggggcggcgacatgggcgcagggcgcgggagaggcgcaggaggcggggaaggtgggcagcgtggggagcggtggtttcggcggtggttggcgccggggcgtgggcggctagaggtaggggacgaccccgacaggtgggccccacctgtcggtgcccgaaagagaaagggagggagggaggacttcagggaggggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaacggcgcggacggctccactccacaggcagcttgaccaaggctacacctaaacctccacaccatcagcatcattgtagaactcttcctctgatgaatgattgcaaggtgagtatatgacatactcagcaagccacgcagcaaatatgcaagtgcacaggataacaaaggatggcataatagggtttcatttgcaaaaacagcatttaacaaacttttcagaatttaataaaacagttgagtattaattaaacaatattaatccaacgctatacaacataccctgttgtataggcccaaccattatgtacaaccatcccagctgcacagttctatctccaaaccaggaatataccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcgccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgctccgcaatgaaccatgttatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaaatcattaaataatagtgagtcataagttatcccaatagtgtgctaatgtttctaagcagggctaagcaattatatctaatatctagttgaaccaatatataaagctcaactagtcaaattataataacccaaggtatcaaggaataaagtaatcaagaacaaaagggctataacaaacaataggttatttccacccaatgacattcgaaaataaatgcaatagttgaatagaaataatagctttaaataggatcaacatgctcaaagggttgtttgggatctgtgtgacttgccttgctggccttggaactcttcaaattcttctcctgcgaaaacggactctccggaaacaacggaatctaagcagaaaagagcaaaatcaccaaaacagcacataaacaagcatgaacagtacatgtggatatttttaacctgtagatctcaattttagaaaaatttagagacttgaaccaactaaatcggagctaagatgaattagttatgaatttttgaagattaaatcggatta

SEQ ID NO: 64118 - DNA, 14371 bp, Oryza sativa
ccggctcacgggagagggcgaagatgacgtcgacgatgacgtcaccaccggcggcggcggctcggcggctcggacggcgcacgctcaccggcgaacggcggcgctttggcacgaactgaggacaccaacgggtagcggacggcacggcgaactcaccggcgaccaaagcgacggcggaagaccaacggacggcgacggcgacgaggttgaaacggcggcgctcttcggcatgacgacggcgacgatgctccggcggtctccgacggtggcgaagcggcggacgaggacggcgacgacttggcgagcacgacggcggtcttcccgagcgacgacgatgactggaacggcggcggcgcacggctggagcgacggcggcgacggcggcgctagggcacacggcgctagagcgctacgggcgacgagaggcgaaggcgagggtggcggccggtagaggagacaccgggggtccttttaaaggggctaggaggcgacggcgaaggcccacggcgaccggcgacgcgaaggaaacttcgggttcgggagagaggaaagtcgatccgatttgacttcaaatctatcgatttccaaaccgatttagccgatgattccaaaagagaaaaggttgaggagatctcgaggatcatttgccctcttttgattcggccggagaaggaaaggggcggccggatttggaaaggaacggcggcggcgcgaaactagggtttcgggcggcggcggccggaggttgacgacgaccctgacaggtggggcccacctgtcagcgggagagagagaggagagcggcggcttggactgggccggctgggctgaagagagagagagagcggttttgggccgactttcggcccaaagccaaaagagactttttaaaacctttttcaatttaaattatttatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctcttaaaataaattctaaaaattccatttaaacaacaatttatatattttgaattttcagggtgtgacaggaaaggaggagcgggccggcccaggaaggggcgccgagcgcggggagagagacgggccgacggcccatctagagaaaaaagaaggaaaagaaaaagaaaaagaaaaagaagaaaggatttttcctgggatttaaaattgcactttggtgatttttaattgattaaaattatttccaaggctctgaaaattccactaaaaatcttgttaatgcattggaaaatggggaactcaagaaaaattccaccacgctatttccgattattaattgcatttattaactagggatttagctctaggttaattaagataatttcttcgggcaatttatttaaccaatttttaaagcaagaaaaagggggggatacttcagggtgtgacacttctccaacctctccaactaccagaatggaaatgggatgaaattgggatggatttcatcaccggacttccaaaaacctagggcggttatgattctatatgggtagtcgtggatcgactaaccaaggtagctcggtttattcctgtgaagaccacctatggaggaaacaaactagccgaactctacttcgctaggatcgtgagtctccatggcgttcctaagaaaattgtatctgataggggaagccaattcacctctcacttctggaagaagctccaagaagagttggtacccgattaaatttcagcaccgcgtatcacccgcagacagatggacagaccgagcgtctaaatcagatcctagaagatatgctccatgcctgtgttctagattttgggaagacctgggataagagtctcctctatgccgagttctcctacaataacagctaccaagccagcatacaaatggcaccctatgaagcgttgtatggacgcaaatgccggacaccgctattgtgggaccaagttggggaaagccaagtgttcgggaccgatatcctgagagaagctgaagctaaagtcagaaccattcggcataatctaaaggtggcacagtctcggtcgaaaagctatgcagataaccgacgccgtaacctggaatttgcagtggatgactttgtgtaccttagggtcacgccattgtggggtgtacacaggttccaaacgaaagggaagctagcacctcggttcgtgggtcctttccgtatcatcgctcgacgcggagaagtcgcttaccagttggagctgcccgcatccttgggtaacgtgcatgatgtgttccatgtgtcgcaactcaagaaatgtcttcgagtgccatccgagcaggccgattcagagcaaattgaagttcgcgaagacttgacctacgtggaaaggccagtgaaaatcctggacaccatggagcgcaggaccaggaaccgggtaatccgtttttgcaaggtcgaatggagcaaccacgctgaggaagaggctacttgggaacgtgaagacgagctgaaggcagcccatcccgatctcttcgccagttcttccgaatctcggggtcgagattccgtttaaggggggtaggattgtcacgtcccaaaacgactctaaaatatatcttttaaattatgcctagaataattaaaatccttgtgaaagcctccagcaattaaaatgtgcaaagttaaaagtcaaatcaggcttagaggatttttgtatatttcctaaaagcctaaaatgtgtaaataaattttagtggaattttcagagcacaaataataattattaagaaataaacaaagttgaaaaatttttataaaaagaaaaaccctaaaagtccccctttcctcccttgggccggcccagcccatctctcctcccccctctctatctcctctccccgcggcccactcggcctctccccgcgcgcgcgccgctgacgggcgggcccgcccgccaccctcgctgacgggtggggcccacccgtcatccccgacctcccgccgcctcgcccgcgccctagcgctgccgccgccgcgaatcccgccgcctcccgccgtcccgcgtgcagtgaagtagggggaaatactcctcatgattccctctccctttccccccatttttccctccctctctcgcgttcaaacaggcggatttgcccccgcaaatcttgccggcgccattgatggcggccgacctcccgcgccggtttccttcccctccggccgctctctcccccttccaaccctatttaaaccctccccgcacctcctccgtccatttccgcctctcgccgccctttcacctcgccggattcgagctctcgactttgctctctctctacacgatcgccgcccatcgtccggccgtcgtcgtcgtcgccctggaccgcctcccacctcggggccgcctccttcggcttcgccgcatcctcgccgacctcgtccacctttccgtttcggtcgccgaccgccggagcgctgccgaccccgtcgacccgagccgcactgccgcctccctccgcttcggccgcctcctccgtcgccgccgtcgccccggggtggagccgtggaccgtcgcctcctttcccccttccctcccctctctcggccgccgctccgcggcgccggtggtcgccggcggcaaccatcgaggcgcgggggcgccgcctcccgccgaccgcgccggcttggccgccctcgggtgcgccaagtggctgccgcgtggggcccagccgtcagccgcccgcgccctcgggtgcggctgacgcgtggggcccacggcgccggccggtgcgagcccgggtgcgcccggtccaccgtggaccatgaggctgccgcgtgggccccactcccgtggacccggtccgcgcgcccctccccctcggctgacgcaataaaccctttttaaattaaaatttaaatgaagaaattcgcaaatattcatttaaagagcatgtaaacttcaaatggccataacttggccatttgaactcggaattggaccgttcaagtctctaatttttccttaagaagtcaagaacccatttttgtgctttgttcctgcttgttatatggagtttattaaagtaaaagcccttttcttttccgttggtcgtgcagacgctgcagcttcggaagatccgctcttcgtggaggttgaagccaacgtttgggaaagtgagcaaggcaagtcatatcatccttgaacatattggatcccattttataaaattattttgatttaaattattgcattatcgctttacttaaattcccgcgttatcattgttttatttagccatgcctatttacctttgttatgaacttattattattgttattgatattattaccttattcaccctagattaaacaaaaccccaactagtggacactctactcatggtacccctagtatgaatttaggtagatgcttcgctggttaattaggcaacattaggtggttttacaactctagactttgggaatattctcatcacctggacactatggaatggatggattattgtggaattggattcacacctccccctctattcaaaatcctcaaaatggttttaggctggggtcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgaacaatgtacccaagttagtgttttaattcttaaaaccagcataacaactaaaatatggaacggttggcctgggttggcttgggacgagctgagacccagggtcgggttgccagttcggtctgaatcatcgtaggccttgggttaaggcaggttcgtgtgggttcacggccttgattaataatcttgtatagctctaggatcgtctttataaaatatctttggacaactaagtgtcctttaaatcctgtttactacaaaccctaaccccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccatcaagcgcctgtggtcgtcgccctagtcttccgctgtttttcgtttgtcttcttgtgtgctgggccttcgccgcccatgtaataaattaattatttacgcttccgcttgttaaactctgaattgtatcaacttttggtgtaccttgcctcctgggacaaggaataatacacgcacgtaaggaacagccgttgggttatttccggtcgtgacaattggtatcagagcctccttgaccctaggacgagatttagatcccaagccttagcaatattttcgaaataaaaatccattcttatttgtgaaaatcctctagtctctctccgtcttgctgcttcatttatcatcaaaagctgatccctaaaatgtttatttctttttctcttttgtctttgtttgtagatggccggcagcatcaaccgtcgtggcctggacctgactggcttcattttggagctgcggggcatgtgcgttgtcctggggtatccgcatggagtggactaccagggcaagcagctcccggagcaggagggtgacgatgcagagccccacgctgcttgggaggtcactgcagtgatcctcactggctcacccgagaggacttcgttggcagtcaccgcgggtggagattctttctccgccgcttgctagagcgccgtgctcctcgccatcggcactcttcaccagcgctacctggacgagttgcagcactcgccctaccgctaccaccctcgtcgaggaggagcccgcgactacgtgtcacgtccgataaattcatcccgaaataaaaatcattctctaaaaggaataatagaattaattaaaattcgaaaagaaattggcaaacactaaaatacgtacaagaaaaattcaaatgtggcctggagaatttttgttaaattctccttggtctaaaaggagccctcaaattttagtggaattttcagagcacaaataataattaagaagaaataaacaaagttaaaatgattttataaaaagaaaaaccctaaaaagtcttctttcccccccttcccttcttgggccggctcggcccacttccctccctctctctctcctctcccccgcggcccaatcggcccctcccgcgcatgcgccgctgacgggcgggcccgcccgccaccctcgctgacgggtggggcccacctgtcatcgcctacctcgcgccgcgcccgccgccgcccgtgccctagcgccgccgccgccgccgaatccgccgcatcccgccgtccccgcgcgccataaagagggggaaatcactccccgtgattccctccctctttccccccactttcccctctctctctccctcggattcgctcggatttattcccgcaatcgtcgccggcgtcatcaatggcggccgagatttccgcgccggtttccttcctccccggccgccctctctcactcccgtccctttataatcgctccccgagcctctctcctccgtttccgccactcgccgctcgctctttccgtcggattcgtgctcgcgccgtcgcaccttctctccgccgtcgccgccgagctccggtcagccgccgtcgtcgctccggacttcctcccgactcggcgtcacctccatcggcttcgccgcgtcgtcgtcgacctcgtccgctcctccgtttcgcccgccgaccgccggagcaccgtcgtcctcgccgtcccgaaccgcgccgccgtcttcctccgctccgatcgtcgtttccgccgccctcgtcgttccggggtgagccgtggaccgctccgttcgtttccccctcccctcctctctctcgggtgccgctccgccgcgccgttggtcgccggcggcgcccatcggggtgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggtcggcgtccgccgcgtgcgcccggtccaccgtggaccgagaggctgacgcgtgggccccactcccgtggacccggtccgcgcgccctctctctcggctgacgcaataaatccggtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttatgctttgtttctgctgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattattgttattgttattattacctcgttcaccctggaataaacaaaaccccaactagtggacactctactcatggtaccactagtatgattttaggtagatgcttcgcttttaattaggtaacattaggtgattttacaactctagactttgggaatattctcatcacctggacactatggaattgttggatcattgtggaattggattcacacctccccctctattcaaaatccccaaaatggttttaggctgggctcggggtgcatggttttgatggtagcacctcggccatataaggaccggtcttcgggcctctgttgcaaagcattaccgtacttccacatgtctagtgggtaaggcttagtttgtggctcagtctggttgtaaaaaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcttacctgtcccggaggttccggccgtaggtgggattgggtcggtactcttgtctatagctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaaccggcttaacaactaaaatgtggaatggttggcctgggttggcttgggacgagctggaacccagggtcgggttgccagttcggtctgaatcatcgtaggccttgggttaaggcaggttcgtgtgggttcacggccttgataaataatatggtatagttctagaatcgtatttacaaaatagctttgagcaactaagtacctttaaatgctgtttactgcaaaccctaaccctttatagtataactcctttgtactcccttgcatttattctgcacttgtgggtgtgtcttgttgagtacggtggttgtactcagtcttgctcaatttttcccgaacccagaagaggagttccttgaagatgaaggctttggtgtctagctcgtgcctgccgtcaagcgcctgtggtcgtcgccctagtcttccgctgtttttcgtttgtcttcttgtgtgctgggccttcgccgcccatgtaataaattaattatttacgcttccgcttgttaaactctgaattgtatcaactttcggtgtaccttgcctcctaggacaaggaataatacacgcacgtaaggaacgcccgttgggttatttccaggcatgacatgtgtccacactattaatttggtatctctataccatgatccataagacattatcatcaattaatacatgtgttgatcatataaacgtatttgttccacatatgatatttgatcagggatcctttagaaatagcaacacataacataaagagtctgatgaaagaatcacatattcattaaccaataatgagtttatctattttaagaaacaaagtcggataaatatgtaaacatagtgtgtgacacgatcatctctatgattgcctctagggcatatcactaacactgaaaacctttcgttttgcccacgagacggttagttatctagaatcggctccgctaaccggtttagttaacaaacccatcttgctttagcttttgctagatcgaggtggttggcgactctaggatcaccacaaggcgtttagatgctgcgatcgtgtgcttgtcaacttgtcacaaaaagttgccaacagtgatgttaacggtttattagtgaaaaacataatttataaatacaagttttatatttgtattctaagcaatttaaacgttaatgctgaataaaaaactccattaaaagtactctaaaatcaagtctaaaatattgaaatacaaatatatagatggttaaatagaaaatttcagcaactcaaatgcgaaagcaaaacaaaagatgaaagtactaaaatagaaacataagaaccgaacaaattgaatgccgcgcgtggataatctttgcaactatgcaacttgccatgacaaagagtgaaaaacgcagagattatatcagcacggaaacgagaggagacttcagaaaacggcgaaggatgctgcccggaaaaaataaactcccttaaattcctatgcatatcttgtgctccgcagaccaagtaaaaacttaattaagcacatgcatttgacgccttttcagtttccaccatatccaaatgttcgttctccacaagtcgtacgtgcacggctcaaactcaccttttttttatttcaggtcaaatgtcctggtaagttaaatagactgcatgtttaggagaacaatacccttgtgtcttttacgaaaacttttcagactagacctctatattttccttggcacaggaaccatactcgctctaagttagtagcgcggaatcatcttctctcacgcatcgctaatattatattatctcacgaccaatgagtttaaatggaatattctaaccagtgatgggaggttctcggttaaatctctttatcttgcattggtgtagaccggagtttccaatagacaaaaagaatttagaagatcaaagccctcctaaagattaagatattcttatggtacttacgtcgggcagtagttttaacaagagataatctgattaaaaagaataggaggaaacaagacttgttcttaatatcacgaagagaaaactgttaaacatttgttctttgattgccgttttgcccacgtggtttggtccttaatccactttgcttgtaatattactttacataatagtataactcgtatatatgtttgggtgtaggataagaagaaaaccacacaatttgtggcaacgaaaacaaatgttctttttcctaaattttttgtccaatctttgatcaattatatcattgtatattcctctcaaaaaaattatatcattgtgttgtattcgttaaatttcactaatctataggtattttaatcaaattatcacaaaactatatatttaacaccaaatttatcttaaacctatagatttaaggcctacatattttagagtttaaatcctagcaccattattactttggagctataaacattgtagttttgaactaaattttgggttctggtagtgagtagtgactgtatcgtcggtgtagaagcattagccaaatacttcatggcattataactcatttttataagttagatacataacgatttatgaaagcacggtatcaatttgaaaaggtcgtctatcaaatgattaaattggttccggattccaaattaaaatacttgctacgtatgcagtatgtcgttatcaaacgtgatggatctggttatccttattagcacgaggggttacttcagctttgtgggcgaagttaattagttgaccataagttttaacgtttacttgtacacataccgtgctttcatatctttatatggtacgcgtacacacataccgtctagatgacctcttttacgtatatatataagttagaggtcatatctttaattaacaagccacgcagtgttgtttcaggggagagagagagagagatgcgttcttgcggcatcagaggtgtcattcgccaccatctggcgtggctggtgctaattttgtgctcatggcaggttgcagctgctcaggctcagcaagcaccaaaaaccgatccagtcgaaggtaggcgtatagatggccaaatgggccgcccggcccggcccggcccaagcatggccgtgcctaggccaaggcttattgggccggcacggcccgaccaacacaccgggccgtcccgtgccagcccacgggcggcatccacggcccaggcacggcccaatactactcgggccgtgccgggccggcccgaaggcacgatggtccatcgtgcttcctcatagaaaaagtctatttttggtcgctcaactttgtgggctgtgtttaaatggctggaaaataagtctattttgtatacctcttatcttgggccttgccttatatgattatttaagtctattttaaatccctatattttttttatttgaccgggccgtgccgtgccggcccagcgtgccgaaggtgcggcccaagcacggcccggctgtcgggctgggctggcacgggcacaaccccagtcaggccatgccgtccttggccaaacagccgtgctttgggccgggccgtgggccacgggccatatggccatctataggtaagcgagcaattaatcatgcacgcgtacgtatatacgtatcacgcatgcatatgcatgtctctctagtttggttttcctccatgtagctagatcgcaggagttgtaatttgtggttgataacattgatatggtgtccccctcttgccgccttgaaacgaaagagttagagaaatcttatatatttatataaagttctatcctatatatttttataaagtccattcctaaccgtagtaattattactatttatatcttttcttattaagccacatcatccgaattgtttttttattccttcgatagttggtagtatattgtgcaaattatctctcatattttcctatcttattaagtcatatcaccttagttttatatttaagatgatgtacttggccacatcactattgttgtgattttaaatgaccaatctagtttaaattattataaataacatcttaattgtacgtagtatttttctacagtagataaagatggttaattcattaatcgcctagctagcttccatccgcatgattaataatggagagtttaattaaccatgcagcggctgctctgaacacgatactggggagatggggcaagaaggcatcgccggagtggaacatcagcggcgagctctgcagcggttttgccactgataaaactgactgggattactaccccaacatcaacccgttcatcaagtgcgattgcacggacagcaacaacaccctctgccacattaccagactgtacgcacactctctttatctttatcgtggtttcatcatatgtgctccacgcagtgcctgaaagagcccatgcatacacacgtatatgctgcaagtatacaaattaaaaaacatatatatataaacaccagattattaatattaattagtatctccaaggaatgcgtagaggaatcagaaaagtctatcctaaattcggtacatatcttccttaaaaaaattgtacatatctgctggacccaaatggaggtattaatttggtcctccggctgtatatatgtatcccaaacacagttctcttatcagtatttttacttgttttttatgcaggagggtaactaatttgaatgtagttggtcaaatacctacggagctacagaatctcacacatctagtggatctgtacggtatccaagacttctcttcttaattaatcttgctactagtcgcatcgggaaattcactagcttgtaattagcgaattaatttgtgcattctcgtctagtaattagccgatatactagaaacgacaattcaataatccaatataataataacattagatattacttacaaataaaaagaaaacaatagcttacaaacgatatagcattagcttcagctctagttccacgcacagctcaactgagatataagccagatgtcttcttcctcaaaaattttcttcaactgagatttgatgattattgtatggcgagtacatggaatactccataagccacacagaaaaaatacaggtgcatggtgatacaaaggaaggtatgatagggttcatttgcaaaagcaacattcagcaaaacaatataaaatcaacactgtacaacatacctatgctccataggcccaaccatctctaaacaaccaaacccgactacactgactaaagtccatacaaagagctaacaaattatcattaccaatttatttatcattaataagtagtgtgtgactaatcacaaaaaaaacactgttaggcttgcccataaccgcgtgcacaactattcgaacagttttactctggccagatatgtactaatgtacccacaagacaattccacaacctgtcaccatgtcatcatgtgcccacgcttaacatgtcaccatgtgtgaaattctaacaagaccattcgcatagcacaactcaaagtag

SEQ ID NO: 64119 - DNA, 1097 bp, Oryza sativa
ttatatcgataatatttacattattacaaaggcacttcaagcctgacaatcaaaaataaacagcagcggactagcgggcctacggctccatcttcacaggcgctcaactggggtataagccagggctccacctaagacttcttctccaaagcttctcttactaggggagggaagatagagcaagaatgagtacaaccacaatactcagcaagtcacaccgggagatgcatgattaatgcaagggaaacaaggggtaataatataggggattaggttttgcagtaaacagcatttaaaagacacttagttgcccaaagctattttataaagacgatcctagagctacacagcattattaatcaaggccgtggacccacacgaacctgccttaacccaaggcctacgatgattcagaccgaactggcaacccgacctgggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccatcgtaaacatgtgacataacccttcacccatcctagccgtgaacaaaagtaccgacccaaccctgcctacggccggtatcccgggacaggcaggccaggattgagcccctagcaacaggatctagaccgggtgcgccacacgcataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttacccattagacatgtggttagtacgatagtgctttgcaacagaggcccgaagaccggtccttatagtggccgaggtgctactagcaaaac

SEQ ID NO: 64120 - DNA, 2817 bp, Oryza sativa
ataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacaaatctaaaaccataaccctctgcttgcaaacaagaagcagagataacgttcttacacaaagctggaatgcaataacaattatttaactccaaaactaatcctgacggtaaagataatggcatagtgccgaccgcaacagcagcaactcttgctctattgcccacgcgaatgtccacttcgcctcttgctaagctcctacttcttttcagcccctgcaacgatttgcatatgtgagcaactgaaccggtatcaaatacccaagaatcagtagaggaagtagcaagattaatttctataacattaatacctgagatggaactctttccatcctgctgcttctacttgagctgctctaggtatttcttacagtttctcttccaatgacctgtctcgttgcaaaagaagcactctgcatccttagcgggccctgtcttttgaaccttggtcttagagttgctagtactcgtgatctcatcagagtttagctttctcttttgaccactcttcttgttgttgggcttgcgcttatgcataaccatcatatggttggagtttttcttaatgctttcctcggcagtcttgtcgcgaccgagaaaatttgcattttcccgaacgctagtgtattaatccccgtcccagaaaaagccggcgtacaccacacaaacatgatacaaatggcacatctttattatatcgataatatttacattattacaaaggcacttcaagcctgacaatcaaaaataaacagcagtggactagcgggcctacggctccatcttcacaggcgctcaactggggtataagccagggctccacctaagacttcttctccaaagcttctcttactaggggagggaagatagagcaagaatgagtacaaccacaatactcagcaagtcacaccgggagatgcatgattaatgcaagggaaacaaggggtaataatataggggattaggttttgcagtaaacagcatttaaaagacacttagttgcccaaagctattttataaagacgatcctagagctacacagcattattaatcaaggccgtggacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacgaaagacgtgacatagtttccaacccatcctagccatagacaagagtaccgacccaatcccaacctacggccggaacccccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttctgtttataaccagactgggccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataagccaaccattccatagtgtccaaatgatatgagaattcccaaagtctaaagttataaaaccacctaatgttgcctaattaaacagcgaagcatctacctaaattcatactagtggaaccatgaatagagtgtccagtagttggggttttgtttattctagggtgaacaaggtaataataacaatagcaataataatgtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaacctttggcgacgaccgcgaaccacgcttctggaacctccggaacgacagaagctacgcgaagcacacaagcaaagctacaagcttataaagaaacaataacaatacataaaaagaaagcatacggtactttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgctgttgacatgcggacctcacatgtcaacaaaaaggaccgcggtagaccgagtacacagagacggtccacgggtcgacggaagcggatcccgtgtgtcaaccgaggcgagtggccgacaaacggactccactagacaccacacgggctgcacacgtggaaaccacgtggctaccgagcgggcacactaacacggtcaccacacgcacaa

SEQ ID NO: 64121 - DNA, 1169 bp, Oryza sativa
cggattcgagggaggaacgaagctagggttcacgggagagggagagaggaggccgggcgggaggaaggagacgaccggcctggcgcgtgggccccacgcggtcggacgcgcggtcagcgcatgcgcggcgcgcgtgtgcacggccggctcggctcggcctggcttgggcgcagcttgggccgggcggccggcccaggagaagaggagggggaggcggcctgggagaaagagggaggaggagggagtgggccgggagggggagaggaggcccgggagaggagggaaagagagggaggagagggagactttggccgtgggccgggagagagagagggaggactttgagccaaatttggcccaaaagaaaaaggaggattatttttagatttttctttttaataaactttgataattgtttttgttgcttaataaatattcccggcgctctgaaaattcaagtaaaatttgagggctccttttagaccaaggagaatttaacaaaaattctccggaccacattcgaatttttcttgtacgtattttagtgtttgccaatttcttttcaaattttaattaattctattattccttttagaaaatgatttttaatttcgggatgaatttatcaggacgtgacatagagtacccactagttggggttttgtttatcctatggtgaacaaggtaatagtaaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcagagagaacggccttccgaacctttggcgacgaccacaaaccacgcttcgagaaccttcggaacgacagaagctacgcgaagcacacaagcaaagctacaagcctataaagaagcaataacaatacataaaaagaaagcacacggttctttaggttatgacaaacattaggagacttgaacaggtcgattcggggttcgtatgaccaagatatgatcatccgaagtttaatgctgttacatggagatttacggattattgtgattaggttttgcaattataaaacatgtgtaagcgctagcctggaaaagaca

SEQ ID NO: 64122 - DNA, 783 bp, Oryza sativa
atggcataccaaaaagggaaagtaaggcaggtgcaatttccggaatattgattggtgcaatagttttagtattagcagcattatttggagtatttacactgataaagaagcggagagcattggcacaacagaaagaaggtatgatttatcagtacataattcaaacatcaaaattgtcaactggtttattcttctcatctatactaaaaataacatgcagaactatacaacctggttggacgacctgatgttttcagttacgctgagctcaagctagccacagacaatttcaattctcaaaatattctaggggaaggaggattcgggccagtgtataaggttcttaatttatttccataattaatcatgtacaactgcaactggttataaatttgtgtgattttggcatttaagtgttgtgttttagccacatttgtctatgctcaaaatatacatgtaaaaactttatcagggtaagctacctgatgaaagagttatagctgtgaagcaactttctcagtcatctcatcaggggacaagccaatttgtgacagaggttgcgacaatttcagctgttcaacatcggaatcttgtgatattgcatggatgctgcattgacagtaaaacacccttgttggtttatgagtaccttgagaatggaagcctggatcgagcaatctttggtgagttcacttctgcaaaattgccaccctcggcacttatagaattgtattttcttagttcacaaataaaactcacactacaacaaatataccttgtaga

SEQ ID NO: 64123 - DNA, 2209 bp, Oryza sativa
aaaatgccattacatatgaggcaaattttaaagtgccgaaaagatgtctctataagataaatttaacaaagtatgctaaaaatatctctaaagtgtctctagaataaaaatattttaagcgattttaaaagtgactctaaaaagtgtctttagactatagagcttcaaaacttagaggcgttttgaaaattgtctctacaaaagagcctctacataaggtttggtttttgttgtagtgtcattgcttcatgactaataattatggatttttcttttctgcatttttgtaataatttgcgttccttatgataactgagctatttatgcttgtaaaggtgacagcaacttaaacctagactgggtaatgcgcttcgagatcattttaggaatagcaagaggcctaatttatcttcatgaagagtcaagtatacgcattgtgcatagagacatcaaagctagtaatgttctacttgacactaatctcgttccaaagatctctgactttggacttgccaaactctatgatgaaaatcaaactcatgtgagcactagaattgcgggcacattgtaagaatattttaccacttatcatcttatgattataacatcaatatgaatgctactattaacctgtcttatcttttttaaggggttatctagctcctgagtatgcaatgagaggccatttgtcagaaaaggctgatatttttgcattcggagtggtcatgctggagactgtcgctgggcgaccaaacaccgacaactccctcgaggaaagcaagatctgtctccttgaatgggtatgctggtctatgatcttcccatacaagaaaacttcaattcactgtgtattgtcttttgcttactgaaactatatacaataaaacttcaatttaaggcatggggcctgtatgaaaaggatcaagcacttggaattgttgacccaagtctcaaggaatttggcaaggatgaagcttttagagccatatgtgttgcacttgtctgcactcagggctcaccgcaccagcgaccgccaatgtcgaaggttgtggcaatgctgactggagatgtcgatgtggctaaggtggtcaccaagccgagctacatcactgagtggcagcttaggggtggtgggaacagcagcaacaccactagcagctaagcagaagtttgtctccaggttaagtgaatttaaagtagaaaatgcatgggtcatcaagattggtttgcgacaatattgtatgtctttttctaaaaaataattatgtgttgactaaattacagcaaataatggaattacttatccttaactcggtcctggtaataaaagtttgctcctaataatttgtaaatggtgaataaccgtggtgtattcaatactcaataaatgttaatagataaccctcaatctgtaatggccagtgcaatgcagaggtaaaattctgtcccattgttaatttcatgaagagctgtctctcccatacttttttcagatttttatttaatttctaaaagttgtagtacaaactagtaccaaaacatttattaatcattacaaaccagtactaacgtgttttgaaaggttttaaaatccatttgcgaaaggttttaaaatccatttgcgaactcctcctacgtactagtacgaatttgtgaaattccgggttagaacccgctaacatgtatgttttgaaaatgggttgataaaatttaaaatttgatagatatgagaggttgaacacttcatcattatatttctgtaccataaataatattggtggcgttttgaactcctctatcatgatatttcaaaattgtaccgatatggtatagaacgggtagatttgggacaggttagtaattgttgtgcgtaaaccctggatttattgcttagatcaatcatataaaattcgtatggcctctggatcactttaacttcacaacattaaaagatgatgaaagtaggaaacttaaaacgtactctaagatttatgttgcgttggttgtgggggacacagagaaaccaggctacatctcttcttcacctgcccgttcagtgtaagatgttggtaacatctgggaatcacatggaatcaacacatgagttctttcaaatgaatgtcttagtaaggctgaattttgccagaaagggtttcttggaaattttctttattgcctcttggcacatctggaagcagagaaatgggtt

SEQ ID NO: 64124 - DNA, 6823 bp, Oryza sativa
ttagttatgaattttgtaagattaatatgctttaacctaatacagaaaactattatgatttacgacgcaataaagatttattttgaagaaggaaaagggcttttcttacgtcagcatgacgtcatcgtcggcactgcacgggaccacgagatcaccggtgctacagggctcggccgggctatccaagggcaccatcgtggagaggacgacgaggtgaactcaccggtgctcagaacaacgacggacgacgacgaacggcggccggcggtgagctccaacggcggcgcggctctgggcggcgtcgacggcgggattccggcgggtctcgacggcaacggaggagcggacggggtgcggctccactcggcgaacccgatggcgacaatagtgagcggcggcggcgaccacaacggtggcgtggggcggctaggcttgcggcgaccactaggacggacgcggcggctgtgctatggaccacggcggaggacgtggcttcagggcaatggtagaggacgacaaggggatcatttacataggcacggaagctcgagatcgatcccacaccgagaggaatcaaagccgtaaaactatagggttaggtggagagataaactcgaattcgaattcgatttggataaactacacgaaattcggctccgattcttaggggaaaaggaagaggacgatgaggggataaatttccctcatccaatcgaactcgggagcgacgaccagcggcggatttggtggggaggtggtggtggtcgggctcggcttgactggccggaggtaggggatggccccgacatgtgggccccagatgtcggcggcttagagagagggggaggggcggcttggcctgggccggcagggccgcgtggctcgcgcgcgcgaggggaagagttgggccggaaaagggcccaacagattaggataggattttaaaaattttcctaattaaaataattcgtgaaatgctatttcatttaataaaaatacttcccttgctcaaataattcacataaaaatccaggaaatagataaacaagcaaagtatttaataaaattgtatctatctcaattttatgtgcgattttgctagtttttattagggtttatcttgtaggtttttaaaataatttctaaaaaatgcattaaagaatgaattattaaattaagcgattctgagagtgtgacatgtagggagaatacttccataaaagatgcccgtggtgccttaggccctctttttgcatgtgtatagtattatgtacacattggatgacatggcgttggacctgttcgaaatagtgctgggacagtatgtcaacatcttcattctggtagccatgccctacaatttactcacccaacattgctgcggaattctagaggcactcttaagtttcagtagtcagtatggactgcaaatctctgcccctatacagccaatatcaaattgcctttttcagtacaatgagctccatatcttgaggtatgtatagagattatggataccccatacccacacggcatatatagtctgactgggtatggggtgccatctgtagatagaatatcttttaaagggactcggattaaatttcaaacttgtatgtcaaggaaatatccgggatcctagtcggttacgattgtaacttatctgtaactacctattccgttagggatatggattgtactttgtaatacggacccctcccctatataaggaggggtccgggtgcctctaagggcacgattttctcccagatcatacggtcaataacatactcggcggatcaatccccggacaggagtagggtattacttcttattaagaaggcatgaacctgtataaaattccttgtctctcaacccatccacttttccagcttgatagccacccccttttagtattgccgaaatctcgtttcgacagttggcgtgccaggtaggggtagcgtcaagttcttcgccgactagtgcgatgggtttcatctccggcatcgacgacttcgtcttccctcccgggcaggcgttccggtttggcagcctcgactttgtcaccaacgacttcggcaagatttctctcctcggctcagatccgaaacagtcggggagaggccaggtctccgccccgttcggtatcccgaagtcggccgagatctactccaggatcatcacaaccgagccggccccaaaccactcggacgagatccaatctactccaacatgacccgatcaagacgatggcgcctatcctccaatcctgatgaaactccccgatgacttggctgccatcttcaccataagggcgtcttctccccgtaggcctaggcgggacccgacctcggccccgatccagtctagctctagggaagtcggcatcatactccagcctctcggcacggtttcgacggaacaattggacggctaccttagctcccccggtgtcgactctcgaccgacagagatcgtagagtacgacgacttcggctaccgctacgaccaccgcaacctcgacgacttcgatgaaggctacgaagataactacacacctctctacttcggcattttcatggccgacaacgagacagaagaacagcgccaagcccaagaagcagaagaacagcgcgtgcgacaagaagccgaacgtcgccgactagaggaggaacgctaagcacaagagcgagaacgattgcagcgtgagcaacaggagcgcgaacgggctgcaaaggaggctgaggaccggcgacagcgtgccttggaggccgagcgacgagcacgagagctcatcgggcaacaagacgttgaggggacggcggtttttcgcaccccctagcagaacgcggctgcaccgatcactcttctcgacaccctcctcaaggaagacgcactcaatcaagccaatcacgtcgtcaacatcttgaaccagaccaagaccatgatcaccgcttcggttccagtaaactgtcacagcctgaattttgtttcaggatttataagttatctaataaattattaatagaatttatattaaatgttctttaattaacaagtgaagttaaatgtgggaaataaaatttcctaaatataaatcatggttggatttaatttttattaaattctccatgattaattatactctctgaaattttctcggatttttcagagctcaattcctaaatgatacaaagaacagttcagtaattatttaatcattaatgatctaattataattatgttaagtgcttttcttgtttaaaaatccttaatttataaattgttgtctaaaagggaattattagaaatgatcttaaaagcctagaagagaagatctaattttaatttgttaaattccaatataaaagtgggctagataaaattttattaaatactttacttgattctatagttcctagatttttctggggtttatttgagccaaggaagtatttttaataaatggaattgcatttcatgaataatttaaatggaaaaaggtttttaaaagtcccttttggttttgggccgaaagccggcccaaaccgctctctctctctctctccctcggcccaagtcagcccaagccgagccgcccgcgcgcgtgcgtgcgaccgccgctgacaggtgggtcccacccgtcagtcgtcgtcttcctctcgccgaaaccctagccgagctgcgccgccgccgccattccaaatccggccatccctttccgtttccggtgaaattgattgaggggaaaggatccccgtgatccactctaccttttcccttttggaaacatcgtctaaatcgctttggaaatcgccggatttgagttcgattcggatcgatttgtctcctccgaaccctaaaccttccttcccgtcaccggtcgccgtgggccttcgccgccgctccctagaccctataaattgaccccccaagctcccctatacctgccgccaccctcgccttagcctctcgtcgccggtagagctctagcgccgtgccgcctcgcgccgccgtcgccgccgccactccagcagtgcgccgccatcgctccagtcgtcgtcgtcgctcggggaggtcaccgccgtggtcgccgtcgcgtcgccgtcctcgtccgccctttcgccgtcgctgtcagccgccggagcaccgtcgccgccgttgacccgatcgtcgccgccgctcttcctcgtcgctgtcgtcgtccgttgatcttccgccgtcgttttggtcaccagtgagttcgccgtgccgtccgctacgcgtaggtgtcctccgtttgcgccgccgcgccgtcgttcgccggcgagcacgcgaggccgagccgtcgccggtgatgacgtcatcgccgacgtcatcgttgcagtccgccatggtccggttgtggaccgatggatcttggccgtccgttttggatggatgaatctcggccgtccgttttcgtgaaccgtcgccatgcactcggtcctccgtcaactgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgcccaaccacactctcaaagaaccaacctacgcaacctaaactcgaggatcaggagcacggattgggtgccgatgacgcggccgcttctgtaatctccgcgaaggaaaacacaagagaaaaggggtagagaatctctctctggggtttgttagcacacagctgaacaaagggttccgaattggattatcaaaagtctgagtttgcaatggtcttaggggttatttacactagcaacagccctgctagataggtgtgaattcgagatggaaatgaaaagactaaaaatgtgaaagggcctccacgaaatggcttctgaagtgggttcgcgaggctgttggtcttctggagtggtgttcagtaatttggcaataactccaacttgggaagtccaaatgatgcaccgtcagttgcgttggaaagttaacttcactatgttttgaaccatgtatacatgcaccacgaaacattgtagattggtacagttttgaacatgaacttgtaccaacgtgctgactcagcagactcctggccttcagagcagtcttcacaaacgtacttggttctcattggtgtgaagtccaaagtacttggtattggtggcattggaaagctgacttgataagctttccaaagagtcctcatttacttccatagcttctgtaaattgagagttatgagcagttctttgaactggtccgttttgcactgcagttggtccgttttgcttcactggtccgttctgtactccagtgatagaatccaccgatccactttcatcctcctcatgttgtatgttcctaagcacaactaaagtagaacacttaggtagtataacattctcagaagtactgaaattaaaatcagttaggaatgaattcacctgaacttgtagtttcttggcacgacttcttgtaagtggaccttgaattgtatcctttgtgtttgatgatggttgcttggtacttgaagtagcatgcacggttgggatgtcctcatcatcctccccctcttgaaaaggagtcgacctcgacgactctgaatcttctagtccaaagaatggtgttaagtcagcaacattgaaggttgaactaacaccataatcttcaggtagctcaatcttgtaagcattgtcattgatcttggacagcactctgaatggtccatctcctcgtggcatcaacttggatttgcgcttctgtgggaagcggtctttgcgaagatgtacccaaaccaaatctccaggctcaaatgtcaccttcttgcgattcttgtttgcccatgcagcatagtacttggacctcttctcaattgcttctttggtcttctcatgaatcttcttaacgtaagttgcacgcttggacgcttccatgtcactcctttcctgcaatggtagaggcaacaaatcgatgggagaaagtggtttgaaaccatatacaacttcaaatggacacatgttagttgtagagtgtactgccctgttgtaagcgaattccacgtgtggcaagcactcttcccattccttcaggttcttctttatcaaggctcgcagcagcatagagagtgttctattcacaacttcagtttgcccatccgtttgagggtggcaagtggtggaaaacagcagccttgttccaagctttgcccataaggtcttccaaaaatagctcaaaaacttggtgtcacgatctgaaacaatcgtcttgggcatgccatgcaacctcacaatttcactgaaaaatagagaagctatgtgggaagcatcatcgcttttatgacaaggtataaagtgtgccattttagagaatcgatcaacaacaacaaaaatcgaatccctccccctctttgtcctaggtaatcccaaaacaaaatccatgctaatatcttcccaaggagcactaggaacaggtaagggagtatataatccatgagggttcagttttgacttagctttgtgacaggtgacacatctttgcacaagtcgttgaacatctcttctcatcttaggccaatagaagtgatcagctagcatgtcataagtctttctccatccaaagtggcccatcagtccacctgcatgtgtttcctgtaataacaagagtctaacagagcaatgtggaacacacaatttgttagctctaaacaaaaatccatcatgtatatgatatttttcccatccttttccag

SEQ ID NO: 64125 - DNA, 1214 bp, Oryza sativa
ggcaagttcttagtttcaagttgagatgcattggtttcaatctccaacaaggaagtaagttctatcaacttcacttgtatcggcatgactagaacattctcgattaagtcatattttttttttgggttgacgcaagcattacctatctaatacattgattttatctttaactgcatagctatttatagttgaatcgacttagttaggactttctcggttaggtccgatattctgattaagttgatatttctctaatcataccgttgttttagataaatttgttatatccatcatgtttgtgcatatttatcggctaaatagtttttttgattattttcttcaatcttatactgtctcggttaggtttaatctaatagatggctgctaataagtaattctactaagccaataggttttatgctgtgtttttatcagagttctagccgatgtgttatcttgttactaattctcagtgttgtattgtcttatactcaaacttgtataatcaatagttaaatttctctttatcatcttcgatcttatattgtctcgattaggtctaatctatcaagattgttttaataaggagtggtttattgatgattatgcatatgtttagttctagccgatgatagcatatatctcattgtttatccgattatctgaatctacatcgagcatatagccgattgatcaaaaccctattgacatcggcaagcctcgctacatcacattggcctattggttagatgtatcttgttagttgtaggatcaaatgaactaaaatgccctttgatcttgttagttgtaggatcacattggccctatgatcttatacaatccatttatctattttgttggttgtaggatcaaactaactaaaacgccacgtacacgaatgataggacgagctatgcagatctctcatgacttcatgtacgacgaattccatgtcaacatgttgtcatgtggttccatctaaaccctggattgaatcggtctgggccgtcggattttggtcaactcttggttatgatttaatctaggttttccatctcagtgaacccgtggactacctctgtggacctagtctacggtggactgattgccgatgacatcataatttatctttgtcttctttaaagtagttataatttatgtaataaatctatttaatccttttaaataggctttaattggattaaatcttgtaa

SEQ ID NO: 64126 - DNA, 2390 bp, Oryza sativa
atatttacgaagtaggaggacccgagccctcctatcgagacccacacacactaaaccacccggagagcttagctgcctaggcttgccgtcccacaaacgagcttttgaaggccagaagctcctgcaacactccaaggatgactctcattttctaccacttgcaagatcgtcacaactctaggattggcgccattgaaaacatagtcattgcggtacttccaaatcttccaagccactagggtcaccaaagagttaatccccattcgcaccttcttcggccgattcttggtcgcttggctccaccaccttagaaagcggtcggtagagggctaaggcgctacctcggctaaccccagcctcaagaagattgccgtccaaacttggcgagaaaagacacatgagatcaaaatgtgttggatggattcttgacttagatcacaatggggacagctcaccgagtgctgcagcccacgcctagccaattgatcagctttccaacacctatcattgatagccaaccaaatgaagaatttgcatcggaggtgaccccaacacttccaaatacacttccaacacctattaaataatttataaatccctgaaacgaaatcaggcactacaccatggcatcagattaccaacagacatctgttggtaaaaataaacaatcattgatagactgtatgttagtaaaagcttttggcaaaccatatgtcagcaatactcatatgtcagcaatactatgtaacaagatatgttatatgttggcctttgctgacatatctgtagcaggctaccttgtgacatggtgtagtgagggtgtggcactactaaagagtcttgctactaaagttacgctattgatcaaggctttgcacaaaatataacttccatggctctctttgtgaacaccagcaaatgcttgtcagctattcagcatcatttttgtgttggctaattgttctagtttatttttatgttcttttcaggaactttcggaataattacttgactggtcccattccaccattcatcgggaaatttacttcaatgcaatacttgtatgagttactgctcgttctagatcatgttccatctattggtcattattttttgttaattattgttaatcatctcaaggtcattatctttgaatccactatctggactacttccaaaggaactaggaaacctcaccaatcttgtttcattgtaagaaatcttttctcacacgtggattaatcttcaactgctccctctgctacgaactactcatgcttgtagctttaaccgtcaattccagcacttttcgtatatatatagttgaacattttccaccctcctccatttgaaaaacaacttatgattatgaatgcgcatagcttatgtctagattgtaagctagaagtgcttttttttatggagggagtacgaattatacattatgaaattatttctcatgttgaatctaaatgttaaactatacaaatttgtaaaaatggatatttaggaatacaaatgtttgacttacaacaaaagcagaatgacagatagtatgaaacgaatggagcatatatttggactgcatgaactgatataataatacaagaaatagcaatcacataagttctaataaaaaaatcaaaactactactaaataggatgtaataggcatgtcagtgtaactcctgttcatgtggtttttcagatgatcaagtaagattaaacagcaaggacttgaacatattgtaatgatgaatattgtgggtccaatagcacatcgggaaaactatgcccttttgctattagatgatgacaaacattttaaatcacttctgaaatatttcatttttcttttaggggcattggctcaaacaattttacaggaggccttcctgaagaactgggtaacttgaccaaacttcagcgattgtaagatacccccattgatttctagcttcttatttctacttgtaaaagaactaaatttggaatggccatatctattgtcgaacatgataatatttcaaactttcaacaacaggtacattgatagttctggattcagtggtccgttcccttcatcgttctcaaaacttcagaacctgaatacattgtattgtcaaaaacatagccacagctattatatttgtcatgttttcaagctaagtgatattttggtctgcttgcaggaaagcatcagataatggattcaatgggaaaatacctgaatatttgggcacaataactaatttggtagaaatgtaagcttcttaacatatcatttgttcttactgttcagagatagatgaatctgtgcaagataaattactgtctgtatatcacattgtctccattcagacttaaacaatagcatttttgggctgcag

SEQ ID NO: 64127 - DNA, 2855 bp, Oryza sativa
  unsure (1)..(2855): unsure at all n locations
acaatacgctgaatgttgcggtgcagtcctgacataaaacgtgcaattgattgctcttcatcttcataaacattggctctaatcattgccttctccatctctttataatattcatcaacactgaggcttccttgcttcaaattctgcagcttgtcaaaaagatcacggcgataatgtttagggacaaatcttgccctcatttctctcttcatttcagcccatgaacgcacatcgccttggccagcttcttctctttcatttagcatttgctcccaccagattagagcatagccatcaaactctagagcagccatggcaactttcttccgctcagaataattatgcaaacgaaagattttatccaccttcaactcccatgtaagatagacttcaggatcagatcctccttcaaacttgggcatggtgaattttaatttgccaaatctctcttcattgggctgatttcgcccacgatttcctcggtgacgacgatcatcacgatgaggctgttcaacctcttcgtcagtcccactttcttctagtccatgttctcttccacgatcagcacctctaccaccatttccacgaccaggatgtggaggtcttcttgcatttgcaacaacacgatctctccgtcttcttcgttgttctcttgcaaggcgagcagcagcttctccttcggattcttcatcttcttctccatggtgacttgcatttgcatcttcaggaggaggctctggcaatcgattcataagtgcttgaacattggctgttagtgcctccatgctttgcttcatctcattgaattgtgccatggtgacacaatcctcaatctcaacattagaacccatcttcctgtcaagttagtgatggcttgcaacaaatatttgtggaatatgtggaataggaaaatatatgtgcaatcacacaacctcacctctctaccgaagctcaagtgagttccctgcagattacagaggaccaatgcgaggtggtaacttgagaatgatggttgggagaatgcaagatcagcgttcctatgacggtggattacttgtggagcttggtggggatatattttacaaggaatgcaatctgaattctcgctattgtaaagttaaatcacagtccaaaatgcttagtgctgaccacaagatatgaataacgtaaatagatcaaacacacacgcaaagataattcagttttgatgcaaacaaggagtatgcttaggatgcaagtgttgcaatcagacctaagcaaaattttgcaccaaaagatagataacaaactgattgtgcaacttgatataaaattcagaacatgtgcacataaacaaactgatctttcaacttttctttctcaaactttcctcaactctttttcttctctctttttttttgtaacttttctttcttctctttttttttgataaacttttttttatatatataactaagaacaagaacagatatgaaacttatacacttttctttttgtagaaacaagacacgaccgtcagcgttctaacttgataggatcaaagtttacgcgaaggatgataccggtttctgaatttttttttatatatatggatttgcagatgtatgaaagaagctcaaaggacacgcaaaggagaatatgatcagcaactaaaacaagactctaatggactgaaaattaactaaactcacaagaataacagattgaaacaaagggctatagcagaatatttttatggctttttcagtggataggacgaacacaaatatatatgtagctaagggtaaaaatcctaccgttgcaaccgaggctctgataccagatgatgaggttgttgtcccgatcttcacgacgtaagattgatcttgataactagccgaagaacgaccgataacttgctgcaagcagcgataattagtgcaacctgacgacacgcacaaggagccaaccaccgtctctatacggcagcctgaaccaaggattcgaccaaccacactctcaaagaaccaacctacgcaacctaaactcagaggatcaagagcgcggattgggtgccgatgacgcggacggttctgtaatctgcgcgaaggaaaacacatgagaaaaggggtagagaatctctctctggggtttgttagcacacagctgaacaaagggttccgaataggattatcaaaagtctgagtttgcaatggtcttaggggttatttacactaccaacagccctgctagataggggtgaattccagatggaaatgaaaagactaaaaatgtgaaagggcctccacgaaatggcttctgaagtgggttcgcgaggctgttggtcttctggagtggtgttcagtaatttggcaataactccaacttgggaagtccaaatgatgcaccgtcagttgcgttggaaagttaacttcactatgttttgaaccatgtatacatgcaccacgaaacattgtagattggtacagttttgaacatgaacttgtaccaacgtgctgactcagcagactcctggccttcagagcagtcttcacaaacgtacttggttctcattggtgtgaagtccaaagtacttggtattggtggcattggaaagctgacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64128 - DNA, 2468 bp, Oryza sativa
atgcatctcgactcggtttgggttgtgtgttgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagaggtgtatacggatcataaaagtttgaagtacattttcactcaacctgatttgaacatgcgtcagcgaagatggttagagttgattaaagattatgatatggaaatctactatcacccggggaaagcaaatgttgtagccgatgctcttagcaggaaaagctactgtaatatgtcagaaggtcgacgtttaccttgggagttatgccaagaatttgaaaagttgaacttgggaatagtcagcaatggttttgtggccgctttggaagctaaacctactctgtttgatcaagttagagaggctcaagtgaatgatcctgatatccaagaaataaagaagaacatgagaagaggaaaagccatcggttatgtagaagatgagcaaggtactgtgtggttgggagaaagaatttgcgtcccagaaaataaggagttgaaggataccatcatgaaagaagctcatgaaactttgtattccattcaccctggaagcactaagatgtaccaagacctaaagcaacaattctggtgggccagtatgcgacgtgagatagcagaatatgtggctctatgtgatgtatgtcagcgggtcaaggcagaacatcagaagccagccggtctgttacaaccgttgaagattccagagtggaagtgggaagaaataggaatggattttataaccggcctacccagaacgtcggcaggacatgattctatttgggtagtggttgataggttgacaaaagtcgctcacttcataccggtcaaaacaacctacacggggaataagcttgcagagttatacatggccagagtggtatgtttgcatggcgttcctaagaagatagtgtcagatagaggtagctagtttacttcgaagttttggcagaaattacaagtagagatgggtacccgtttgaatttcagtaccgcttatcacccgcaaacagatggtcagacggaaagagtaaaccaaattttagaagatatgttgagagcctgtgttctagattttggtggaagttgggataagaatttgccgtacgcggaattctcatataacaacagttatcaagctagtatgcaaatggctccgtatgaagcattatatggccgaaagtgccgtacgccgctcctttgggatcaaaccggtgaacgtcaagtttttgggacggacatattgcgagaggcagaagaaaaagtgaagattatccaagaaaggttgcgcgttgctcagtcacgtcagaagagctatgccgacaatcgtcgcagagatttggctttcgaagaaggagattatgtataccttcgggttacgccgttacgaggtgttcatcgtttccagaccaaagagaaattggcaccgcgtttcgtgggaccttttaagattgtgagtcgaagaggtgaggtagcttatcagttggaattgcctccgtcaatggcgggaatacatgacgtgttccacgtgtctcagttgaagaaatgtttacgtgtacctacggaggaagcagatcctgatcgtatagagcttcaagaagatttaacttatgttgagaagccagtcagaatcttggaagtaagcgagaggaataccaggaatcgtgttatacggttctgcaaggttcagtggagcaatcattcagaagaagaagccacttgggagcgagaagatgaattgaagtcagctcatcctcatctcttcgccagttcttctgaatctcgaggacgagattccgtttaaggggggtaggtttgtcacgccctaaaaatcgcctaaattaaaaatacattgtttaaatcatttttagaaattaaaattaaaagcctacaagctaaaccctaattgtctaggaaaattttcaacgtaaaattgagctagataaaattttattaaatactttgattgttcctctattttctagaattttctgggaattatttgagcaagggaagtatttttaataaatgaaacaacatttcacaaattatatttaattaaaaagttctgaaacccctccctaaagccgttgggccgtttttggcccaacatccttcccctctcccgcggctgagccggcccaaaaccggtccaacccgtcgccgccgccccctcctctcgggagaccgacatgtgggccccacatgtcggatccttccccttcctctagcagccggccgagccgtgcatgacgagcccgagccgccaccttgcgccctcaaatccgccccaatccggccaccccgagtccggatattagaggggttttaatccccgtatcctcctctatctttaccc

SEQ ID NO: 64129 - DNA, 1483 bp, Oryza sativa
tgctcattcttgcaatattcaatcatcagaagaggagtatctcagtgaaggtgatgatctggaggattaggcttgttctggttaagttgcctgtggagtggagtcgccatagctgttccgtagtttgttatagatttattttttttcgctgcgtagaaggatattctttgagaggaactatctacctctgtaatattttattatttgcgaatattctatagttgttcatttgtactctattatcaatttgttattgtgtgcctcggttgattcctggacgagggtttaacacacatgtaagcgtttggaattttggatagaaattccgggcgtgacagattggtacttggtttgttccgaagcctggggttggcacttgctgccgaacggttggcacctgagcagtgttgccgaagtcgaactgctgtcattgactccacggcgaaggtcccgagcctggctgaattggtggcaacccattgggcgctccttgacttgtattccctaccgggtgagccgatggggttgtgcttgaaatgtagtggggttggttgagttgctaaaggaaagcttggagttgcgcctgcagagccgaagcccattccaccactggttgtggcgcttggccaggtggttgatgctgcccggcgaagtacaccggcggctgtgcggctagtggcggagagggctaggtcaccacttgcggccggacttgaggtggggcatagcctgccgaatactgaaggattggagccgacgtggccttggtcggccttgtcgcctcgtatgcttgttgttgttcttgcatttggcgaagcatgtcttggagccgtgtcatattctgccgcatggcttccatgtcggcttcggcttgcgcttcggggtccaggctgatttgggcctatacaacggcgagcgcagttggtgccgccggctgtgatggggcggcttgaggcaccaccagttggtttgtcgaaaggatctctgccctggtctggagtgcccttgccgccgcagccgccttcgccacgtcggccttgttcggcacttgcactgaggttgcggaggccgaagacggttgtgatggcgcgggggccgaaggcggctgtgatggcgcttgtccttctccatcttcggccacagacgccgaaggctctgctccttcctcggcggccatgtccggtccggcgtcgctctccttccgcctgacaaccttctccttcacgaccctcttcgtggcattcgctctcagtggtttcgctcggagtccccacggtcggcgccagctgttgtcgaaacaacaactgtatacgtcgaaggacgtggttactcaacagtggttgggaaaatgaagtgtactaaatttttaatttcacttgggatcccccgttacatagccctagggggctatttatagccctattgcaggctctttctactaggatctaggttgtacaggggaatttatataattacccttata

SEQ ID NO: 64130 - DNA, 1651 bp, Oryza sativa
gaggtgtatgttcaattccatcacaatccaaccattccacagtgtccaaatgatatgagaattcccaaagtctaaagttataaaaccacctaatgttgcctaattagtcagcgaagcatctacctagattcatactagtggaactgttaatagagtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaaacaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagtcacaccggagatgcataattaatgcaagggggtacaaggggataataatataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctaggcttgcccataaccgagggcgcggctattcgaatagattatactctaatcagaggtgtacatctttacccacaagacacatcttcctcacgtgtaaccacgtgccacataccaccacggtatacggacggaagacgtgacatagttcccaacccatcctagccataaacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggtcggggtgctacttcccacaactggcatgcacccaaaccccaccgaaaacaggttttaggggttttgaaagaggaagagaggtgtatgtccaattccaccataaaccaacaattccatagtgtccaagcgatacgaatattcccaaggtatagcgttatcaaaccacctaatgttgcctacttaatccgccaagcatctacctaaactcatactagtgggtactctatgtcacgtcctgataaattcatcccgaaattaaaaatcattttctaaaaggaataatagaattaattaaaatttgaaaagaaattggcaaacactaaaatacgtacaagaaaaattcgaatgggtccggagaatttttgttaaattctcgggctgcaggaat

SEQ ID NO: 64131 - DNA, 2763 bp, Oryza sativa
aatgagaaatgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactagtacatactgatgtatgtggaccaatgagctcaactgccagatgtggttttgggtactttattacctttaccgatgactttagtagatatggttatatctacttaatgaggcataagtctgagtcctttgaaaagttcaaggaatttcagaatgaggtacaaaatcatttgggcaagacaatcaagtatctacgatctgatcttagtggagagtacttgagccttgaattctgcaatcatctaaaggagtgtgaaattgttccacaactcactccaccaggaacgcctcagtggaatggggtgtctgaacggaggaatcgtacattgttggacatggtgcgatcaatgatgagccaaactgatctgccgctaagcttttgggattacgctctagggacagctgcgttcacactaaatagggttccatcaaaatcagtggataagacactatatgagatatggactgggaagcgtcccagtttgtctttcctaaagatttggggttgtgaggtctatgtaaaacgtttgcaatcggacaaactcacacctaaatcagataaataattctttgtggggtatcctatggaaacgaaaggatattatttttataattgggaagagggcaaagtgtttgtcgcccgacacagtgttttcttggaaaaagagtttatttcacgaaaggatagtgggagcatggtgcgatttgaagaaattcagataacaccggaaaacgcttcaacgtccacacaaccacaagctaagcaagatgttgttcaataggttgaacaagttgttgttgaaccagttgtggaagcaccggcttcacgaaggtccgtaaggatacggcgtacacttgcgaggtatgcgttgttaactacaggtaacgtgatatattgttgttagacaacgatgaacctactacctatgaggaagcaatggtgggaccagactctgagaaatggcttggagccataaaatctgaaatagaatctatgcatgtcaattaagtttggaacttggttgatccacttgatggtgtaaaagccattgagtgcaaatgggtctttaagaaaaagacagatgaagatggaaatgttcacatctacaaggaacgattggtggcggaaggtttcagacaaattcaaggtgttgattatgataaaactttctcgccagtcgccatgctagaatctattcggattgttttagcgattcctgcctatttcgattatgagatatttcaaatggatgtcaaaacagctttcctcaatggaaatctcgatgaggatgtgtacatggcacaacccaagggatttgttgatccacaatcagctaaaaatatatgcaaattgcagaaatccatttatgggttgaagcaagcatctcggagttggaatattcgttttgacgaagtagtcaagacgttgggctttgtcaaaaatgaagaagagccttgtgtatacaagaagattagtgggagtgcactggtgtttctaatcctatatgtagatgacatattattgattgggaatgatattcctatgcttgaatccgttaagacatcgttgaaaaatagtttttcaatgaaagacttaggggaagcagcatatattctgggcataaggatctattgagatagatcaaagaggctaattggattaagccagagtacatacattgacaaagtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccattatgtatgctatgctatgtacacgtccagatgtttcatatgcacttagtgcaacaagctgataccaattagatccaggtgagagtcactggatagctgtaaagaatatcctgaagtacttgagaagaactaaggatttgttcctagtctatggaggacaggaagagctcgttctaaatggttacactgacgcaagcttccaaaccgacaaagatgcgtgcgcacgtcttctgaattggtaagcaatgcgtttttttttcagaaaaaaaacattctacaagaaagttgctttaaaaattatattaatttatttttcaagttttttagctaatattgagggcatggtagagctccaactccttaatttagctccaggagatgggattggagttgtgttgtggagaagtttaaacctagctccacctctctagttcattttatgagaacgctctacccagctccgttcctattttaggtgaagttgaaactgtttggctagactctagctctaagagaggtagagttggagctgtgccaaacagatcttgatttaatcatgagctaatgaattgctccgtttcatgtgcaagggggagaagtacccaaccggaacattcaagcttagcctaaggctgagtttaggaggtggacttagaaactccacatccccgcacagaaaatggtattgcccattaacgcttaattaattaagtatgagtctaaaatacttcaaacatagattaatatgatttttaaagtaactttctatagaaaact

SEQ ID NO: 64132 - DNA, 1282 bp, Oryza sativa
aaaaagagatacgagtttgggaaagaaggggaaagaacacagccgaagcagggttcgtgcaacctcctcaaccatagtactaaatttacaattttgcattatctgtgcgaaacaatagcacgattttcttaaaaaaaagaaaagcgtaacatcatgcttacattctattacaccacctaccttggaataaaattccttttgcaaccatgccaggacaaaatttctgtgacaaaaacagcacaagccactcgcgaggccgtcggcaaagctccacgtatacatgcatgcggtggcttgatggcgaagtgatggagccaagtccagcatcatgtcgatccaacgtgtcaactccaaaaaaactttaaaaaaccggtccagcgggaacgcgcagcgcaaacgaacgaggctgccgcgtgggccccactcccgtggacccggtccgcgcgcccctccccctcggctgatgtaataaatcctttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagctcttttcttttacgttggtcgtgtagacgctgcagcttctgaagatccgctcttcgtggaggttgaagccgacgtttgggaaagtgagcaaggcaagtcacatcatccttgaacatattggatcccattttataaaattattttgatttaaattattgcattatcgctttacttaaattcccgcgttatcattgttttatttagcgatgcctatttacctttgttatgaccttattattattgttattgatattattaccttgttcaccctagattaaacaaaaccccaactagtggacactctactcatggtaccactagtatgaatttaggtagatgcttcgctggttaattaggcaacattaggtggttttacaactctagactttgggaatattctcatcatctggacactatggaatggatggattattgtggaattggattcacacctccccctctattcaaaatcctcaaaatggttttaggctaggcttggggtgcatggttttgatagtagcacctcggccatataaggaccggtcttcgggcctctgttgcaaagcactaccgtacttccacatgtctagtgggtaaggcttagtttgtggct

SEQ ID NO: 64133 - DNA, 1345 bp, Oryza sativa
tcgtcctttctctccgccgtcgccgccgagctccggttcgccgccgtcgtcgccccggacctcctcccgcttcggcatcgcctccttcggcttcgccgcgtcctcgccgacctcgtccgctcctccgtttcgcccgccgaccgtcggagcgccgccgtcctcgtcgatccgaaccgcgccgccgccttcctccgctccggtcgtcgtttccgccgtcttcgtcgtcccggggtgagccgaggaccgccgcttcgcttccctcttctctcctctctctcgggcgccgctccgccgcgccggtggtcgccggcggtgaccatcggggcgcgggcgcgccgcctcccatcggccgtgccggcgaggccgccttcgggcgcgccccgcggctgccaggtggggcccggccgtcagccgcccgcgcccgcgggtgcggctgacgcgtgggacccacggcgccggtcggcgccagcagcgtgcaccaggtccaccgtggaccgtgaggctgccgcgtgggccccactcccgtggacccggtccgcgcacccctcccctcggctgacgcaataaatccgatttttaattaaaatttaaatgaagaaattcgcaaatatccatttaaagagcatataaacttcaaatggctataacttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcacctcggccactataaagattaagctcgggcctctgttggaaagcactaccgtac

SEQ ID NO: 64134 - DNA, 1414 bp, Oryza sativa
caaaatacccaacttatacagggcgtatccgcaaaatctgcttaccttccccagtttcccccaaccaacagaccatgatggcatcgtcttcttgaacaagcacacaaatcggtagctccaaccaccactgaatcagcattcacatcactcacgtggtcaacacttttattgcagtcttcccaaattttgtgtcctttgctaatagtatctgttccatggggttggcttcctcatgttcttgtatcttagcagctgctgtcgctagcttcattgtccttagagatgacgtgcactaacattcttttttttttctttgcgtgaccagcggaagcatttggtctgccgttcgtgccgccgtacctggctggcggcgacttccggcaaggcgcaaatttcgcggtcggcggcgccaccgccctcaacggatcattcttccgggaccgcggcgtggagccgacatggacgccgcactccctcgatgagcagatgcagtggttcaagaagctactcactactgtctcctcgtcagagtccggtacgtcaccctcctgagacctggagttctttgctgttgctactagtatgtcggataagctgatcgatgcatgagccgttattaaccgtgttagtagacgccaaggaaacatgtgagcgtggcatcacagcatgccagtggatacagtaaatagtgtccaaacatgctgaaaaccgtgcagatgagctggccacctactggccagaatggttgttcagtacgagcaaattgctgcatttagtagagtggctcctttccctgtttgcaacttgcaagcaagcactttgtttttagttggcttgtaagctaaagttcactagttaaatggcaccgcaaaactgctacttggagccttctgattaggtgaaaacattctgtgtccttatatgtgatgagatagccggctgtgcaaatattgtaggatatttgtggaaccatgtttaaccagcaggctggtttgacaggttttaaccagcagcaacatgttagaaaatctttactgggttgtcaaagcaaaatcatctcgtctaactgttctagagtggcactgaattacatgcatggttgagacataaaagccaagtccataattccaaaatcgatgaagtacacatagtggaactcaaaagccaattataatactttctcagcatcttgatactatgcatacaaaatattatgaacgaaccaccttacaacaacatacggggggtttcatttttggtttctcctcacaagtcacaagttgattccaaaatacctgtgcgtttcatttttctgatgtcacaagtttaaaaacctaaatctcgagctacatgtccgctaaattattgtctattctctgtgcagaactcaatgatatcatgaccaagtcacttt

SEQ ID NO: 64135 - DNA, 7587 bp, Oryza sativa
tacagttttgcaggagctcataaacttggagcaaagaaactagttgttccaggaaactttccaataggctgtgtaccattgtatctctcaatctttccaagccaaaaggaagactactatgatgagaaaacagggtgcattaaatggttaaatgaattcaccgagtaccataatcgattgcttcaggaggagctggagaagctcaggaatctttaccccgatgtatccatcatttatgctgattattatggtgctgcattgaatatattccttgccccactccagtttggtgagttccaccttccaactaaaaaattattaacacagagagcacattttataagtggtaagaatatttgagatttagttataggtcaagcataccttagtcaatttacatgagccttcaaaacttccaagcgtacctggcctgcattacattcatttcgtgaataaacttcaattaggaagaagctgatggttatagtcaacatggatctgatagtatatgctaaaacctgtcagtatttactggatatagcctgtattggccctccatgatatacaaagctctctgacttcgatgagcttctatagacttgatgagtccatgagccaattaaaatttattctattaaattttgctaaaactgttaacatggctagcatatatcatatgaactttatgtatccatattgattctcaatgttctaaaagttacctcatgtccacaaagacatgttttggtgacagatggagtaacttgttgactttaggtataagtaactaatggtctgtaaagttggtatattcttgtgctatattttttattagtaacactatatgatcttagataattcagataggcgaaaataggtattcttttacctatgctactgaataagttgcagaaacctatttcgtgctccactgttcttgatcttattgtgaccttgatgatgcagcacagtctgcaccccaccagcagggatctaaactagccttgcacttatcttcatatgcataggcattcttaaacatggtcgaggtagtttttaatcatctgaagtgttaaataactactggcgattaatcgaaatcagagcttgaagatgcttaacctatccacgtaacacatacagaagccaatgtttacaacataaggttcactagtcgcattcatagcataaggcccagcatttgatacaaagtcaacaaactcgtcggcccccccccccccttttctctattttcaaactgaccacttttaccagatggaagagaagtataagcagaaatagaaacacaggaaactatgtattccgcataaaacttttggttattgacaaaaatggggctaagaaaggttttgtgctattgcaggtttcactgtcccgctgaactcgtgttgtggaagtgatgctccatacaattgttctccgtcaatattgtgcgggcaccctgggtctgtggtctgctctgacccatcaaagtacacttcatgggatggtctccacttcacggaggcaacctacaagattatcattcaaggggtgctagggtcatatgccaaccctcctctttcagaaacttgtcggggtggagcatacaaagtctcacaacttcatcaatgtacagataacccaacaaacactgtaacgtatgattctatgagctcttttatttgatcctctgagctctagggcatgtagagtattaaggagcaatatagatataacaggccccatccccttggacacttctcaaaggtgagaagagcattggttggggatctttgtacttctcaaatccatttttctgctacaggtagaaaagagattttgtagagcagaaatttgcaattgccatgtccatggctttgcccaacccatttagtttctcagaaatttactgcaacgggaaacagaaagtacaccgtatagtttttcttttagtatggtcaggttgccatgctatatagtatactctatataggaaacaaggttcatgattcatctccaaaaggacaatgtattcagtactgtaggcctaatttccttacaacaaaagcgtatacttgatgcttgcttgttcagcagtctgctgtatatgatcaccctgcaatgttcagttccatatctgaaattggtcctcctgtcttctaagagattgggcctgttcggaggaattttagattatggtaaaatgataagcagctagtgaatctgtagaaattgggaaaattggattctgtcttctaattcattttctagattctataagcttagcttctcagaatctgaatgagaagtagactgtttgaagaagttctgattccgagagaagctaaagctgtcagacgagcacatgaatcaactctgaatgtttggcaactaacaatgtccaaagtcaggctccatggagcaattctggcacggttaatttcatcattttgaccaattagttgccaaatattccgagtaggttcatctgttggtgtcatgttgatcaggaacaggaaactgtctcatactcgtactacctagcaacagaatgaaccattcaagaggatccatgtcggccaaaccaatgaacatgcagttccaaacttcacacaaccaggtcaggtggcacctggtattgttcagatacttcgttcctgacatgtcattacatgattcaccctgacacccgacttcttttatttatagtaatcaataatccttcaattaaatgaatagtaattagaggcaacaaattaggaaaatgggcaggacgataccactttctggtattgtcgacggcgtccaaggtctggtcagtgtccactttctggtttcacaaacggaattggaagccttgtctctggtccaccgcgccaatctcctcatggctgcggcccacgggccgccgctctcagctgctcctcacgacagctcccgtggatgatttcttttttttttcagaaataaatacaacttcaatgaaaaattggcaaaatagatgttagttgactgaaattacctatcgaacaacggttgtttgatagggttagcacagtaaaaaaaaaaggagaaattgggatgcgtgcgtatacatatgagtagaccgaaaaggctaacagacgatcgattgcccctagcgatcacgtccccttctccacgtggtttctttttttttttggcaccgattacttttctatttttgtaaatttatgcacctaaagtttgtacacctcaagtttaaacatctaaagtttagagacccaaagtttataagtcaaaagtttatatatctgattcaaatttgaatttgaattcaaatattttttatatatagtacttttatacacctaaaatttatagatctaaaatttgtaagtcaaaagtttacatacctaattcaaatttaaatttgaattcaaatattagtttatagacccaaagtttataagtcaagaatttacatacccgttttaaatttgaatttaaattcaaatattttttatatatagtatttctatacataaattttttcagctttgtttttttattttttttaaaatttatggtgtagcagaaagagaaggagaggagcgtattggggggggggggggggggtgggggtgatcactgtgggcaatcatccgcccattagccacgccctgagtagactgctacatgtgagcaacacctatcgaattttgggagttcgatttatggaactttggggtttcgatagtccacctgcatgcttgctcttttcgtttttttttaatcaagtcaattcccatgcatgctctttttgataggatatgtcaagctacggctgtttggcagggtgctaaatttgtgatttcagtcgaccaacatttattttgcaattttctattaaagttgtattatttctaattttttcccctcatctatcctccgccgccgcgaggcgcgtccacgcgtgtccacctctcgtcatcaccagaccagctttactatggaaacatgtataatgccacatatgtaatggaaatgtacgtttgctgcatatcaatgtcaccgtaaataaaacttttacaatagtaataaagtttcattataagttttcctcatacatgaagtaaaagtttactcatactgacgtgaataaatctcatctaattttacatcctatggtccactatatatttttcctactgactgacagatctgtcgtcttcattcagattggcagatccctcgtctgcaatttagattcagctacttttgtgcttcattgggatttctagaatccttatatgtccgtcttcatatacaatgtctttgtcgtagatcgtaatgtctcgcaactatggtttttaggtagaaaattcgttctgttataaaacttgttcggattgttgatctgagccggtttagtctttaccgtttactatgatacatttatgtttcggaattgctaaccatcatttggtagaattttagggtgaattttctgtctaattctccatcattggatccacaccatgattcgtgttccaatccttcttctctagctctagcacaactccgacgagatggccacaacctgactagttagagtttcgggattgaggtttgggttggaaggggggagggagagggggagagttccccggtcttagagggatgaccgtggcccgtggaggcaacatcccaacagtgggcggtggaatgggtgagcggggaaggtggcgtcaccgttgccgctgaagccacgggggcaggagagggcggttgactggtgttggtagcgggagcaaagctaggagggggcagaggtggcgtctttggtgggggactatcggagatggaaaagatgacgggtaggtactctctgccgatggcttaactgggggggaggggaaggggaaggtatggtggacctcgttggcacgattgactcgtttccgatgctagcaaggctgggtagtgacgtggtgggcagtggcggatcgggaggaggatgaggctgactgatcgattaaagagaagtggtggtgcatgaagggaaataggaggaataggagagagttatggtcaaagaattacacgaatattaaagcagatgtaacgataaaaaaacgaaaattgtggggtggattttctcacatgttgtatagtcaatccatttaggttttcatatagaatgacaaactttgtcgaatgattacgttgacatttagttccttgaattttttagagacatagcacaaacgcatatactctcaatacgcgcacactcgtccctattagcacctccgaaaaactggccaacgtcactgtaattgtctcgcaatcgacgagtatgttgtctatcaatgaaaaaataattagtcataaatgtgaacatccatgttaagttcatgagctgattccaccacaagaaacctaacaagttaagctacgctcacattgtatttagttcatcgatattgatgcaaagcgtaagttaatttttgcactggcttgtttcttgacacgtggactttttgtgaagacaaccgaaatttacgagaatgattcacgtcggtcgcccggcgcggggggagccggattgggcgctcccctcgcgcgcccctccccccacgtgtgggcccacccacttctctctccttttttccacaaaagatgtttcatctagtataattacaatgtttcactatttataaatataatgttgcagtgaattaaaatactctttttcaacaaaaaacccacatattttggaaactctctattaaggaaatttggtttattttttattctaccaaaaatatttcacctagtgtactcacaatgtttcactatttatagatctaatacagtgaacgaaacattccattgcaacaaaaaaaacccacatattttggaaaccccctattaagggaatttggtttattttttgtttcaccaaaaaatgtttcacctagtgtactcacaatgtttcactatgtatagatttaatgttgtagtgaactgaaacattctttcgctatttgctgaaatattgtttttatataaggtgaaacaacacccaatttaaacgagtgaaacattttcgatctacttagtggaacaattctgatatacttggtggaacatcgtgcaacatttaaaaataattcaataataagctaattttttttgtcggaatatattcatgtgtggtcttgttttgaagatttaattacaacaaatttaatggtgcatcggatcatgatttagataaataatttaagagaaaaatcagtgcgcctgattttttttccaaatcgattgggcgaccgatccataggcgcgtcccgaaatttattcttgatcctgaaattctatcttagaaagaaggtaaacatccaatatttctcctgtgaaatgttctgccgtactgctgctcttctgaatcatgattgtggcaacgagtgtgtatccatactcattagttgagaaaatattcccatgtttttttgcttaacccaaacgtattgtggtcgtttacatttcattgtttttctgtcttgctacagcgcaatttattataacttatatgtttatgcctacagaacatcaaatatctcatccatttatgtgctaacatgtgaggcaaatatccaactgtctctgaagctctacaaataaagacctaccggattccatgatcattatgacaaggttgtgtttgacacaacatggtactcgctctatagattaataatactggtccttttgaaaagaacacggtcttaaaaaacaattttaaccactattcttttattaaaatatatatagaaatatcaataaatctatgattattttgaaatgcattttaagacaaatgatttagatgttatttataattaaagtttttaaaatttgacaataatcttatccaaaacaatgagtattattagcttggggagagtacttcctatagcataagatttgactaactttgaatgttttatcattacagatgtatagtcatgtcgataaatgggagtacgtagtatttttttatgaaaaaaattcaaatgtaactatattttaattaaagtgtaattacatcgtaactctgttataattatactataactacattataactacattgtacattgtagagctacataaattttgataataaccttttagatagaaaacttttaaatgtaactatagtgtaattaaagtataattacattttaaatctactgtaattatactataattgtaacttatatatgtaagtaataagaaatcgtcaatagaaaacttgttcagatagctagttccatgcgcttgtaacgtcgcaccatttttttcccgctttcttgcgcgaatctcaatgcaatatggttcatgaaattatatgttttggaagaatgtcaatagttttttttagcaattccttttttttttctttctagttgtttagtccatcaagccaatttaaatactactccctctgtttcaggttataagacgttttgactgtttcaggttataagacgttttgactttggtcaaagtcaaactacttcaaatttgact

SEQ ID NO: 64136 - DNA, 1376 bp, Oryza sativa
ataaatataataattatatacaataaatttatatactccatcaatatacttcataaatttatattttcttgataccaaagagttgtcatacataaaaattatttttgttttcccttcgcaaggcgaaactaaaatatttttttggtaaatattatctcacaaaataaactgatacatataatagtcgaacacaataaatttatacaattcatcaatatacttcataaatttatattttgttgatagcaaaaggtaaaatggactttatgatagaaatttaatggtcaactaatggaaggggtatagaagggatccaaactgaaatttagggatatgaaagggaatgagcaaatcttaggggcatagaagggattgggtgaagttttaggggtacacagagaattttcttctcatttaattcctattgcaatgcatgagcattcaactagtttctttaaaagtctctagttgtggtgacatggaatctgccaaccctgtagttttacaatttgtctgctaatatattttagggaaattttgctacaggacactgcttacgtgtgattttagccctaggacactgcccaaactcacttttgggggaaaacactccataaacgtggtaatttgctagtggatattgtgccggttaaaataataatttctgattggagaggagagagaaattgtgtgaaatgtctaaaatgcccttgggcccacatgtcagctctcttctctttctatcccctcctccacgacgagcatcaccgtgcgggccttctcccccgaccaacgccgcagcacgcctagagctagatggtgacgcccctggcgcctaggatggagagccgctcggggccgtccctgtcgccgccgccgccacccctcgataggtcgtgctgtgtcgcgttgaacttctcgccgtcgccccacaacgcgtaggcctcctcgccgtgcgccgcgtcgtcgccgatcatgagctgctcgtcgggcatccgcagcgggatgaacaggccgatgccaaggaggatggccgtggtgaccacgaggttccacgcgatcacaaacgcagcgccgccgagctgcttgctgatctgcttgatgccgccgccgtagaacgcgccgcggagtcccggcaccatggactcgaggcctcgagggagaagagctccggggtggccaggaggcccgtgaggatgcagccgaggagccccgccacagcgtgggtgtggcagagtggtctcgcgcgggggccggcgcgacgacgcacaggtgatgggcggcgatggcgtggcgcggccgtggcgatgcttcgtcaggcggcatcggcgcgcggcgttagtcgagggagaaggcccgcgcggtggtgtcatgga

SEQ ID NO: 64137 - DNA, 3135 bp, Oryza sativa
aaaccaagtgagatttggggtgggggagacgccgttcggcgagcgtcacacaccactcgatgacacgagatgagatacgcgacggcggcttgtctcgttgtctgtatcggcgcgctcctacgcgaaggtccagtccaatccaacaggaacggggacggcctcgtcgttagttcggtgctccgccacctccatctggcagtggtatggcagcagcttcgtccggtgcggcggcgtccctttcccctgggtaaactactccatctgggacacgtgtaccgtgcacacgtgctttaaatattgtttgagacatccgtaatgtcaaaacatgccctattaatatttgggtagtctggataatggtttttgtttcaagtcgaatcattggtgttgttaatgtctaatttaaattcagaaacgctataaaaagtggtgacagtttttcccttaaaaatatgtcgatttgtggtgcattgaattgatgtcaagattggtgctaaaacagcagtatgctaaggccgggagtacagcatagcacgctcataccagcttagcaaacatcttttcttaaaaaaaaaagacacttctcatatatttatacaaatttacatagtaattacatcccacttacacaccacttacatatgtaattttgaaatttacatatataattttaggacttacatatgtaattttgagacttacattgtaaatacactaaaattacatatgtaatttagggacttacaatgtaaacacatgccgactattttttaataaaaaatatggcgtcataaatatagctactccccaaaaatttttgattctactcaaagtttgactctaaattgacatcaaaccaaatacaattgcaccctactttaaaaaagtagtaatgctaaatcttagcactaccaatattggtatggtactgaactaaacaagctcatcatgctttaagagcattgatacacgtatcattacatacatgtatatacatgcatataaagttataaaatataatcggccacaggtgttaaacctagaattttgaacttcttttccacctaatggaattggatataataataagtacacatgcttcttgagctttcagaaaactttctacatatagttttctcaaaatattattctatatcctttctttaactttatactaaatacttcattttgtcgtgcccttgaatcattttattcagcattgcattttatttccttcagcccagaagaacacacccaagtgtcaacgaatgcacaaccacattttctttacgtttttcttaccgtgcacgtgcgatctaaccaatgagaaaaatcacagtatcaactaattgcacgtcactatcatttacgtgccaggtgacagagctagtagtataatttttttttacgtggatgagagggctcgtaaatttgtaatacagcatttccctttctaacttatctaattctttacatcgctccgtcgtcccaattcatacaccgcacacaccttacctactacactcacatctgttccaaaactggacaaaattatttgataattacacccggggaaatcaaatctcatacttatctttagaagtattataattaatcattcttactacttaattttcgtgctgtatgagtgaatccatccagatagggatcgaatggtcagcgttcagtatcagtgaatccctccagatagggatcgaatggtgtcaagtgccatggattaaatcgggttcgttaattaattaattttcgtgctgtgctaattttgagatgaacggaacataataaatgcataatactccacagcctatctgcagtgtcacgctaccgagaatcaatgaatcttattttacaagctcacgaaacgtattgattttgtttattgacgcacaggcatacacaactagcaacaataacgctccctctatttttgcaatattcaactacagtttgtctgcctccgtttttttgggggaaagattctaactatataatgatgaatatgacttttccaacttgtgaagcatatatagttttccattaatatttttcgtactacccattccggtgttcttttgggctgaatgattaattcgatggaagatttgtacaaaagttattcaatagcacaaatgaataaatcaatcattttaaagtttaaaaatggatttgaaacaatattacaacaaatcatatatggaaaaagtttgcaacaatcgcatggtttaggagttcaggttacacgcacattcatccatttagcagaaaataacttttttttttggcattaatacctggttgagccaggtgtatatctgggtaaaggttagctccacaattaagtccagagatcaagacgacctcttgaacaatctactctctcatacaaaaaataaatgagaaattaaaaactaatattacactatactatcatgaaaaatatgttctgagaaaaaaatatataaatattcttttcgagtacaagttaggcaaactcaaggacgcacacatccacgtgcgtggctaacactcgtctagagagatattggaggcctaggtagcctcacgcgtacaactatctaaatatgattacaaagttttaaagaatttcatcacatgcttatgcaatatgtcgagtattttttgtgaccaatgaagcatcacggaaccggcaaataaagtacgagtactagctagtactcgtagcaagggagaaaggtagaagggcatgtttatttcgctaaaagaaaatttttaggtgtcacatcggatatttaatcggatgtcgaaaggagatttcggacgtgaatgaaaaaactaattttataaatcgcctggaaaccgtgagacgaatcttttgagcctaattaatatatcattagcacatgtaagttactgtagcacttatgactaatcatggactaattaggctcaaaagattcgtctcgcgattttctccctaactatgcaattagtttttgtttttatctatatttaatactccatgcatgtgtttaaagattcgatgtggtattttgagaaaaaaaagtggggaactaaaccgggccgaagcatcaggctgtgtttttcgactggctcgttttccgcgcacatgtt

SEQ ID NO: 64138 - DNA, 4131 bp, Oryza sativa
ccaccaaagcctcatcacacacgtcatttttagaggtccttcaaaccgagccctccctatgccaaatttggtgtttctctctcctcacgctatcccccaactactcagctcagatgaactcgtgccaccatctggattgtaccatggggaatagagaggatggacataccgggtctgtcgttggagttcgtcggagtggaggccccgccatccgtgccgcccctatcgggattgcgcccgcgctgctgctccttgctcgcgtcgcctgccgccgtcaagatgcgcggcctcctccgcccctcgctcgcctgccgccggctgcctcctccccgaccatccacggccctcacctgcccggtcgcttgcctccgtggccgcccccgcccctcgctcgcccggccactcgcctccgccgccgcccccgtcactcgcccgcccggccgccgccgtccctaggctacacgcctgccgccgctttctgccagctcggttgccccgctgccgccgtctcccacgccgagaggagaggagaggagagttgcggcagtcggcagaagagagaaggggaaagaatggagaagagtgtagaaagaagcagagagaaggaggaatagaaaaggagagaaaaagagaaatatagtctgggagaaagtcacaatttaatgcattaaattatccattaaaaatatataggttaaaatacacttatttacattatcgtgataaataacaccgttaaaatttagttgttcaagatatagcccttaaaaaataacacaaatatatggttagttggaagatattagtaaaatataggaggttgtgatatggaggatgtaatatgaatgatctattggagtaggaaggtatatgaagaaggaatcttttttggatggccatccatatgagaatatggaggattaaatttagatgagctgctaggatgggatgctctaactagtctaatacctcgagttgtcaaaaggttagaaaagggcatcatgccttgccgaagctgtcagggttacgggtaagggataccctctacccttcgatatacgtcacatatcgatatggtacctttgcacgtatacggacgttttttgcatacgttaaggaaatttatcatggagttcacagatgaaaggagtcctactcggacggaactgggtcgtcattgtatcgtgccgggtccgatgcctccgtgtcctacttggagaccagttggcctgcgatataaaagggacccccgggaggacctaaggcatcgaatctcatagccaatacatccaccaccatctacggagttgaagcctgcaggagccaagtcgccgggagatctaatcggacctgctcgattacgatctcggcggtatcatcaagttccgctttccctttataatatgtggtttccatcatataatcccatatcaactggattagtgctattacctatcaaggggttttaaccagtataatttttgttttctgtctgcttgatgtcgtattatgtagatcctcgtaccagcgtaccccaataccctctatatccggtctacgggtatccccgtcgacagaagcatgacgtgatccaaactgcaaaatacaggaaatcatcgtataatcacttccgtggagatgcaaaaacagctagcctgacaacataaacaaattgttccaagggctaggtttcaacgctagagagataaatatattgcgcctcatgttcctctccagaaaagaagaaaaataagagattacttctcatgtttctttctttttttttttcaaccccatgaccggtttgaggctttgagccttttgaggcaacgggtgatagtggtcttttggtagtcaactatagtatttgtatttcaaattcagtttgttaattacaattttgaaaagatatatgaattataggtgcgaacaaatattagagcaagtataatagagggctataaaaaagctaaatgctgaggtggataagagaggaaaggagagagataagaagcaggatataagtttatagttggcttaggcacaggaatcaaaaaaatctatgagacagataggtgaaccatatattcatagtaaagagttagccactgtatgagtgagctgagagataaactatagggatctatacagtaagcagctggctgtattattagtcttgcttttaatcatctccatcagtataattctctaagggtatgcccaaggtacaagactcaatgaattataggtgagcccaactttatatggagacgcacaacttgcagatacgggtagaccatcgcccatttgcccacatgccaccgagaaagccactaatcgacaggctgcgtcgctcatcgccacacgctccgccccgcccctgcgaggatgcgacgcacgcgcttttgtaggatcatgcacgcggcatttcggaccaacagcacggggtgcacctacttggaatctctacctcccaatgttgtgggggcaactgctcatcgatcgagagagagaccagagagactggtcttctgtgctcttttttttttttcgcctctggcgtccacgaacttgagtggacggtgatggcgatgatacgcagcatgcgcgcgcgcgcgcacacacacaagatgagacgatatgagattggacttttgagaatcgcagcggccgctccggtcgccgtcggggatcagcgtgaggctgccgccccacgcccaggcgcgccgtgcgacggaaacgcgcgagacgcgcgcggcgcacgggcgggcggctttgggtgggcgacgacgagacgcggcagagaccgtcacgccgacgcgggcgcgcaccgtaggatgcgtgggatcgttgaccgggcgagcggaagcggagagcatccacatccaccgtacttgcccaccagaagggatatggggggatattggggatggcgtttctgccgttgtccgccggccggtccccaccaacgcgacgatgtgatgtgatcgcgagaatatccttgtggtggtagcgtcagccagcgtgccgtccggtcagagcgagtacagtagcaaagctatactccctccggaaaaaaaaaacatttatagggctgtgtttagattcaaacttccaacttttttcataacatcaacctgtcatacacacaccttttagtcatatcgtaccaatttcaacccaaactttcaacttttgaaggagctaaacacggcctaggtttaaatctaaacataaccaattttgccaaatatagatatagtgtatatccatatttgaatataaaaataagtgttttagaacagagggagtaagccataaaaacttattacttttatcctaaaatataaaaatctaggattggataagccattttccagtacaacatatttagataagaagtctatcaagatacattatactaagaaacgttttatccatccaattataggttattatcttttgggacggaggaagtatgtaaaaaaaaggaaaagagaagagtcagcttccatgcaaaaattaactcttaacatgttccaataaagatatactacgtatattatataatatgagaaagggataagagaaaacaatcagagataaccttataatttactctctccgtcctaaaatagtgacccatccagtacaaggttgctatattttaggacggatggagtatcaattatatattagttctaatataagcttatagatagctcttataacgagagcagttgtctctattattaaacttgctcttataacaggcagagctcctccacaaattgattcgtgacaaacttaacagcgagaacgtttcatgtgactaaattttactacatttatctaaaaatataagaatttttaaggtaagaaatgagtattgagaagtattacctccgtcctagaatataaaaagttttagagttgggtacggttattaagaaagtagggagaattaaatacgaagatgttatgattggttgagaagtggaggtagttaagaaaagtgaattgtggagggttgtgattggttaggaagaaaatgttgttgaagaagttgttatattttgagacaaatgttgaatgctaaaagttgttactccctccgtttcataatgtaag

SEQ ID NO: 64139 - DNA, 30407 bp, Oryza sativa
  unsure (1)..(30407): unsure at all n locations
ttacattatgaaacggagggagtatattttaggacagatggaataggtgggactaatagaaaaatgttgtgattagttggtaagagaaagtagaggggaaatatgaatggcaaatggttgttattgattaagaagagaaagtagataagaaattactatattttgaaacaaattttaaatgctggagttgtttatatattgggacagagtgagtatttgttagtcgtgcgtttttaatatgttactgttccctctaaccatgaataagcacaaagtttgaaatttgtttgacaattctttatctattttctaatcttaaccaatcacaaccttcttttatttatttttctttcttatcgacttccacattttaatcattgtaagcatccctcatctcaacctaatggtttatctggataacggcacaagaggagtgagattggggtagaggaatcagggaatgggttgagggttaccatgaaatgagagagggataatggatgactacgatttaaacatactctttgatcagcgcaaaatcatttccctaatccattaataaacctatgtgcttcctatgtgcttcccctgtgcaatggattctgttggcccttcttcagacggcgacgtgccctacctccactccatcgagggtgatgctttccatcatagtctcatcactccaaacggtgcctatatgttgttgaaacacgcagaattttatttaaatcttttttgggcatttctatctaaaccatttgtgcaatatcgccattagattgtgtttagtccacgccaaaattaaaaatttgtttaaaattaaaatgatgttatggaaaagttgaaagtttgtgtgtaagaaaattttgatgtgatgaaaaaattggaagtttaaaaaaaaattggaactaaacacggtctagaacgctcttcaagtttttattcttcaagtttttaatgatgcccgtgagattctttgttccctagactccaggagcctcgttgcacacatcatgcacgtgctggcaccaattcggctttcacttcgtcgtctctgaaggtcgacttctgtgtctcttactggggtggaaagatgcaaatgttcctccggcgcaccattttctcgacgaaggggaaaaaaaaagtccgaatgccacaagcagaagatccgactaacctgacgccatgaaaagagaggcaaaataaagataagactttgggatcacaggagctgatctttctttttcttctcaattatgggggttcctttcaagccttgggatagtgaagggtgcagtccatttgttgttctcttcagtcttcagctagtgacaggaacttggccacctcatggaggaggtaggagagcctgtctccctaaacaatactagtagtagtagtacctaccactaccaatggcgatgctccttgccatatctcacaaggaattgaaaatgctggcctgttccctttcctctagcttagtttatggggttcacagggcaagtagataaaaaagaagagaagaggaactttctgcaactgcaaaccacattcggttgagatcaggtgtacttatttaaacggcatggtccttgtttcaaaattataatacttaaaggatagaaaaactatggcagtttggggaaatgatgagatatgcacatttggcagatgctaacatagttgactgacgattcttatgaggttatatccaatgatcattgtgtttgcttgcaaaaatagggcaacttgtggcaatatcatacaagatgttgggggggggggggggcgcaataattaggaggttaaaatgaacaagcaaagcataagttttcgtgtcattagttgttaggtcaactgcttaattgaactatacagatccctactacccaacttaagttaataaaactgtatatgattgaataagtcaaagcaagtgccgaactatatcagcgtgtacatattggtgccctttatgcacacgcgattttctgcacatacagaaaggacgaaatcatcaaaatatatacctcaggaataaagaataatgtgtgttaaaaattaccttcgctgatctgaacacgatttttccaatgacaaagaccaaaacaaaagctaaaatgtgtttataacccttccagcattcttagagtagattatcactacacaacatccacagttgtttaacaattactccctccgtttcatattgtaagattttttggacttacctagattcatccattgattaatatatatgttttctacatgtgtctagattcattaacatttatataaatttgggtaatgctagaaagtcttacattgtggaacgaaggaagtatataagaaacaaacatatttcatagtcgtaagaggtcatctctcactattgtcatacatactttgaaagttacagattagaggctgatgtgatttttcctgtgacaacgctgaaatttgcctcaaatggctgtcaaataataaagaaaagcgagggggggggggggcaataacagattgatttattgacctctatgtttatttgctcaaggttcatggcataattatacacgaccgtgattttgttatattatactccttgtgtcccaaaataagctcatttttcacccatcccacacataccaatacaaaatcagaaatactataatacccacactttataaaataccaatgcaattattcatctccttatctactcccaatgcatttatcccttttcaaactccgatgcaatgattgcttaaaaatgaacttattttgggacaaacggcaggggcaaaaaataatcttacgtagacagctatgttcaaaaaccaacacattactgtctatacctaaaagtccaagattttcaaaacttgagaacatggtaattaaagtattagtggtagttggatgactgtagagaattttttttactttcaccctgccagttataattatgatatactatctatttcagggatggggcccttaaggattcacatcagaacacagacttaagtgactaatttgttacaccatcagacctttttttatgtgaatggaagtagtcatgacacagtgcagtttttatttcatcaactagatgactgttgagccgataagagtgaacgatgaccattcttgtcctcacaggctcacagccacatgatctggggctcaaaacatttaatggagtgatccttctcaaaccaaatactggactcatgttaaaggttttaaggggtttctatcatgtttttgattgttagttgagcaacactactacctaaaataatatgctgagaaattagctgtcatgacagttgatactgaaaagcaaaaacaactaatacttagccattcttgtagcaaaacctcattacatatttacaagaaaacccaatggatcaaaagagaatctcaagcatcttatgtctatcatctgaatattctgcatacattcagaaagcataattatatttcttctatacaaacaaaaatggtagggaaaatcaaagtcacattttattatacacgttggtctttggttttagtttttggccagaaattcctccttacaagcctaatttctcaacttcccctaaaaaggcctaattcctcgacacaaaccatccaattcaatcacctatcatttgcatttcatcagcacaagaccaagccacatctgtaaacacttgaaacgtcctcaccaaactttagcaagaacagagactgaccgtgcggaaatcccagtggccaacgataagccaaacgcaaggacgcattgccccttcaagcgtagccttttccaaggcagttcaagcagcgctgcaccctgaaaacatgtttaaaaaaaaatcaacaaacatccatagcagcatggtcacagcagcacagcaattcaaaggggcgtgaccaaaggtcaaggaaatctccgcaaaggacggccaacctagtcccgtcacaggtagggcagaggcacgggttgacgaacaccgggtcgtggagcggagaccactcgatcgtcgagctgcccctgcagagcctgcacgcgtaggtccccttcccctcgcaggcgccacacggcgccgcgaatttcctctgcgcgcaacagcagcgcagcccagttcaggtcagggcagcgacggcggcggaggcggaggcggcaaactgagcgacaagggtttgggtgtgttgtagtgtggtacctggttggcgtcggagagggagcggagggagcggacggcggcggaggacgcggcggagaggaggaggaagccgccgccgaggtacgccgcggcgcgcccggccgcctgcagctgccgccgcgcgcgggcgtcgcgtccgccgctgccgaactccatgggcgagccgagagggggtctccgctcgctcgctcgcttcccggccgcacgtcgtcgggacgagacgtgagccttcgttttccttagccgattgcgcaatcggcccatttagttaggcacagtaaagaattcggcccacatgttgagaactgaggagccatagtcttctcaatctaattctctgattaccgattttatcttggtttgtgttagcaagtttttcaagctgctaaactgatggaggttgctttaaaatatcatataaatctattttcttaagtttgaaataattaaaactcaattaattatgctcgcatggttttcgcgtttagctagagtatgcgataaactactttgttttatgctaaactaaaaaaagcttaaccgaggacaaaattactgtttagatgagattttaccttaatatcaagtcagaaactgagggttgtgcccatttgcaggaatcaaataaaatatcaaattgttctagagagagctttggttaagctgaaactttccattatccacattgagtatatttccagatgttttcaaaaaaaatttcgcagctcaattcttgcccataccacagaccggactctgaaactaagtctgagcaatccctgcaaaagtgtctacagcaatgatggcctaaagcacgattagcagcatggctaattctcaagcctcaacacgtcagggggcaacatgatggtcaccgcgaaagaaccatctgaaaactactctgttatcattcatatgacatacgcatatcacctccagattgaatcgaactatttttcttttattttccctttcaaaggagatctagtcgtactaacaaggtcacctttcctgtctacatcaatgaaaaaaaaaacgctatctttgtacactttggcttgtccataccatcttgaactttcatgcccacacctcatgacgaagggcgaacattctgttcctttcatccacattagcatttgaagctttcttggaatccgatgggtacatgggaccagaactgatcaggcttcagctagccctgatgagttagttcttgtgggttgctcgattgataaccgacggcgaacattccgctcctggaacaaaaggaacaaagaattgaaggagatcaatgtattggcaaatagctgaacaattatgcactgcaacgacagtctaagtatcaagaaatctactgaatgaaagcgtgggaacagcaaaggattgcaggcaaccaaagctgaaggcatcaaagtggagtcacagtcaaagacagttcgtagtgcttcagatctatcatagtgcacggcatgattatctgagacaaggaggaagataaaagcttcatgtgttgactgggattcagataaagcaaaccatgtctattatatatgaagcacctgagccacgacattttattaaaggagcatattgagtcatgctcagaacatgcttcagacttcagatccctcctttccatctaccatatatctatctggttaacctccctccctctatctgattaatatggggatttctagccttttagagcaaatattgaagtttatgtagtatcaccttaatatttgataaacaataggtctcagtacaacatgcttacatagcaaataatgcctgtcaggattagtgatttagctcatatagccaaccggatgcatgggaaatctagaatctaaggcagtcatattcattagaaagtaaaccaactcgaccaacatgcacagtacataatcagttctctctctctttttttcaatgtagcattaccttctttttcaacatatttatcacaaataagcacatatagcaagtaaatttatcacaagccatagttcacttactccaatttcagtgacaaagaggcacaacgagcacttaacagcaggcgcaccaaaaggatacatcaataatgtcgcacagtgtccacaatgcaccttaccaacttcatgagctgcaacaaacatagggggaaaacccatgcaagggtaagaagatgcatatatacacacatcggtacatcagtatttggtaaaagctataatacatggaaatattaaggacagccgtgcttcaaaaggaaagacaaagacgagataaattttgcgcaaatggcatccatattttgcagaagtgttgcatgaaaaagctttagagggtgtgcatgaacaaatagtattataaaggcaagggcaaaattctccagttctctattgagtggtccaatgttgaaatatgtaaccaaccatacttcttacacataatttagacagtagcagaaggcaaatttttgagaaaaagcatgttcagtattcagtaagtatttccacagaagtaagatacaagatggctgatatctataggtgttgaaagacaaaataaaaattatatggggcataacaaaagtaaaacactgttgggcaaatgagaaatagtacgcaccttccaatacatagttcattgtctggcaacaagtacagtgaacataaccagcacctctaaaataagcaagaagaatacggcagcttccacataccatttgacctacttctgtacaagttagcaacagaggttacttatgctcagagagagagagagagaattacaccggattacttatatactagccccagatttatttatgggtgaaaagctgacttctttggttcacaactatgtatgaattgatattgagggattggataacatccaaagagaaggtacacagaagcatagtatattcctttcatctattgctctaaaaaaaagttagtactatatttcacaattgcaatcaaacttcatcattttggctgaaactgtcttaagagggaccaggtatacacaaataggggatcaatggagatataagtgagcatattacatgcttttttgaatgaatgaaagcacattacatgcttggtaaactttaaggacttaatgctgattcccgcaactagttcattaaatttatatctgctagccacagtttgcatgagcattcttctttcaaaatcatatcaaagactgagaatcacaaaaaacaagccaacttttttcacaaattataggaaacttatatagtctaagatgggcatatgattggtacatgattaatcaatggaaagaaaactgttcgtagaactccaaacacgacccagtagcatgagcacgcaaggctggccaggttgtccagttgtccttgaacatcaaggaagccaagttaagaggttagaatagataagatagaaatgtgtttcctgttagtggtaagagaatcatatttaggataagatgtttctttagcttagtgagccatgtacgtggacgtcctatgtactcaagtcagggtatcaatgaaatagaccttcctgagaaacttggtcatctcagagcctctgcatggtgtttgatccaatctcacactgactcattttcaccttccaaagacccccaaactcatcacaaatactaagtcaacacaaacaatagcagttatatagacatggaattagaggaagtgagatgcaatatactaacctttatttaggtaaggggaaggtggtggtggcaccaatggcacagagtcctgtaaacaaggtgaatcatgtgcggtagaagagggtggatgctgaggctgcaatgactcatccactataccctcagattgtggctgcattgcagttgtactgacaaggtctgtagtagttgcctgcgatgcaagtggtagctgagacatctcctctgaggccacagccacagactttgagtcagatgcatctagtaagctatctgcagcctgtgatgtaggagaatgtgactctgattctagttgtggcagtgacccctcagaaatattcttcagtggtgatgaccgaatgggcactgtgccagcttccatttcccctgatacaagcggtcgctgaggcgattcttccaatgccactgcaaccctgtcaatggcaggaacatcagccaagccatctggggtctgaactggagaaataacagcaggcagtgacagaagctgagagggctctgaattgtcacatcctgaatgcaccatatctggcaaacaggttgttgtatccttttctgcaggaggaggttgcgcgaattgctgcggagatagcccatctgctccactttcagatgatggtagcaatggaggtactgcatccatatgtacacccattacctccactgagtgcagtagctgaggggcttcctctatcacagacacaggttcagttaccgattgatcttgtcgcacatttgtggtttgtgccagagatggagatggtagcagtaactgtgatgacttataggtttcaaaccctggcggtgccctatctggtgaacagggcgcttcttgcattatgggagaaggtgctcttggcagtggcttttgcaatgactccactccactgtcaaaaggcagcggtggtggatgtatggcatccatgtccacatccattgcctccaactccaatgcaggtggtggcccagctgcttcttccactgttgctgccaaagcatccgctgcggctgcatctggtacagtttggggcagagtgggaagtggtggccatgatgacttaaaattctcaaaccctggaggtgccatctcctcttgtgaacatggttcagatgatgacttaaaattttcaaaccctggaggtgccatctcctctggtaaacatggttcagatgatgatttgaaattatcggaccctggaggtgctatctcctctgctgaacatggttcagatgatgacttaaaattctcgaaccctggaggtgccatctcattttgcaaacatggttcagattgcaccactggagaagggggtctcaatagtggttgttgcagtagtccctcagtcccttctgttggcaagactgttgtgggcaagatactgaggacagtgtctgactccatgtttgtcacctccaaagctggcaatggcctagacacttcctcaatgggtgcttccactgccttggtaaccaccacatctggcaagacatcagtggtttcaactgggggaggagtcgtgggtagcggcaaccatgacgacttaaaattctcaaatcctggcggtggcgtattaggtgagctgggctcagcctgtgtgatggaggcaggtttttcaacatccagagcttccgatgaagggactgactcaaccgcttcctccggcatcaccaataaaaccttgggggcagctgcgactggcaaggagggcattgattcgccaagtggtgtaggagggggcaacggcaaccatgatactttacagttctcagatccagcaggagccatctctggcgaacttgtctcagtgccaattgtgggagaaaatggtctctgcattgactcttgctcaatgttcattgtgggagaagatggtctctgcattgattcttgaagtgacccctcttccctactctccaataccagaggcacactgactgctgcggtaccagtctccccgtacattacctccatggcaagctttgaaccaggagcttcttcttgcatccttgctactacatcgatcttggctgcatctggctccacactctccaataccggagacacactgactgttgcagcatcaacctccctgtacgttacctccatggccaacattgaaccaggagcttcttcttgcatccctgctactacatcaatctgggctgcatctggctccccactctccagtactggagatacactgactgctgaggtatcagtctccccgtaagttaccaacatggcaagcgctgaaccagcagcttgttcttgcatccctactactacatcaacctcagctgcatctggatccccactgtccaatactggagacacactggctgctgtggcatcagtctccctgtacgttacttccatggcaagcgttgaaccaggagcttcttcttgcatccctgctactacatctatctcggctgcatctggatccacaccctccaataccggagacacactaactgctgccgtatcagtctccccagacgttacctctatggcaagcgttgaatcaggtgcttcttcttcttgcatccctgctactacatttttctcagctgcatctggatccccaccatccaataccggaaacgcgctaactgctgcggtatcagtctctccagacgttacctccatggcaagcgttgaatcaggagcttcttcttgtatctctgatactacatcaatctcagttacatctggctccacactctccaatactggagacacactaactgctgaggcatcaggctccccgtacgttgcctccatggcaaaccttgaaccatgagcttcttcttgcatctcttctactgcatcgttctcggctttatctggttccccactctccaatacaggagacacactgactgctgcggcatcagtttccctgtacattacttccatggaaaactttgaaccatgagcttcttgcacacctgatactacatcgccctcggccacatctggttccctactctccaataccggagacacgctgactgctgcggtatcattctccctgtacataacctccattgcaaccgttgaaccaggagcttcttcttgcatccctgctattacatcgatctcggctgcatctgtctccgcactccccaataccggagacacactgacagctgaggtatcagtctccccgtacattacctccattgcaaccgttgaaccaggagcttcctctggcgacaccgctactacatcgacctcgactgaatctggcgatgtgtatgcgatttcagccggactagtgggaggaagcggcagctccgcaggctccgagctatcacactccggatgagttgtaggcggtggatgcggctgctgctgctgaaacccctcctgcccgctctccaatggcggcgtcggcggttcaggtgcggtgcgcgagcccatgggttcgcgcgcacgggacgccattgccgcgggctcggcggaggatgcatctggcccgccctccaatggcgtcggcggcggcggcggctcgggcgcggcgtgcgagccctcctcgtcgccgaagcgatcgcgcgtaggggaggactcggtgtaggatgaatccggcgaggcgcataagaccagtggcggaggagtgggcggcggcgacgccggcgagtcatcctccgcggtttcgtacgaggaggaagaaggggatgacgccgccgacccggggtagaactcggccgccggctcagcgggaggacacggcgaaggggagccgggctgccccgcccccgccgccgcggcttcgagcgcaggtggcgccgccgaggtacccagctccagcgaggggaagaacgaaggcggcgccggcgggcccgccgcaccgggggtcccaccgatcggaggttgcggttcttccgccctgggccacccctcggtggcctgacctggagacggcggcgggatcggggtggcatggtggggttggggggatggctccggtggaggagcgtcggttggtagggaggggtctccttggagaggaggaggagaaggggaatgggatggcgggggtgaacccatgcgtgcgctctccggtggtacgggtgcctccggcaagctcgccatgggtgagggggtggcgccgcgacggcggcggtcaccgggaaagggaaaacggtagcggagcaaagagagaagcaataaaatgggggtgtttctactggggtttagcccaagtcaaatctcggccgttcatcctttgcgctgaagtttttttttttttttgttgctcacatggacaggacggctgatctttttaataaaaaaaatagatatgtcatataacttttaaaatctatgctattcacataattaaaaccgtaccaccgtgacaaatctaaaattagatccacgtcacattatacgtatgagatatgctttgaatcgtcttttctaccgtatatttttatggattaaaatacccctaatcatgatccccatttctttagacgttctcctcttcagtagcagtagctaagctagccaccaccatgatgaagatgactcggatcacttggatatggcctccatggtgacagaccatgggaggtcgacaacaccggcgcttccatcgccagggttataggcaaagtggatagataatggaatttgtcgcagaaagatcacctcgagcacggaatcgatagaccctcctctcctctccatgtaagttcgggctagggagcgagggtgcagaacaagagtaatcacgtgagtaaatgaggtgaaaagcagttatacatgtccgggtcatactgagcgtaataccctactcctatggggttctttcattgctcagcggtttagaagctaagttactatggagttgcgaatgtgtttaaaagtttctaaggttggatctgatccctcttttcggtggctttggatcttctcttgtagtcaatggaggaataccacagtgatcgagttctttaaaaaaaggccttagtacacaggggttaggtatgggaagttttgtcacttaccgacatgtcgatgtaggccatccaatcttgatagcgtgttgatgggcgtcccgagcagcagatattggggatcatgctttgtaattcaccaatagaatccattccggtctttacttcaaagaagttacaactaattattatagatgttgcagttcaaactactatgaattacaaaatcataactcgattgaaaccaacaaaactacttagaccaatagcctgaaggtagagatggcacatattgctaaacttccaactatagttaacgaaaatatgcataactgttgtttctacgcaacggtttgcaagttgtatgtaatcattgtcctcctcgagccaggaagcaaactctccgaagaaacaaaatctctgaaagcagcgattgtgtcgcttattttttgcgcacatcatcattggcgacttacatcgaactaaagtggaagatgatgtcaaagagtaactaagttgtaataaatctgtcatttccctaatctttccactctcattgaatccaattcattagggacaccatcaccaaccgacggtggccatgagcagtgctaacgaccgagaagtttgttgactggcctgtggtgcatggaggaaaaggttcagcggcacgccaaagtctcaacatcatggaaggcttgcaatactcttgggaactaatgcacatcctcgtcaaccccaccattaccatgtgcatcactaaccccttggcgtaagcggccacctcatcgtcgccatggtttacgataaaatccgtctgtactctcactcaatgctggtgagatgtgcctcctcgagtgctcccataggcccatggcagttggtggcagcaaaagataaaggagaggatgtgttggtggacattttttgagtttcgacactatctccctttggtggcggcaaggaaaaaatcagtttctcattcgcttattatgatatcctcttttctcgctctatcctcattaggttagtagtattttttttcagcttaaaagaagtgtctttgatacttgtcacccatgtcttcgtttcaatagtaaaaatgtaaaaaaggtcatgtttccttccacaacaaattgccagggccgtccctaggccggtgcggggcatgcaaccatataaggcccctaaatccaaggggccccaagtggtattaaataccctaagtatataatgttatagtgggctttgtttttattattcttgttgttcaaatgagttttttagctcatagttggcacaatctctcttcaactctccgtatctcctaatttgtgggttctcctgtctcactcgcttgtagttgtctctagggtcgcttcacatttgctctttgtgtcatgccaatcagtatcgcatcatggaaaggatgcagtggcagcaacaacactgagcgctcatggtcgccgtcattgctcttaattattttgtggccgtaggagatggttacggcgattgacaacgacaagctccagccttccggtatactccctccatcgtaaacaatgctaggttggtttttattgggatggagggagtaaattccaagtccaagccttatttttcctcttttcttttttttctatattttgtatatacaaatcagttgatttggtgtttcattgtttcaacttacaagccaacttaagtttaggtcccatttagcgttccatatagggccaatgaatttttctgggatggccctgcaaattgtacatgttctactactacaatggcgcaaaaatatttatatttttttgtctacaatattgtactcagtaaaaaaaagacattaatgaattttgtagagaggtgaggatgatattgggtactgaatagaggttatgatataccgttacactcactatatggaaagatagctgacggcgggaaccccccatgataaaataagcacaaaagggtatagtttttgttgtcgagacaattgtggtctatgtaatcattccatcccatatacggacaatatacatataactcataaaataggttgtccgtagtataattaattatttatttagttttgtagatggtatataaaacatatatatggtattaagttgtctattaggcttctttatctcacctccccttattaaaaaaaaaatctacgtgacatctactctagacactgacatcgcgctagtattcgtgccttaaggataaagtaagaatgtgtggtatgccgatttttgtttaaatacaagaaagaagcatgtaccttatggcagaaataaaaatagagaatgctgatatatttcaaagatatatataccttatgtaccttatgtacttctttaaaagactccaatgataatggtgaatctgccaccacttcatcgactgcaatcttacagataggaccactatccttcatccattttcatactgactagttaattaacacatgagagagttgcagatgagagcatatagtagtcggaaattcggaatggcatgggtagattagatggtgacattggcattatcgtatgctgtgtgctccaaacccataacagaagtacgtgtattctgctagtagaaaatgatgttgacaagagcccatagaagagatgaaaagcccaaggtacatactatcagtacggacaaaactcacttgatgttcctctttgtattttttctatttcttctagcttttatatcatctaactattttttgttagagaagaaaatgtatttttccatcacttggcggttgcattctcattctatcatttcgatacgacttatcccacatctagtcaaagctgtcctaaagtttcatctcacattcatccataattaaatagaaatgttattttcttcagagaacaacattcaaaacaaccctcctccgaaaatactacaatgccagagaaacgcccaggggctccacaaggtgtgagctggacgatgtgggtttgaagtttcgctccttctaattatttgatattagatcattgcctaatattcgcatctttattgacatggtatttgggcagtaaaaccttcatcctaaatcaaacaagaacagagggcacacttggcaactctatgggggaaaatgatatttacacatgtacaataacaatgaacgaaagcaacttacaggctacagcatggaaattcatcagcaccagctgtccggtgaagcatgattacagtataggaaaaactgaaaagatttcctttaaaaacaagaaaccaaaaacacaattaaagaaagaaggaaagcccattggatggttgcaagttgctgtcaactggcagtgactctgtacttatagtgtcctttcattgcttaatgaatgcttgttatagtcaagccagattaagcaaagcgagcttaaataccaagatattattttcaatggagtaactaagaactttttaaaattttaattgcaagagaatgcttgtgccgtatgaaagtcccaagaattttacgtcacacctgtataaaaattccagctctctataccttctatatatatatatgcaacccactaaacacctaaacctcaacatataaccatagtaattattagtacaccctaatgcctaacatataatcatgttatatccaccagtaaacacccaaaacttaacatacaaatatagtaatatatgatttttatgacattctaaaactcaacataaatgcatgctaaatcatcattttgatgcatgatgagaatagtctcatgtttgtctggtttccatggttcttccaaatcggattatcctctagtatttcatagtaggaaggatagaggacaaacgttacaacatgttgatcatgcagttaagttaattttacattatatgctttcatatgtgcagctatagtattcttacaatagccacaaattttagaattgtacccatcaattcaccgtatacacaacacggagttgaagtttctagcattgtcaggtaaaaattggatggaacatcccgaacaactcatacaaatttgatcctccatattcccatttggaagaccatacaaaaaaatattccctcttcgtatcccttttcgctctaatagattatccaaattacatcctccatattacaccattctatattttagtaatatattccaatattatttttattagctatattttaaatgattaaattctaacgctattatttgtaacggatagattttttaaattattatgtttgaatgtatatatttgtaatggactagtgggtatttttttaatggctatatctccaacggatggatatttttttagcggctagttgtaacggctactatattagaattgatagctttccaacggctagatttcaacactacatataccattacattgtttgctatctttttcctccatccacattgttgtgcatcctctttcatcactcaatgagctacattttgaggcatcttctcttggatgattcattgttggacgatgaactcatcgttgctgtagcaatagtcgcacaagataaatatgagcagtcggatcctccactacgatgtggttctgttcctgttcaaatgctccacagcggggtgcgagtgtgggcacggggcgacgcttggctgccgtagcagcctagggaatcggtggcgcagcgggtgccaacccaaaacccatccccacctcctaatctggtacactccttcctctctacctccactcctccacggctccaccagccaatgtcccgctactgccaccatcattgtaaaaaaagaatgacaacaatgacaataatggacaaggggttgctccgtcaatctgaatcgggatagctcggtctagaggtggcggttgcgatatggcgtgaggggagaggaacgctaaaatttaacgtttctctttgggatagcacacacgtgcccacatagcgtatctgctggagctggttttttttccctatgctatttcatcgatgaaggactggatatagtatccgttcgaattgctcttaggcccagttctattcaacaactgaaactaacttacttgttatccgatacgacgcttttcaaactattaaatgatgcgatttttgtaaaaaaaattatatatagaagttgtttaaaaaatttaaataaatatatttttcacctttataattattaatatttaattaattatgtgctaatgagattcctcgttttacgtgtggtacaaatcttcctcctccacctgcaatcgaacgaagccttactttcctagatattctagtgtaaatcaagtatgttgacttggaaggaagttccaacactttttcgtaagaaataacatgatctctccgacggaaaggaaatgtctttgcatccaataaattctaatgagctaaaactttcctgtagtcgaaccatccaatttttcatcattccttttatgcattttttaaagttttttttcatttacagttcatctcattcatgtgtttgttttccatttctgtactttccatccctgtgcggcctaattctgcccaaattaatggcaatgccttttttttccctactgagagagatttttttttccgtggaataagggagctctatttttcaatgccattttcttttcaatgtcaaattaatggtattgaaaaaaaaatgctggatcctcgagcaatcactgctccgtgccaagtccaagcttagtttttgccccatacctcgtgcgcgattcgaaactttttgaattttgaattttgaaccttgaaggcgagtagagttcaaattccaacgtagtactactagtagtatccgccgcggtacacagcacgaggacgaggggggggggggttaaagctcaaatcaaatgagcatccaaagaaccacaccaggggggagcactatggccgtgggccccacctacgcgctcccggccctatggcccacccgaatacatcgcactcgggcggggggacacgccaggacgagtccacaccgcaccggggccccacctgtcactgaccagcagctcgtgctgggggggagcagcctcccgctgacgtggcgtccgggtttaccataccactcgcaccaacaggaaggctggctggtggtccccacccgtcatcccaccgacagggcggtgcaccggggagacaccgacatgcgggccccactgaccggccgtggtgtccggctcacggcgaggtcggtccacgcgggtgcgggccgggccgcgggcgagagaaccctagccaaccacgtcactgtccacgtcacgccgaccaaataatataaagcggcacccatcgcctcagcgcctccctctctctcgagtctcccgtctcctttcccctccttcctcctcccctttcgtcttagcctcagctcgccgcgagacgaatcctcccctcgccgccgccgggtccgatcgacggcggtatcgagggacggagggggcgcgcccgttctctcgccgtacaccgtcgtcgccgaccggctccctcgacggcacggtaaaataaaaaataaaaagcctcctcctcctcctcctcccctatgatggcggatgcggcggcgggggggcgggccgatctggacgccgttgacccgcccgattcggctcggtcgcatccccccgtgcgcgcgtttactgggaggatctgttgtatttggacgttttagactggatcgagtgagggggattttgcggtgttcttgctgtgacgggattcagctatgtaggtgtaggaatcttatgttaacttgttgggtggctctgctgcttctgattctttctgtgaatctggagtaacaaattctttctgtgaatctggagtaacaaggacttgtgctatggccgatctctacttttagtacttcgttatgttctatacggcataggagtccatctctcgatagataagagttctctgattttggatggggatttgcttgatggatccggagtcatataacatgtttgcaaaaaaagaaaaaggaggagtccatctctcgatagataagagttctctgattttggatggggatttgcttgatggatccggagtcatataacatgtttgcaaaaaaagaaaaaggaaaaatgatttagtttgtgttctgtcatgtataacccttgtttctacaaagatgtactagtttgcgatctgattaagcatctcatgctttctcgctttgattctctttcagagtttgaagttggaaatcaaccttgttgttctctgtagcgctttcctttggattgcggagaatttcaaacaaaaccaacaaacctttgcatctgactgacttgaggtaactatgccaaaggacaggagcacccgtgccgtgtcatacgagcgccgccggtctcgtgtttcgccgtacccctccaatgggaagggctgtgctcgcaggtcagaggagtctgctgctgctgccgctgccgctgccgcgaagcaggctgcggaatgggaggatgtccgctgcccggtctgcatggatcacccacacaacgctgttctgctcgtctgctcgtcgcatgagaagggctgccgccctttcatgtgcgacacaagctaccgacactccaattgctttgatcagtaccgcaaggcctctaaggagtcctcaaaggattctggtgccagtgctgctgctgcgccagaatgcagcgagtgccagcagcccataaaactgtcttgcccgttgtgtcgtgggccagtcagccattggacaaaggattatgatgcacggaagtacttgaacgtgaaggttcgagcatgtactaaagagtcctgcgagttcaggggggcatacggtcaactgaggagacacgccagggagaaccatcctactgttagaccaactcaggtggatcctgaacggcagcgagactggcacagaatggagcagcagcgtgatcttggggacttgttcagcatgcttcgttcaggcttaagtgccagggaggacgggatcggagtcagtgaaggggaagaggatatcagcgagagggctctacatagcccatctataacaatggtcttcattgtgcgcactggcaggtcgatactccactacagggaagcattcccaggccaccacagaagaagaacaattcttctgcttggggaggcttttggtcgtgaatcctccccattagggggagcaagtggcagtggtgatggtgacaccacagctcgcgaaaatgatgaaggtgatgacgacgtcacgctatcaacagaggcatcggctggttctcagcatgatggtgaagtcgatggtgatcctgcacattgatgcagctggtagggagtgccaaggcgtgcacctggactgaaaagctctacaagcaagcaatctttcgggttcaccaggcatccaagaccacatgttgggaagaaacatgggggtgttccatttggctttaggcgtagtcaggacatcctgcctacgtgcaagaagaactgagatgaaattgcaatgcagggataggctcaaaaccgctgtggagttgtcttagtttcatttttaatatatttgctggaaggtctgtagcaaacagaaacatcaatggtggtggtgtatttatcatgtccacggctaggacttgggtgaattcaattcactgcgttgtaatttgatctctgaaatatattctttctgcgttgatgaatctgatcatgttaaagcagaaatttgatgtatatttatgtatataggtgcactttggttccttctacattgaagaattcggtcatatgctcctgaaagttgtgctgtgttcgtcagaccatattgtttggacatgagctgctctttgtgggcttaggcgcgtagccttaacttgtcttcttgttgattagaaaaattggatggacacttctatcatatgtataatacaatcgatagactctactttgtgcattaatagacatacagcaaaaaacaatatttgaagctgtgtcagtttctgtattcgatggcaggctgcatctgcgtctaatcctcttcaacggttcagtatgggccaagaggaaccgccatctctgccgttgcaacaagagtagttactgcctccaatggtatggaaggaaactgacgcccattgatccaccatctgagcacactgaatttcatttccttctttttctgtgaaaaatcctacgaatagaattaactctctaaaaactactgaaaatatttctatgtttgacctgtaggcatacagctttctcttcttctccccccatttcttgaactgcagatactgtgagtgcttcagcaacatgtggttttgctccaagctgatactgaagaagccttaggcattcagaccaaagatcgtcgatgtcagtgcaaatggcttagccgattcggctgtggtaagtgccaatacctgattctacactgtgttttcttgttcagttaggctcaggttattgttctgaatctttggatgaacaggatggtggcgagcgtgaggaaccaagtgaagggatgcgcttgctgtaagtctggatgcaggaagctttactgtgagtgccttcaaggtaaacggaattacgtacggatgcgctactgtcctttgatgcttattttgtgatgatcgtgtcgtgcaaatcttacgttcgctttgtgatttgaaaaacaaagttgcgtgtaccgcgagatgccattgcagagggtgtggcagaatgcaaaagatggtgagtgctgcatcagacgtttattcatgttccttagcatattttctttctttctttcttagtttctttctcttttttttttgggttttctaatggttaagttttttctttaatgtcagtgactgacacagatatacaacgatttgatgacaatggcgattctagtgggacatctggctattccagtggaacaataatgggacagtacaaattgtagacgacaagaggcattggccaacacaatcaagtatgatggaaaaaaatattatagttggctgtccttggaatgttgatccatataattcgtaactgtccttgtgtgttgaacttcaactagtaaagtttgataactagaaaaggcggtggtttgattctttgatgtgataatcatcttggtgatctatttatgcacctgttctactgtttagcctattttcatttagttgcttgaaattctatggttgtacgatatacagtatttttatgatgtgtaatgtgttcacgattagtcaatatttttatgatttgttcctttgtgcagtgatgatggccttgagatcagaaggtttctcaaacatattggtgatggagattactttcagcaaaatggtcaccccctaaacaaaccaccttcaagaacataggtatgtctgctgctgaaagattatctatactttagacagctcatagtaacaccttatcatcttatcttgttatgatttatgaattatgataccttgaaattgtgataaaatcgtacggttaatttttaaatctctcatcttttgttggtccaggggactatgatatcatgtaacgaagtacactaacatgatctagagcacaaatatattatgactgcaagattagtgaggctcgatagcattagtaacgaaagtatcaaacaagcaatacaatactacattatacgcatccctctttagcggtaacaaagtacatcagtagaaaactacaactgtaacgtggtatgcagttgtttggaaaacacatagtgttacatatgctaccaaagccatgactgtcacaattcacatatcctaatcaaccttctcctgtatattgtcaataccttcttctcttatacatcactaccaaagccactgaaccgggttcatattttcgaattagccgcgggatcggtcaagtcccagccttgaactgagccacttgcagacatcgtccatttcttcagggatggtataatgccccaggctgtgtaaatggcatcatgttagttattctagttttcagagaaaaaaatgaagatggggaaaattaagtaagtgtgtctatacccgttgtagggtttaaaattcagatactgaaaacccgagcctcgcaggaaatcggctgatttctcaccatttctgtaggtgacaacctcatcagctgcaaaggcaaaaataagtagaacatttttagcatcattacattttatacacatctagttcaaaacgattgcattgctcacctcttccatggctgagcaggattggtaaggcaccagcccttctcagtgcagtctgagagctgtccatcttgctcttcagagtcctaaataagaacacatgaagaacatcacttgtaaggaaatcattgcaaattaaattattattatcattttccaaaacgatcgaagaatagaatcagaccttgaacagggaagccaaccgctcaaaccgatgacggcgctgagggtgaccgggtaggcaacgccgtttgtgaatcttccatgagcatagcatgcagcagagtggagggcagcggcagcacccatgctgaaaccacctatcccaagcttcactgaaatttgaaattccaccaaagatcagtaagacaaatacagagtattctaaagcttatttaatattttcacattttttttccttttgttctgtaattatggtacaattctgaaaatgtaccatcagatggctcggatgacagtaggtttgcaacgtgtgcagctgaagcatcaagcccttcaatatcatcacggccatccacggaagtgtcctccacatcaaaccctgtttcaatttcagtaaaaaggagaacggcaatatcagaatctgtagccaggttgcagcaaaagaaatggcctagaaaattaggaaagcaaagctgcatgcttctttttttcttttttttttctttttttttctttttggccaagtcataaatggttcagaaacccacatgctgtgcaagggaatccaccgaaagcagcaacagggcgtgttggtgcagtagggcaaatccatttgatctgcataaggatggtataagcttgagagttaataaacttagaactagcatgaacaatgctattgctaaaaatctttttaaaaaattgctatggctaacctagtgattcagataagttacattaatttgaagagataacagaatgaacaagtctatacatgcattattgtgcccatttggaatagggataggaatagaaataagattgtaggtgaagatggttgtgtgcatgattgattcaactgcaaagtgagagtgcagtatggtatcttacattaggcagaggaagagaatccagtagctgggaccagctgcagaagataaaattatgaaaaagaaacaagaaacaagattaggccagtgtttcaagaaaaagtacatgttacagctagtcagcaacttgtgtagagatatttcagtgctgtgctggctttctatcaaaactatagcttcatctaatgacattaacatgtcaacaaaagaagggttatcagaaagtaatggagaataaaagaagtaaagagtgaggaaagaataaaacatgacatagcacaacactggatcaaactaaggcagctaatgagctggctagagcacatatgtatatataattaagttttttcttgtgttctcctgaaagttccaggtagtagtacaatcgtcttattaatgaaatatgccattgtaattcagtactgatgggaaaagcaaagaagtgggaagagaacatttgaagcagacacttgacagttgacacatgcatattgaactcagaaaaagaaaattaatggctagcatattctatgcttttgctgccaaaacccatagaagagaaacaatgccaaaaaaacttatgttatttaatgcaacatcacaaaactgaggtgctccatgcatccttgttggcagacagaaccttgcatgaagcatgaggtaattaatccacatctatctcttctatatttaatcaacatattggtccttcaacaatggattcttgcattcgtgtttctacaccctttcgtggtaagagaaaccaaagaaactattttaatccctcaaggttatatgctattattattttttgcatgtggttcagatagaaacaagatattttgaaataaaaaaaaagagagaatataaccgatcatcttacacacccttcacaaacatgcaagttcaaatgtttatatctacatcgtttaattttctaaagaatacaatgtttcataactgttaatttgaacggtgtgtaccacccccttgagggattaattaaaaacaagcctcttaacgaaccacacaaataataactcacactccaactacagttatagttttgtgtttaatttaagatacgtggattatttgtcataagacacatagatggcaattaaaaccatcaagtgtaactctaaacaagtagtgagtggcagatggccaatatatattccaactggttaattttcttttcgcaaacatcggcatcgtctagctacctccatccttctcgatctacaggaaatttttgtgaggtcggggagcagagacagagagagaataggacaattggagatgatgcatgatcaggctttaattcggaggtaaaaagcaatcctaggaatatatgcatggacagaaatggcgaggccgaatccatcgtttctagcaaaaaaataaaggggcatcgatcgagttacagtacaacgtcgggggagagagaataaagcgattaattgggtgcagatatcaacatcttgacagcctaacctaagctagttcattcgttcgtgttccccatgtcatctagatcgtcccatccatctctgtttgttgcattcatactaaacacttgcagctatagctagtgaagctaccaccaatctttttgaaccactccctcctttttacttttataatatacatgtatatgacctttggtgaattcaggtcatatataagtatataaaaaaggagtgagtatagtagtagttgtgataaaatctgtgtactactaggacatttaaaaattaaaaactgggagcgtgtagtagtagtacaagtttgcatatttttggtcgtgtgtaatataattattaagctgtggaagaaagaagtcatcatctcgagatcgagagagagaactctagagaagtgatgatgggttaccttgcgccattgtcgccgaggccatggagccacacaatggtggcctggtgcctccccttgggcctcaccacgtacgtcctcccgtactccacccgccgcccgcctcgcccccctgcacgcattccattcgatcgttcgtcagcacacgccggcggcggagaaagaagacacgaagaagcaaagaaagaaaaaagagaggaagtgagagagagaccagaagagctgctcccgtagctcatggccggcgaccaagaagcttgagagaactagtactgcaggtgatcgatcgatcgctggaggatggtgaatttggctgctgctgctgctgatggatatgtatagctctggatcgaggagaaagcggtggaagtacgaagagcacaggcggcccgtatttatagagcggcgacgacgaggaagacgacgtggtgaatatgtgaatcgcgcgggcgcgcacccggtaatcaacagttggcggcggctggtaggttggctcgctagctgtctgtcgctgggagaggggggaataataatccatgacctctagcatacgtaatgcgtgccggaatgagataaacgttcattcagttatttgccaacttaggatggagattttacaaatatacctgaataaaatgtcttttctaacttgtgttggtattagtattagttattgtctagtcatttcctggtttttatgcgctgtctattgagcgcatcataagtggtagtagcttctttgaagtaaaggccgggattctttgcattattaaagggagtagatatatttatggcgccatatttttcaacaaaaaatagtcggcatgtatttacattgtaagtatctaaattatatatgtaattttattgtatttagtatgtaagtctcaaaattacctatgtaagtgtttaaattacatatgtaattttagtgtatttaggatgtaagtcccaaaattacatatgtaagtgcctaaattacatatgtaattttagtgtatttaggatgtaagtcccaaaattacatatgtaagtgtctaaataacatatgcaatataatcgcaacaaaaagaagagggaagctcacaaatcataggtccgtttggagaaaagaaagaagctagcaaagtagaaaataattactcacaaaatcacatgtccctttgagtatttgtaacaaagtaatcaagtgatgaagtcatccttgatatacacctcgacaaaatcaatcagcgtgggaagctaagcacggacatcaagggagatcctaccactagaaaaaacgactgttttttcctcaaaaaacatgcgccataaatatagcaataccgttattaaaaagttagcacacgtacacacgagggagggcaaaaaaattttaaaaaagaaagatcaggggcttttgccttttgctacctcaggatggggatgggggaggtggcagcctgcaggcattggcagtggagggtctcttaatgtatgtaaattcattggtgtaatggtgtgtgggtggcgtgtaagtagggatgaaaaacggtgccggaaattcccgactgagcggctattattcccaattttgttttgctgatcaaaccatcttgaaatcaaatggctaccaatcaacaaaaatagaaaagcaagtggtaaaaatgaaatgtgcaaactgaaatggttttgatgtttgaccaaccatttacttggtttaccgtatttttcacagatattgttaccgtgtttataatatggaaattgtcatatttctaaataaatcagttcatgtagttcaaggcctataggttttactctaactcccccactaaaccctatatatttttagcacacggttaaaagcgaggcaactcacaattagtgttgtaagcatgaactaacgtggtatatagtcattctaaattacatatgtgattttgtacttcagaatttcttctgattgattttccgtttttgatttcctgatttttctatatcattttcatttctagctctactgttttcaattatgtttctaagaagaaaatgttacggaaatgggtaaggctgtttttcaactattttcatccctgagtgtaaggattgtaaaagcacaagaattaacagaaaaataaggaacaatccttaggaacaaaatggcctcatgggatttcaagacacacaagttaagtttagggccggtatgtttttggaaatcaatgtttctccgaagggtctttctaaaaatatagtgatagattttttaggtaaaaatatgtcaaatgtaattatagtataaatctaatgtaattacatatgtgaattagtgtaattacatatgtaattttgaaacttacattgtaaatacactaaatacatgctgattattttttcatgaaaaatatggcgacacatttatagcaaatccgttctccgaaatagggtgtgagagagaaacataactcatgtttcttttgagcataggaatacacaacatatgaatttgacaacacattcatacgtttcaaactttcttgtgggaaaagaaatccaaaattcccaacaaaaaccttacaaatctgggcctcgtttggaatgcagattttttttctcgaatcatgttagattcaaaaagattcttgtggaaaccctgtgaatttcctataaagtccctacaaattcttatgtccaaaggtggcccaaagagaccctggggtgagctttctcctgtgcaaaggataagcatgggaaaatagtcctgtagttcatgggtcctatgcacaaaatggttaggaggttaattgtcagcaccacactatgcagcccatctgagtaggccccaaaccctgcaagattattttccatgagcatggcatgtatttaggcagggagaatagattcaatccttggcagtggagagagaaccgaaatatataaatactacttagtaccccttttataaccacccaatttctcatcttggtgtcttgataagatactaatgcccactaatttagcatcacaagtcctaaatagtattatatacaacataaatacaaatgctaaggaataagcataagtgttttttttctatccctttgtctctctagagaaagaaaaagaaaataaaggtacatagtgaatgtctcactctcagtacctaaggaaggttcttgttaacacaaatgctccatatctagtaggaaaaggcatcttttgttgtagaatgtttgtgcacaggaggnnnnnnnnnnnnnnnnnnnnnnnnnnnnnnnnnnnnnnnnnnnnnnnnnnnnnnnnnnn

SEQ ID NO: 64140 - DNA, 1152 bp, Oryza sativa
ttaattattctatgtatagaaaatgggatatcactgatatgctgagataaattatgtgtgtgtcagtgtgagatcatcgtttcatcagctgaaacggtcgacagcaaccgtgtttcaaagatgcgccgtcgattacttcttacatgtagaagtcaatcacacgctcgttcacgcattcatgttctgcaacgtacgctctgaagtctgaagcacatactagtactccgtcgtagaaatactcctattaaacattaaaattgcagttgctgcttccttgcagcaaagaacttctgccagccatatgtcctgaacgagtgaatggcagcaaacaacacattactacatttcagttgagagttgacaacacaactgctccctccgtatcataatataagctttagagttgaacacagttattaaaaaagtaggtagaaataaatgttggagggttataattggatgtgtagtgaatgtagatgggaaaaatgaatggtggaatattgtgattggttgggaagagaatgttggtggagaagttgttatattttaggacaaatcctaaggtctaaaagttgttatattttaggacagagggagtagacgactagatcttgagcgaatgatttcaagatgatcacgagcttggtctcctctgaatttctatacctatactcctttaaagaccctaataatgatgatcggtaggtctgtcaccacccattacccaacaaggtaggtggattttatccctttcctagcctcgagccatcaaacatgaaaaattttcttttgacgtggagtaaaaatgatgacaaataatatgacctcaatattttacaataaaattttattttaatttttgaggctttaaagtgtatggtggggttctctcatttaagagaaaattccttgtataccccttaaagtttgctcaatcccttctatatccctgagatttgcgtattcccttccatacctctaaattttaatttggatcccttctatacccctttcatcagttgactgttagttgaccgttatattcatatcataaagtccattttaccgtttagtatcaagaaaatataaatttatgaagtatattgatggagtgtataaatttattgtatacaactattatacttatgagtt

SEQ ID NO: 64141 - DNA, 14300 bp, Oryza sativa
cactatagacttttggtttgaagttcaattcctaaaagagaaaaatcgctagggcaacctgctcaacttgataatacatgctaggaatagtgttgtttcacaagccaggccacccccctagctagtggaaaataactttataagaaaatatatgttacctattcttgtctatctatctattatcttataaagatatatcaaaaagcgacaccacgatcacttcagaatcttgaaattctcatttttattttaaaaatacagatacatatattgattgtctgatcatgataggtaagttctcgtattagatcggttattaatatatttgtactgaaaatacaattagatttaactctactattataaaaattatatatgcttttgccggtactttggtatgtcatccttatttgagttggtttttagttttgttcgattttaaaaatatagatttatgtttgagtcatttttcatatttgttcgtttttggaatacaaaaggagtcaacttacatgctaacttgacacgaaagtctagactcctaattgcagctcatgattttctaaaaaaaaatcaagcgaatttccagagtaaatttcaccctagctaaaccgtataacaataataagttaaaatagccttcacccgttacaacgcacgggctttttttctgataaaatagaagctaagatttacatatgaaatatggaatccattcaactttagtacctactagtgtatacaattatctatgggaacaatatgataagagttgtatatggaatccaatttataactttatctattgtacatcactagcaaaaatgcccgcgtgttgccacgggtgaaaaaattctaatgataatatatgtttttcatgaataatcatttcaatgacaatgtttgtattttaatgagcagcttgtttttttataaacaatgtttttttcttgcgcgattttctcaaaccattcagaaatagcgcatttctttctaaagttttttttctagcatgtttttttttcttttttatttacaacgaaaaccataattttctcccgtttttgcttttcttttctcgtgtgttttttttgcctttttttacaattattttctcgcgtgtttttttgcttgtttttttttcaaatgttctttttttttgcttttatcaatacaggagaatatatgatgaaataaaagccatgtagtaggtggcaaaaaatcgatggatcctatccgactcagagcgatttttttaatagactgtgtttttttcttgcacggttttttaaaaccattttttaaaatggcgccttttttctgacagttttttcctcgcatgtttttttaaaaaaatcaccgacggtggaaataatttttcttgcgtgtttttttatttttttttattttcgctggttttttccgcctcttttttcttgacgttttctttcgcccggttttttagatgggacaattttggttttttttcgcctcttttttctggatcggacagatttggttttttttgcactttcttcgcccggtttttttatctgataaatttggttttttcatccggtttttttgacgaacgatggaagcacctcttattttttaagtaaaaaaatagagagttgcaaacatatttttaaggcttgtataccaaattcaattgtacttttatcgagatctatggtccgggttaatccacttgttcatacacaatactcggaatgtttttatgtatctttcatacgtttactggatacatctttgatatgtacagtctggattgatgtccatttggatgtattgtgtacttgtagattacattagaacttctacacagctccatctaggacaagtttacaagcatgccgacatgccgtcacaagcttctcgatctggcgccgttgtcatatctggcgggccatcaggcacgcatgcatggatacgtaccttgctgcagtctttctatgcaatttcggagctatattaaagagtttgagaaatatactcaagccacagctgtcattaattcaacataattctaagttgaaacaacaaaatggattgaattttctgcaacagtaccgtgttatgatactaattcagtaaattgaggtgtgttttcaataaatgattttgttttcacttcagctcctgaatatttcgttttactgaagatgcattctatttttttgtgaatatagtagtacgcatctgtcatctgattttgtcacaactacaaaatatgccttatgtgctggttgggaactctcatctagtacgaactcttgtttgatacatgttgtatatctttgtggtttaggcttccttctgaatcaatttactcgttgtgaggtgcttgaaagagtaacttacaattgcccggaacttcataggaagaaccacagaagttccggatagctttctctgctcggcaagaaaagctgtcatgaagtttcggaccatgtttttaactgctggaatttttaagtaaattttaggaatgcctattcacacactctaggtgatatcaaggtcctttcagaaaccaccttaggggttgagggtattggaaaggttaggggtagaatacctagtttgagagtggggtgggggcactgtgccaaaaccacctagggggtaaagtaaatggttttgttaatgctatagtttaattaaaataacctactaattttatgaaaccgactaatcctttgattgtagattatgctaaacttgaccagaaatacaagccaataatatatccagtctcgtcttaccctttttgtccgtgtaattctagttaatttggcccaaatcaagtaaagtgtgaaaacatgtcataatatgccacttgttgttaaaaagatatgacaatattaatggttgcatttttagataatggaactcattccaactattgatccaaataagctacaaccaattattatagatattgtagctcgaacgaccacaatttatgtatcatagcttgataggtaacaagaaaactaattagaacatcatcagcctacgcagatataacactatctacaaatgataaaagtttgcataaccattgttttgagaaatggattgcaggttgtatgtaatcctcatcctcctcaaaactgaaaatagactccctaaaatagcgtccgactgttctgcctatcggaacccatacacatcactgccagcaccaagaactgaagcgaatggtatcaccgaagagtaactgaattgcaaaccagctgctaagtcccaggccaacacaaaattccaccaacggtctccgctacacgaggaaggttctctaaagcaacgcccccatgggagatacaacatgattcgccaccacctctcatccgaaagctggagcgaggttttcaccttaaaattggacaggacattccccgcttccttctgcattgtttttacaaagcaggcactttcaacaagcttcttttctttggtaataagcaaaagtgtatggaagaggagagaaacacattaatgacgcctccaaggaggggaacgacacttaagggtgtcgccatcgttgaagcgggccaatagcatagcaaggctttcgttagcaattccctaccaaccccacatctataactagcctgtacattgcctacccgaagctccccgcgaccatgccctggaggaagctaagcatgagaggaatgtgctgaagccactgcacagaagatgttgtcaaccaccagccaccaccacatgcacattcaacaagtgcctctggaggcacgtagggatggagcctcaagaccatcgggtctctgaagttgtgcttcggtcgtagctggctaaatctggcatagcggcaccacatccggttgaggcggcgcttcagccgctgccaccctccaccacttgcagatgccatcgcctattcgtagttcatctcttaaaaccccgcccccaccatccctggtgctgcgcccagcagctagctcggcggtggcaaggcagatgagaggattttatgttttttcttcaaatacatttttaatgtaatggaaatggataatatctccttctatcgttaggcacactacaactaagtccttattcaagtacttggaatagaattcacattatttcaaccatctatacattgtaatcatgtagtacagtgcagtgccatcgacaggccacaaaactgtatttggctgcagtgggcctttgattgaattattttagatgtacacttagtactttaatttgtacaaaccaattacttgatgaattattatttttaaatagttgggactgaaagctcaacatgggtgaagccgagtacattggatctcatatctagcttatagttccctattgttgttaggttcatgaccgaatgtatagttaggctcgatctcaaccattgatatgttatgtgcaattattgctccctatttattactataaatccctcgtatctagtttattttgtactccactaattaataactactatatgattcatttgtttcaaaataagttaatctagtatgagatattctagtactataaacatggacatgcttctatacagataaatagtattaggatgtgtcacatcttataataggttaacttatttaaacctagttattacgaaaaactgcatgcacacattagatgtatcgtagtacaaaatagtttgtacgttgctaattgttgctaataatccccctctcccttgcgtagacgtaaaaaaaaaaagtacccactcagtatagttattgctaattattctcactaatatgtttggaaacattttattccgattattttttacaagtgaaacaagtgtgtcgatcgtctagttgtatgaattatgaacgtcataaattattaaatctgtaattcatcatcttcataaagtgcaaacggccatgcatggtacgttggtctttttttatactggacatatattttcttcttttttttctgattacattttcacgtcttaatatcttttatgtatataagggcatgtgcagatgtgctctcgcatggttctgtgtgaaccaaattaatattaaaatctctaaatttatttcataatatctagatacaacagacatataatatctagtaacagaattgaaagtccaaacccaatcggcatatcgagagagaaaaaaaagagagagagaaaaggataaatttgacatgatgagcagtatagtacgtacttaccctgacagacttcatctatcgccaaagctttcccgacatatagtttggcagcatataagtcctctttgctgactagtgggaaaataagttaaagaattttggggcatggtgcagtgagtgtttacatgcactcttacatatactcaatgttttttggtaaatgtgtaagtcaaattaatcattactacaaaacctcactttggtgctggtggaaaccttacataggtgccagattcctcaaccaaaaccatgaaggcggcgttgatgacggcctcatcagtgtctaattgagaatcgacaccgatgaggtgcacgatttaaaaaaaaagtggattggctcaattcaggccgatgtgttgcccacaaaagttctccaaattgttcttcatcaaacacaaattattttcaacataaaaaatcaagtgaaacacaaattttggcacaaatgcattatttctcaaatcagaatccatctactacccaatccgtaactaactatccactacaacaacaaagggaaaaacaacattaattagggaatcgacaagggaggtagaggaaataatccaacagataagagaaccggatccatcaaaaatcccaaatccccaagatcagccgccgcttctgttagtggttgcctccgtctcatggtcccacccactgtttaaaggatccagccccaagctcgtggcggttagtaggccatggtgaggtggaggccgagggagtgaaatgctctgccgccgaatgggagaaggggatggtgttgtccccgagctcacgacggtggatgtagccacccttgagcttgtggcggccggatctagcgactccaagcttgtggcgatgctcatggcacggtggtggatgcgagtaggatgagacactcatagcagcgctcttcgagagagcgagagagcagcgagcaacaagccaaattaaaaacgtggcagttggctggctcatcagcttgactcctactgagggtgtcagtttatttaaaaaaccggcatcaatgtccttcatatgagtgtaatttttaattcagtgaaataaaaaatgaatatttccaaaagcatttcatgtttatgtcatcatttcttaattgaactgtgcatacagttgcacacattctcttgtgctaagagatgtaaatgaaatatgcaaagtgaacttagctcaactgattaagtttctggtagtggaatctactcatccgggtttaagttctaagacttggtacgatgcccacatttatggctaattattctttcaggggtaagtgacatatttgtcgacagcgagacgtctgcgatgaattcatgaatctcaaaaatatgttggttcagcattccgaggtgtctatatgtatagggtgagcgcgaggcgtctgcggtgactttatgattctcaagatacgttggtttagttttcggaggtatttatagggataaggtaaacgtgagcatgtttatatgagcattgcttgtgtattgcgtttcgtaaaaataaaagtactccctccattccaaaatataaggcataatcacctttaactcaaagaccaagaaataattattatcatcttgtagtttggattatcataataaatacaattcatgcatccaatagaattagagaacatgagagtggaggatttaaaaaagtaataatttaatggagaaggggccatagttaattgtctacatgcatgcataccttagagcacccacaatggtaaagtaaggtgctctctataaaacatgtacatctcagcaatagactagattaatagtaaatcacctcaatagtatgtctacatgggtatctatagctctctaatacattgcatcgttttttactatagactatctccaggttagtagatagttttgctctctcttcatttaatctcttccaagtaggaaaatatgctgatatggatctcttgtagagagactatagataactattgcgggtgttcttatattatagaacatctaaaaaagtggttgtgacttatattatgaaatggagggagtagaactagcttgataatgctgtgagaatacagtagtactaattggataaagatagacagatagtagtactccttatcaaaagactccgcacggttattgaagtatagttgtatacgtttggaaagtacgttgaaagtccaaagtacaaaatatagtacaaagactccccatatattttacaaccttcatgccaacttgtaatatcaagctcagatggatcttcattccttaggagaatatattttattgtatatgccacctaaatagtcattattttttaaaaaaaatataatgtgatagatcaccatgagataaattattccataaatacgcaagtttacattcgaactatacaagttatattagaataaaaataataaatataactaaaaaataatatttttagaggtccgctttgttctttttgtttgaacttacatgggtcgaatttaaacgtgtatgtttggagcatatctcatagtaatttatcttattattttttaaaaaatattttgatgactatttgagttgcacgaaaaatactggtatatccccttgacatagagttgaaaacactttcatcaagcctatctacccatgcattcatgctgatgcttgcttgcttcagctgcttataaatacacatgcaattctacaaccactggcgatttcaaaccaaaccctagttaattcaagtcagtttcttaggcttactgcctcgcgccatggatgggcgagacgagctgacaacgaagcccatcgagatcaagttctcgagctgccgtggcgtcaccttcgagcccaagccctcgccggcgagccccttcgccatcgccgccgccgccgccgccgcatgccctgccaagccgccaccggcggcgccgagcaccggaaggtggatctggctgcctctactgtcgtcgagccgttactcctccttctctaggatcattccggcgaagccggactgcggcgttggacggtcgcagagccgcgccagcagccacttctgcgacctcgacgtcgccggcgacgaggaggaggatgatggcgtgtccgtctttgacggccacgacgaggagatggctgtcgccgcggccgcagctgccgacgtcgaggatgatttgaaagggaagaagaagccgagcgtgtcggcgccgccggcggcggcgccggccaccgccaggcgatcgaggctcgccgtcatactgttcgaccagggactgttcaccgtgtacaagcgcctcttcgtgctctgcgtcgcgctgaacgcggcggcggtcgcgctcgcggcgtccggccatttcccgtacgcggagcggcgcgccgccgtcttcgccatgggcaacatcctggcgctcacgctgtgccgctccgaggcggcgctccgcgtcgtgttctggctcgccgtcgcgctcctcggccggccgtgggtgccggtcgtcgccaagacgggcgtcacggcgatcctccagtccctcggcggcgtccacagcggctgcggcgtgtcctccgtcgcgtggctggcctacgcgctcgtccaggcgctccggcgccgcgacgagatgccgccggagatcgtcgccgtcgcgtcggccatcctcttcctgctcgcgctctcctgcgcggcggcgttcccgctcgtgcgccacctccaccacaacgtgttcgagcggacgcaccggttcgccggctggggcgcgctcgccctgctctggacgttcgtcgtgctctccgccggctacgaccgggaggccaggtcctacgtcccgctcgccggcgccgtcctcgcggggcgcgaggacatcaggctcgcggccgccatcaccttcttcaccaccctcccgtggctcaccgtgcgccgcgtgccggtgacggtgaccgcgccgtccacccacgcggcgatcctgaccttccagggcggcgtcagggcgggcctcctcggccgcatcagccgctcgccgctctccgagtggcacgccttcggcatcatctccgacgggcggcgcacccacgcgatgctcgccggcgccgtcggcgacttcacccgtggcctcgtcgccgacccgccgacccacctctgggttcgcggcgtccacttcgccggcctcccgtacctcatcggcatgtaccggcgggcgaccatggtggcgacggggtcgggcatctgcgtgttcctgtcgctgctgatgcagccgagcacgacgacggcgacggagctgtcgctggtgtgggtggcgaagggcgtcgaggcgaactacggcgaggagatcagggcggcggtggcggcggcggcgggcggcaagagcatggcggggcgggtggtggtgcacgacacggcggtgatggggcggccggacgtgcgggagctcgccgtggcggcggcgcggcggtggggcgcggaggtggtggtggtgacgagcaacccggaggggagcagggacgtggtgagcgggtgcaggaaggccggcatcccggcgttcgggcctatatgggattcatgaatttgcatgcgtttggaacgagaaaacgaagggcaaaagcgttcaaaaggagggagaaaagaaccgagaaaattaaggttgtgtttgtttttaccctttgtgtgtcaaattcaaataattatatatttatatattgtacatatatacaagtaacacttggcagtttctattcagatggtggttaattaattagcgctaaaaaatgcgtggtaaccctggtaccatcaaagggccatagaaatagagatcatgtattatcttaattcatttttctcggaaaactcaaatcatgacataagaggatatcccctcatttttgcatgttacttaaaaagtcatcaaaaaaattaaaaaaatttagtaggatagatcaatatgtgatatgtcactttacaacatgccaattaaaattcaacttatacaagtagaaataaaaataaaaaaatttaactatgaatagaacgcgtaattcacggtcaaatttgttatttttgtttcgaattttgataactttttgaatgacatgcacaaaacgaggggatgtcccctcgaggaaaaaaattcacttccattcttctctcattacacgcatgtggatgcgcatcgcactcccgccatctcgtgaatgcatcctcttcaatggggacatgctggactggtgggaagcttgctgaagagaactgatcaaagaataaagacgaaatttcaatggcttaatcatctacatgactttgggtatttggcttcaaagaaacgatagaattttcaatggtgcatatagtacggttctgcaggtggttgactctatcatcgccatgtatgcaaagcgtatgacaagctcaattcttgtaatcccttatgtccttcgctgtgacacctttctaagaggtgaaccttgtgattctctcttcttctataataaaatttgcagagcttctgccctaatccctcgaaaaaaagaaaacgaaataacagtaactccctaacctcataagaaacctactaatcttagccataccacttgttggtgtgtgctcatcgttgagtgattttttttaataattggttgtagctacgtgagtgaagggtgtaatttttaatcgattatctaaaaatcacaccacctatgttttctcttattaattaaaaaaatgatcaccccttatctcgataattaatttacaaatatataaaataatataccatgcaaccaaaatatattgcatgataaattggtaatacaatcatacattttttgttcatcagaatctgtagaacaatttgaaagtgtgatcaggttattaaaacagcatcaatcaaatgtttcaagtaaatgagaaatggaggaagtgtttgctacctaagtggagctacgtcctgtcctcttccgtcgtcctctcctatcattgaccaagaatgtatgcatttatatattgttccgtattcgcgtatgcgaataaatctacggaagcaaacaatcaggacaccgtagcatctcttaaagtccttcgcccctcactatagaagttctaccacacagcatatcgtcatcttcaaactgtaaatgtctcattgccttgtgcactcacttgctgtcagtcgtagctaggatctcaatcggatggatggataggatataatcagggcaatttgtagaaaacgccccgctttttcaccagtggtttcgcaaataacccttagatttctctcttctctttatctaggctcctgctacttctcccccaccttaattgtctccttccccgtacgtgcggcaagacgtcggcggcggattgaatcttctcggtagaccatgctcacgggagattgcttgaagaagatgaataatcaagatgcctcccgcaatcaaaatccctgttagaaggtgtctatgctcacaatcaatggaagattgaagtcagtgtcgtcctcatcgaaggtgttgcacgcctcctccttgtcgatcgatgctggtggcagcggcggcggtggcgacggcatcggcgggatcagagtgggttcgtcgtgatgacctctccctattgcatggtcggaaaaaaattatgtgcatacgaggtgcaaacctcattccgttcaacccggccctacgcagatgcatgacgtacgcgtggatgagtcgcccatccgacggccagcccccacggctccatccgcaccccgctcggctcggctcacgcgagagatgtcaatgcgcggcgctcgctccaggttcggctcgatctggatcgatccacgaactgtcaatcaagcaattcttcttagcagttcttttccgtcgttcccctattcctgttttgcgatcccgctagctatcgcctctctcgtccgctgctgggcgtcgtctgcctgtccgctgccgcttgtatccaaatgccagagggatccgccgccgctttccaccgaccacggccacggccattttccaccgaccacggcgtcggtgacgcaggatgccgtctgccgtgaaatgtggctggctggctgcttgccatcccgaggtcatcaacaatcgattgcttcgggaacaaacgacaggtgaagaagcgggcagttttctacgaaattgtcccgtttggatccaatccatccgattgagatcctatggtcgccagtgcccagtgagtgagtgtataacgtagtaactgcattaggatgtgtgcacatagaatatattgtcctacttaaaactctactactagtctagtagtaccaaattatttggtaaggctgggattagatgacatggatctgatgtaggtagctttttttagaggatgtaggtagctaaatctattatatctacatagtaatagaaaaaagagtctccacattcgctctcacggcctagaaaatcccacgttaatttaaagaaaaaaagaaaaatagaaggagtacttttcaaaaaaaacaaacttagaaacggacaaaaaaattccaatcggacaaaaaaaacttagaaacggacaaaaaagataaacctaagagctgaaacggacaaaaaaaaacttggaaacggacaaaaaaattccaattggacaagaaagatagaaaatagtgaaaacggacaagaaaaatagaaattccaattttaatcaagaaaaaagagagaaaaaataaccattgggtcatagtagatccagattataacagtttagatttaatatagggtgtgtttagattccaaaatttgtttgccaaaaacgtcacatcaaatgtttggacacatgtatagagcattaaatgcggatgaaaaaaaaatcaattgcacaatttacatgtaaattgcgagacgaatcttttaagcctaattacgccatgatttgataatgtgatgctacagtaaacatttgctaatgacagattaattaggcttaataaattcgtcttgcagtttacaagcggaatctataatttgttttgttattagtctatatttaatacttcaaatgtgtgtccgtatacttcaaaatttttacacctaaacaactaaacacggccataatagttatatagttatataattttttttacggaagcttaaactaactataggaatcggagtaaaaaaagcttgagatggacatgaccaaacaaaccacattcacaaagtttatttctaatttaaccaattggattaagaactaatgcattaacttatttaagtaataaggacatgtttagatccgctaacaggttttttcatcctgtcacatcgaacgttttaacacatgtatgaaatattaaatatagacgaaaaaaataactaattgcacagattgcgactaatttgcgaggcgaatttttaagcctaattgctgcatgatttgacaatgtggtgctagagtaaacatttgctaatgacggattatttaggcttaataaattcgtctcgcattttataggcggattctgtaatttgttttgttattagactacatttaatacttcaaatgtgtgtcagtatatccgatgtgacagggcaaaaattttcaccctggatctaaacacagcctaagaaaattagactccgcgtttgctgggcctagaaattctcatattaattaaagtccatatagaaaaacaatttacatagataattaaaaaataatgaatattggaagagaaggctagagttcatactggtgtacaatttataattaattaaaatatggaatcagagaaaaagaataatagagacaatatagaaatacaattttaaatagccaaaattcgaaattaaaaaaatattgaaagaaaaaacaatccatatcagtatactaaaatttgaaattaaaaaaagaaaatagaagtagacgtatgagtccgtatagaaatacaatttataactttaatttataaaaataaaaattaaaaaaatactaaaataagagtttacaatctatataaaaatacaattagaaaaaaatgaaaatttagaatagaaaataaggaatattggtagtagccgcgcagtttgcataggccg

SEQ ID NO: 64142 - DNA, 6136 bp, Oryza sativa
atgttgtcgcgactttcgtattcagtcatgtaagatatgtcttaaatcaaatattttattttttaactagtaatttttataaactcatatagtttaatattttttagaagacatatagtttaatttagatgatttatattttaagatccgtcatgagaaataattttataatacatatttcacatatagttaaactatatgaatttttaaaaattagtggtcataaatcataactttagctaagaaaaaaaattaaaataacaagtaatttaaaacggaagtagtatagcagtgatgttttagcagatccaactacacccttcgttttaaaactataagatggaacttaatttgaaaacagagggtgtattctgcaactccatttgaccttgatcaacaatcataatggtcacacgatggctatatttcgtcggcttattgaaacagcggaaggatgatgatgatgatgatgtcagcagcatcatcccccagctgcctcctcctcctcccccgcccgaccaaaccaacaccaccgctgctcccctccacctcctcctgccgccggccgcctcgctgccggatcagatcccttaggccggagaacccggcgccgcccgccgcaggagtagcgagagcggtcgcctcctcgtcgtctcccatggagatggaggcggcgcagacccaggcgtgcggtggcggggaggggcagcaggaggccatgaggctgctgttcgtggagatgggcgtcgggtacgaccagcacgggcaggacgtcaccgccgccgccgtgcgcgcctgcagggacgccatcacctccaactccatcccggccttccgcagcggtagcctcccccacagctcgcctctcctgtctctgagacattccgtcgaacacctcatccgcacgccaaattcttcacctgttctttttgtttcctatcgttgattaactgagctgtttttggtgtatgaaggatccattcctggggtgaacacggagcagatgaagctgcagatcaagctcggggtgccgaggccaacgcagcacttgctggacgttgagagagtcaaggccgtcttcccctagtgagcactctttctgtgttctcttcgtgcttattagtaaaattgggatcttcttgttggaacgctgaatcagaaatggatgcaatgagtacccctacaagtttattgagcatgttttggtcggttgtgtaccatactagctcgcattatagtagtaagtttgaaccttggtatgattggcaatatctaggttaggtaactcatggacatggtgaacaaatgtggtgtagaggaacatgagctatcatgtttatttgttcagtacaattgttccttgtgattatgttcataaccatatggcaagatcaagtacggatcctcttcattacccaacattgctcagttgctcactatttccaacactaatgattttcataagctaactgtattgaaaagagcccttagctctttaataacaaaatctgaggcagtcaagggcttagatttgaaaaaaaaaaagtttaatgtgttctagttctttcaaaattgtaaccagtttcccataactacaaaagatagatgtggttatccaatgtgtttaccttcaaattgaatgcttattgagtgtagctgtgatctctaactaagattttttatgtatataataaagtagaaccgggtagttcagtgaccctcgatcaatacagtctcaccttttagcatatttgattattttttctatcaccacctgcttttccttttgatcatatttctataaaaacttcatccttaaagtcatcacagcgtcttaggcaaataaataccatcttttatcaagtacacaagacagtgtggtcagcactatacttactacataagagggttttgaatgttcaacaccagtgctccagaatgtccttcagatgtgaaagtattacatggttacagcttacagtatctcagacaaaagccaaagtggcaaactataacattttgtgctaactagtgtgcataacaagcaggtaaatccatgttgccatgacaaattgattcacattagcgttgtaggaatgtttaatagttgcaatactgtgctgtgtgatgtttgctgagatagaaagcagccatacaaaagaaagccatatggactcatacgattttcacgacttactgaaaatgaaagatcagcaagagaaatatttagagtgcgcagacagtttccatgaactcgtattcatggttgcattttacagtaatattagatatttagatgtggcagtaagcatgatcaaatatataaaaggaagaacacaccagaattattaatggcctggactcagctgcttggatgtaaagcatttctttgctaacaacaactcgtaatcaaacaatgtctgagatactcaatggatctcatttgtccagaatgatcattagcagcgtgtttatagccttaatctgatgatactgatagtgtgcatcttgatttggtttacatatgacgtagcaaaagcgccgccttatgctattttctcattgtttgcagtggtaaaattatcagctttgaggttgtggacggtgggatgatctgttcaagtggcgtatgcctagaagcaatgggagataaaaacgatgattgctatatagtgaacgcagcagtttatgttggttactaatattatctcgatgaatagttcctcttcgttggaacagtaaaaagacagaaaaatgttgtgcgcaataagcatgtcctgaattttctgaatcatcttttcttaatgtgtacaagtgcttatttgctccatccattaccgacatcagtttctttaactgcatatgtcgatacagttctggtttcataatcattttatctactatatactccttaactatggcttaatagcttatcacttagaagccagacgcccacacatattacatatttgcattaggcgtaacattcttatcaatattagtacatatttgcatcagtctagtgttcactgtccagtgctcagttgagctagctgtccatggtcgggtagaaggcgtaggtggcgatgccgcagttgccgccggcggcgccggccgcgcgcgacgcgcatgtagccgccctcgccccaccacgtcccccactggttcttcaccagccagtactccccgccgccgtccgccgccgttctgtagcccaccaccgtgacggcgtggttgagccgccgcccgcacgcggcgctcccggcgtagaccccgctcctgtagtgccggaagtccggctcggcagcctccacgaccacgaccaccggttgcccggcggcgagcgcctgcagcgcgccctcgtcgccgtacaggcgcgcccaccgggcgccgccgacggctgccgccgagttcggcgcggcgaacccgccggcgcggcacgcgccctgctgcccgccgtacgcgtaggccgcctccgtctgcagcccgccgctcgcggcgatgtagcggcagcgccgccgacacgtcgaccgccgctgcaggtgttggcgccgccggtgcagtcgagcacctgctgctccgagagcgacacgaggttgcccgtggcgagctggacgagcccctccgtcgccgccaccgccgcgaacgcccagcaactacatgcaacgaacacacgtacagtacacatgagctgatctacagtgtaacggccggtgtcagacgacacgacaccgacgactttcagtaaacctgtagttaaactgtttatccatgtattataacatcatgatctaagtataattagcatattatggtattagtagatacgttatgataccaacgaatcaattttcgagatacgccactgcgtgagctatgccatcgacgtgtttgtgttcgggagtggttctcaccgcagctgcgttggttcttgacctcggtgacggcgccgcgagccctccagtcgacgctgtccggcacgtccgtgtcatccgccgccgccgcggcggtgccattctcggcgcggtggccatgccggtgcgacggcggcggcggcgcccagctgtacccgaggtgcgtctgcgcgaactcgtcgtcggtgaggtcggagaactggttgaggccgagcgtgtaggtgcggtcgccgcccgcgcggttggcggcgtcgacgcgctccgcgttggccgcgaacacctccatccgccgcgccttctcggcggcgtccgcgtacgcgcgcccgaacctagccatccaccgctcgtgccgcgcggccatgctatgcccgcgacgcggctgatccccgcgcgccgccgccgcggcggcgacggcgaccacgaggagagcaagcagcgcgacgcgaaggtggcgagagacgggaacccgtgccattttttttcactctgtgttgcttgtgacttgtgagctgaggatcgtggcgcatttgcctcgtatttatagacgacgcacggttgatgcatggtcgggtcagtccatattgcactctggtgtgcatgcgcggatgcgccagtgtccagtgggatggttcattgaattgactgtccggtggattggcgtgcatccgggaaagagttttcatcctcgagaggtttattacatatcatctaaaaagttattaaaatatttaaaagaaattaataagtaagattaatgagttatatcactgtgcaaacatgtaagtcattcgacttctacgagtcgtacctaaactaataaatataaatgtgaatgtatgttaactagtttcactttgatttggggcaggtttagtttggggcctaaattaggcttaccaatatttgtcaattttaatagtgtttagtgtctatttggtttgaagcaaaattttgacatgcctaagaaaatgagatatttaaccgtttgccatatttagatgtggcaattaactttttgccactgggcccacatgtcatagacatatgtggacccacatgtcattgagatagaggtggcaaatagttatttgccaaatctaaaagtggcaaatagttaaaagccccctaagaaaataggtcatttcaatagtgaacttagactattttggcttcaatccaaacacaactttaccttatcaaaattagtcatgccaaaacttaccaaaatttggcattgacaaaatttggtaagacctatctaggccacaaaccaaaccaacccttgttctttttgttataacttgtagatagtgaatttaactttgcatatttatgaattaatatgtctcataggagggccgcacacttttgcttactcataggtgggctgcacctccgccttccaaatcttccaagtcctcggccctcactatgtttgtccgagagtagagtggttacccaaagtgaggaatcctacttgtttttcatgaggagcctagatctagccactagagagtagaggaagaaagcggatctggccactctgagtagaggaagaaggctaatctagactggtaggattatgttgaacagtttttttagatactgttacaattcattgtttatcttgtttcatcttattatattctttttttttacatattgttgtacttgcaaatgatatgtattgtcgcattaaaggcgtgcgctcaccatattgaagttgattgtcaataattctttttcttcatgttgttgattgtttctcgtacgtattggtttttttaatgttgcattagtatatttttgagttttgcatctggttaaagcatctcaaatgttgcaattagtgatggaacatctcaaatgatcattgattctcggcaaggaagaaacaccatgcatctgacgaagtgtctccaattgcaaaaagaagtattaatatatattatcagaaaggattagttgattctatcttaggaagtgggacgcataccgtaagcaagcaggcagcggagcaacaaagccgaccagcgccggagccaatcaaccgatcgaaaaaatcccattatcccgacgcacaatactccaacttcaaccatacatgcacaccggggaaactcttttaaacactcgggtggatgttcatccgtttattgcatgtcatctaaatggttatgaaaaattttcaaaaaaattgacataataggttaatatgtaat

SEQ ID NO: 64143 - DNA, 5553 bp, Oryza sativa
gaacttgcatgtttgtaaagtgatatattacatattaacctatcttgtgaatttttttgaaattttttcataatcatttaggtggtatgcaagaaacgggtggacgtccacccgagagattagaatccatcctcatactcataatcatttagatggcatgcacacggccgtcaatcagtccagtaacctgcacggccaagatcattaccgactccaaaaatcggcgtagattttttttagccagcgatctaaacaatgcatctcgttatcaccatgagtggcaaactacacagtgcatgttattgtcaccatgaggatggaagaagcaacaatatatcggccgtcgatggtgacagatgtgatcccattgatgtggacggccggtttcaatctcaggctcagcacgattattccatcccatccctatatggctattacactgataacaacaattagaggcttacccctttctataaaagatatacttcatccgtcctaaaacataaacattcatagaaaaaaaatatattttgagacgaaggtggagtagtaaatagctactttaaaaataacatatatttaactatatttttttatatgaagttaactatattttagtacaaagagtactatatatcagccgacaaatttcttccttcaacataaatcaatttttttaacaattcaaattgattcaacattcatgttaagcgttattaccaaaactccacctctctcatgcgtttcctccatacccaaccggtcgccacctccgtccaccttatcgacattagcggcaaggccaatcagtcgcaccttcctggccacttccctcctcctttcccccttcccccaagattagatccataaacactgtataaactatggtgcctttctccggccatgcctctcatccctatctccggcggctcacaccgctagatccgctgtaaaccccgctcatcaccctcctctattctcatggccccggcaccttaacgtccgccgctggttttcaccacccttaacacttatttaaatcgccctctccgcctcccaaaccccctcccaccttcaatcctaaaaccctaataaaaataagccagccggttcaccggcaccgagtccgcaatacccctccctctgccctattcccgcctcccccagtatagaaatttgaaaacgatgtcacctgacgaatagcaaaggagtaacaatcaattaaggtgataggaagatgcactcctgcgtttcagcgtttgcttgcaccagatcgatgcatccccatcctgactaagcatgcgcgcgcgtagtccatttgtacattattattgctagcctgatcaatcctgatgacactcctccttggcggcgggcacattacattatactactatgctgggttgtgggctccgttcatatatgggctagctgccgctgcgcatgccccggccgtccctgtctgccactctcgcaagtgacggcacggcggcgtgcatcgaaccacggcccgtcccgacgacggcgcgcacgccggcaccggcggcacgcgcgctccggcccgctcgatcgggcgcaaatgcaacgtgatgaaacgagctactagcagctagctacgcacggcgagcgagcgagcgaatgggcagggtggacgagttgttgtcctgatattggaagaaaactcggcgtgcgaatgcgatcgctgaggttgcttgcaataactaactactactactgctcgctccggcctgcatgcatgggtgcaaaggagcagcgccacttgcatgcgcgagtggcacatgtggcacatgcgtggcgcgggtgatggagaagtggctgagcggatcaaaataggcaaatgacaggggacgagggtatatccactttacgtccccgactatcacaccagtataaattgaatctctcgagtctcgatggtttggaattggatgattcgtcctacgtggcatgttaatctgattttcatctaacatggtgtctacgggacgcttacgtagcattaccattataaaatttaggcaaattttgctaaagtacgtcatgaatttacggttttagctataagataccgcacgaagtgatttttggggaagacattctcaaaagttgaatatttgctggtcgacaccgcacgtattaaagtaataatttcctgttagagaggagagagaaatcacatgaaatgtcagtaatagggccaatatatcagctctcctatctctcttctctctatatcccctccttcacttctctctctatcccacatgtcagtgacgacggcggttaggcaaggtctggcggtggcgtgagggcgagggaggagtggccgtggcgacgggaggacgacggctccggccaacggcacgcccagacagcggcgtcgaccatcgacggcgcccctccctcctcactctgcgtgggcgacggctcctcactccgcgcgctgcagccgttgtcgtccaaccacgacgccgctcctccacacgcagatgccaccgccgaacctcgcccgctgtccggccagcgccggcgctcctctgcacatcgctggtcgcgtccgctctgcccttgccctcacgcctctgcctctgccaccaccgccactggacctcgcctgcccaccatcgtcgctaacatgtgggatagagagagaagatgagtgatagagagaggatagataggagagttgacatgtgggcccaagggcatttttgatatttcacacgatttctctctcctcttcaaccggaaattattactttaatgcatgcggtgtccgacagctaaaacgcgaagtcacggtgtcgtatagcaaaatttgcctagaatttaaaatagttagtgggtcccatctgtcagtggcatacccatctctcttcccttttccctctcctctcttcccctctttctccatttacatgcagatgtctcctcctctctccgccagttgtttggaccactgcacatcccctcaattccaccacctcacccatcctcaattccaccgccccaccagccgaagaccaccaccctctcctacaccagtcgtctagtactcttgcgtggcgccggtggtggtggcggcttttgggtgcttgagctccttagccgctagccacctcccatcagcaggtagaagctccctatcatggcctccataggtgttgctgcttcaccccacgactctacattcctaatcccaactaccgacgagcttctcctatgcaagtggttgcctacatggagcggcggtggcatcctcaagcaagccatggatgcagaccctgatctggacgactcgtagatcatgcttcgtggtagtcaacgatgtggtgtggtggatgtggctgcttttcgattgccgtcatgttgcttcttggtctcctgttccactccctacgaatgcggcggcgcacatggctgcttctctaaattggaggctaagcttcttctgctgctccttgctttcctctctacatctgacttcgtctagcttcagcaagcactacacccttctcatcctcttcaacctctttgccttcgacgtcaacatcatgagagggcaagtggccacttgaagtctgtcatcgtgctgatgggatgtggctatcaagagcttcaagttccttgcgcacatggcgatggagatgggggagacgagggatggcatggtgagtgtctactcaatcgagctcccttctcgctagcctctttgagctcctatgtcttcgcagccttcctccatttggtgcagccttcctcaatcgagctcccatgggtgcagccgctggcgagccacaatgagagagagagagagagggggggtgaagataagaggaaggtggggtagccaggttctaatgcgtttcttattttcttctttttctatctaggatgtcacgtcaaccaaaaccacaatcaatactattgaatgactcaatttgcattggtttataagacagggagcactcaatagctggttttacagttgagggtcacaaataacgcagcccatagttgaggaacgtaaaatgtacttagccttttccaatagtagtgggcctcgctaatttttggcccctgatcctcctccaatgagccccggccgtctgtggccggcaattaaggttgcagtcgttcaggagcacacgccacacgggacggacgggactgtccagatgagttggaatgtctgttggggctaacacgttacagttttgtacacatgcaagaagcgcggcataatctactaccactacgcatcatgaatgtctgtgatatgtattcaaggaaaaaagaaggatacaacgcatgcatatacatacacttgcttagtacaaatgggttattgactctacgatatactcttatatacatgcttccgaatttcaagcatgtatacgaatataatggacgaaattacggtaacttagtacgaaacgaggaaggaaacgcgacagcgatcgacgcacggtatccttagttattagacgaaggggtaggcggggcggctggagacgccgcagtcggcgtcgacggcgatgcgcatgtagccgttctccccccagtcggtggcccacgagttcttgagcagccagtacggcgtgccgtcgctcgccgtcccgtacccgaccaccgccaccgcgtggttccgcttcttcccgcagccagcgctgccgcggtacacgcgtcctcccttgaatcccctgaactctgggtcgctcgagtccatgtccgccgccacgggctgcctctccacggcggcgcgcagcgcgtccttgtcgtgcggcgtcaccttctgcacgccgcggatgacgacggcgacggacgaggacgacgcggagccggagccggcggcgcaggtgcccttctccccgtcgtacggccggtagctcttgtccgtgctcagccggccgccggcgctggcggtggcgatgtagcgcagggcctcgtggatgtggcctcccttgcacgtgttgtccccgccggtgcagtccagcacctgctgcgccgacaacggcgtcacgttgccggtctcgatcttgatcagcccctccgtcgccgccaccaccgcgaacgcccagcagctgtctgcaccacacacacacacacgacacatcatagattcatatcaccccggccgccatgaacgacatgatgaagatgcaagatttatgtgattctggaaacgtaattcggttggaagatgggttgtaaatctcttgggtgattcatgcatgccaatcaaatgattattaaaaaaaatttaaaaaataataaaatagattaataggtagtatatcactttacaaacatgcaaatttaaattcgacttctataaattataataaaaataacaaattaaactccagtatatgtacatccaatagtcaaatttctttttttttataatttataaaaatttaattctaacttacatgtttatggagcgatatattattaatatgtcttatcagtttttttaaaaaaaaatcatactaacatttagttgggatgtaagaaaccagtaga

SEQ ID NO: 64144 - DNA, 3059 bp, Oryza sativa
  unsure (1)..(3059): unsure at all n locations
aatgcttaaaagagtttccctttcagttaatattttcattgcaaaagttggggtcttttctatcacatcattttgtttattcctttctttttacttcaaagactttttttttggtttctacgacttttttttggctgcgtactcactgagacagaagatataatccatttttattattaataaaacagtttaattggtgcttactgcaattattcttgccttgatcctggacaggggtgacggcgccgaggtcacgccagtccttgctgccccacaccgcaggcgggcgtgagggagggagatgctgcttcgccgccttctcctcctgctcgaacaacaccctcgcggtcgccggctcgtcgacgtcagcgtcgggcatgaggtgcctggcgcggaactcgtcggcggtgaggtcggcgaacggggtgagccccagggtgtaggtgaggtcaccggcgcggttggcggcgtcgatccgctccgcgttggcgcggaacacctcgaagcggcgcgccttctccgcggcgtccgcgtacgtgcgccccaccctcgccatccagcaccggtgccgcgccgccatcggcatgcccgggtcgtcctccggagctggagcacccgacgccgccgccgccgccgcggcggcgagtatcaggcagagccagcggcgagcagaggccatctctcgtcgtacactgggtgtccttgagcgtgcgcccgtgctggactggactgctggttcgcttgggctgtgctgtgcatgcatgcagggtagctctagctttttatatataggagattgggtaggcgagctccaaccatgggtcagtgaagaagtcaagcaaaggtcgtcgcctctcgctgtccatcatgggcaaggtcgtaatggtaaagccttgnctcgatttaattgggtgtgtgncgtgtgtactcgtannctcgtgtgttgtgcattaaccaatttcataatttgtggccaattgagccggaccaaactggtacatacaaaattgaagatgaagccgaactgaacacacacgctctgaatcgtaccgatgaccgagggaacgttgctggctggcccgatcgatctctctgtttttttcctctttttttcttctttgtagccatcttgattctcgagctccatgccgtttccgtcccggtagggtagcgccaatggacggaagcgactagtgccggccgtatccccgactgctgcgtacgcgtggggttcccgtctcgcatcgctcctccattgacgtcgtttgacccctccggttttacttgttcaactgtaaggccctgtttttttagagagaaatggaataaagaatacccgggcttcccgagctcccgaagggtacgatttttacacacacacacaaaataataataataaatctatatatagatttcttagaatactacaatttattttttatcaactttataatatttaattcgttcgtacgtaccttcaaataattatcacagatcatttagttattcattcagccactcagcacaaaagaacaggggagattatcatcgccttgaataacacaagaaataaaagaactgaaatctgattcgatggtgaaattaaactatgagcacaattgtttttgtatattttgttttcaatgaatgaagcaatgaagctagctgacgaagtgcaagtgggcaactgatgctacagtttccccatacaatgtattgaacagggaaaaaataggagcgagatatatacctaacatttgagaactgagatttcagcatacagactctacattttctgttagaagatcaggttccacgaaacgcctatccgatattagactggtcagggcttgaatcaatgaatgcggatcaaaaataatgcccgtctttccatcgtgtatagagtccacagtaacctgcaatatacttcataagttagcacattaaaacgacaatctcaatactgtttatgcacaagctacaatacagaagaacgtggaccagtatcgcgtacttctggaataccgacctacacattgagttttcatatttatcttgtgtaaataacagtgtgccttttttctaacatgtaatggataaatgcctaagtatgcaaaagtaagcttgtttaaccaaggctacagagctcaatgtgacccaccgtgcaaaatctgcaattattgtagttttatcatgtactccctccgtttcaggttataagacgttttgactttagtcgaagtcaaactacttcaagtttaactaagtttatagacaaaattagtaatatttatagtaccaaattagttttattaaatcaataattgaatatattttcataacaaatttgtcttgggttgaaaatatttttatttttttctacaaatttagttaaacttgaaacagtactttgaccaaagtcaaaacgtcttataacctgaaacggaggtagtagtaattaataagctgatgctagatatcctctttcattggggatgaaatgacggaagtaacatggtatcgcacacagaaaagccaactaggaaagaagcgttaaaatttcggagcatctcgaccattcattttctttttcgtgattgtttctcagtaaaagacctagaatctaagtattcatgtaacctttggctgtatatatccattcatggatatagaggctggattttctatccattctcgaaaatattacacagttaaggactcgatggataactataacatttttccacacattttacacttaatgatcactgttttagcaaacacaaacacttaccacatgaaagattcctttagaagacaagttttttatatccaaaggaatttggcctccttttggtaccaataaagcattcacatagtctttgggctgcacaaaatgaaaaagaagctgtcagatggaaaatcttcacacagataatgttaaggggcaggggcatatgtacatctttaactgaatcattcaagatgtggaccaggggacgctgatctgtgggatattcccatcctctaaagctagtaaatgatatgatgcataattc

SEQ ID NO: 64145 - DNA, 15591 bp, Oryza sativa
tatgtacaaacaaaaaatagagcagcatggttaccaatgatggacagactgatgtaaagagtgatcccatagcatatacaatgcagtccaccttacttaactgctccaaaactgtacggttagcttcaggaaatacctgcattgcaaggttagtaggaacagttaggagttttaaaacataaaaaagggttgtttacatatatactgttgtgaagtggctaatttgatacatgtcatcccaatatgcttacatggttataagtgcacacccttttaagcccatgatattcacaaaacataacagcctactatatgaaggagttgtcccttctcatgcctactaagcttagaaggagtaagcgtactctttaaagaattaagttaaccaagagctaaaaacccactattgatgaatggtatagttcacaatgttgtaagtaacaccatgagactgattagataagcatgataaatggaaatatagactacattttctgattattatatcatgatcattattaagaacatgaagatgtgtggtattcaagaaaaaaattttacgctgagaaattaaagtagaaaggctgaatcaattcttagagggactagtagcttttgttttaacaaaaatcaaagtcttacccaaccaagaattcatgatagatgtgcaatgaaaggttcagtctaggtggttacgataaaatgaatgtactaacctcatgcaacaggttgctgccttcacttgacatgtaaaagacacgcttaatccttgaaggaagtgcactacatgaattacaatccttttccaaaaataaaaagcaaaataaaaaataaatcagtgacagataaacaaatattataagaaatcaacaagcatgcccaggtaaaaaggagaaaaacatagattcaagataacatgtgaatcaatgacaaccatgccatgaacaaaaacggaaatgaagcaaaaatagccgatattgtcataacgaaatggagtttgcacaattgtaaatatcagtccaccagagaaggatatggcaacacaattttaaaggtaggagtaacatttttttttcttctatagcttcttttataagataaaacataaaaaagttgttccatagaacatattgaagtggccccagaaatgctttggagccttcatcgcaatgatgttacatagatcatattaactactattgggagtatgctgaaatgatttatagactggagtaccttgttaacaacttctttacgtccattgcttggatgtgatatttcattttgacctcggatgatagttccatcctgaaaatggaataatgtccaagatgattatatgtgattttgtagtaagggaatgtttgtaataataggagtaacattgtaaaacaaagacaatcatgccagttttcagaagcaagttggaataattaaagaaagtttataaggggggctaattaaactatcagtgaaataacaaaataaataaataaataaatggaagcaataaaattaaccaacataagaacaagaagaccagatcaccagagcagtccgaaaaatgaatctactggtttttttattgtgcaactaaaatactgataagtgatgttacccatagttcgcatcccagtgtaagcctgtcatttgtggatatcactggaagaacaagactttcagcagggatctgtgacacacgtgagaacaagaaaatcgcagcatccagagactggaagaatatgcgtgccccagcaaaaaagaaattcccaatgctgcaagaataaaaagctgtagtcaataacagatgtaggcaagatgggagtattgttattatgagttgtgaccacaaaaaatgccccaataccaagaaataagtattgccacaaaggacatccctgtcacgccatcgaattgagaagtggcaagagaccaacgggtgacatgttaaaagcaatcacaagaatatgatttactgcaaatttcaccttaaaagaatcacctgccattggtgaagcaaaacatttcagctgaccgtcgaagtatctgcacaaacgaaacgactgcaattatatgtcatgggcaaggaacgactgcttgatcatcagactgccctctataccaggaaaataaatcttggcaaaaaagaaaacagaagggggggaggcgaaaaatcatattctcttctgttctccagtcagaaaactgttcatttgaaattttcaaagcaaaatctttaagcaaattaaaaatatgctatgaaaagaaaatactacagaggaactgacctcattatggaagtagactaaaaaggcacgtattgtttctctgtatggctgtgagacaccatcccacaaagcgtgctctccttctacaatctggtacctgtcaagtacacaacctaacaacatcacacatcttgtttcatacataaaaaacatcagccagttacttgatccagtttgaatgaacaaaggtgagttttgatatgcaatagacagactaattgctaccactcaagctttgcttctgaaggatcaagaggcaaacggtgcccaagcaatgtccgaacagaaagggcttctgaagtgctttcatcagacaatctcaagcatcttgatctaatgtcacccacagcaggtccacctaacatttaagaacaggttggattttcaattactatacaaattgttatctcaggtagcaggtggtgtggcaagagatttcaacctaccaagcactcgcacaatctcagctgtgcttccaccatcatcggaaacaggaagaacatgtgcaactcgagtcgtcactttcttcagctcttctacaacaccattaaaagcggttcctcctggatagcgttaaatattagaacacaaaagtaaatgacattagtgcatcccttcctgtgccaaccagaaaaggaaaaaaggaaacctgttcattacacagatagggtaaggttgcaagtgccaagcgaatttcaatttatgaaatcccgcaaagtcgcaaaatgcataatccataagaaagaaaatagaactgtttaaacagctactctaggagcatggtatagtttgtgcaatccatcattcaagcaggatatatgaaacaaaaaattttgacatggaaattaaatgacatttcattattttcatccagcgctgcatggagatatgctttcgcagaacctagtgttaccaagacaaacaccatttagtgttccgtttcgcaggtagaatatccaggatttcagacatggctatcacaagaatttaagatgtgccaattatcaacacataaaccagggctatcggagcagcgttcatatgtatccatgccataattgtcatattagttcaacatccaaacgtgagctagaaaggagcacataaagcactggacactttccatcatcctagttgagcataccaaatcataaattgccacattgcgtcaaaatacatatcccaaggaggggtaagatagtaagatagtactgaaggatccatggcttgagtaaggaaaaaaaatgcacaaatgtaatttcgacaatttttgttcccaaactcgcatactcagtcacacacaaaatattatgcacagaatcgcccaaatcacagccaatcacaaatcacaggaacttcctctcgccaattcgaccaatccatcacgcgtgcccatactcgcagcaaggtatgggcacgcatcgaatccccagcaaatcaccgagaccccccggcgcccgcgcacgcactatcatacgctccaagcgatccaaattggcgagagcgggagagagcaagacgcacctgagaagacgagcagcgacgggggagcaaccgccgcagcggcagcgtcggctccggaggcggaggccatggcgcgggatctcggcagcgcgcggaggaagcagccgggagaggacgcggaggcccgcgcggttaggaggccgccgcagggtggcgtggtggtggtggtggcggcggcgagcaattgcgccatcggatggctgcgacgcatcaagcagccaaaaggcggagagcacggcctccaccaggtcacaccgagtaccactgccccaacgccgcgcgcctccttgctcctagctccccggggattgggcgcacctcacgtggcagcggaggccggagggccccatgcgtcgctgacaacatggacccagtgagcagaagcggtttttgcttgggctccggcttctctcatgggccgccgtcgcgtcacatgttgtgggccggtcggcgatgctgctttttccaaccagcttcgggcccgtgcgggcaaactccccaggaataagttcatctaaggtcccttaactttacactgagttcgatattcgtccctgaatcacaataccagatacaatgggtccctcaactgtcaaaaccggtgtagatgaggtccctcagcggtttagatggtggttttaactgatatggcgctgacgtggctagtttgacttagttctagtcctatatggcggtgacgtggtacttggaagcaaaataaaaggtgggacccatgtgtcagtttaaaaaatagtggacccacatgtcagtgggtcccaccatgctctctatctccaccgtgccgtcgtcctttcccttctccctcccagccattcttcatccttcctcgaccttcctcgccggccggcgagcgcatggagagggagaagggcgcacgtggggagaagtgcggagggcgccagccatcgggcggggagggtaggccggcatgcgcatgacgggagaggaaggagcggcggccagagctgcacgaccttggccccgccgccgacgaagactcctgctacgccgccgcatcgatctgcacgagttgcaatcttcatctacagctttgccttcaggccagttaggatttactatcgcagcagagacatatgacaccaccacaaccttaccaagtcccaacctttcttctgaacaagccttccacacattcgtcgtgcccgttacagcagcagcaagtgtatgaacctacaacaacatcaattcatttagctacaagaacatgacgatttaattacaactctgcagacttcagctactactggttgttgagaaatcaatagtttcgacaaatcatttttagtagaaactgttgatttttgtcgattttcagtaaccagtctacagtttgaaccagtcaatggagaagaaaaggaattattttgctgaaaaaagagagatgtgtgcccctgggttaggggcggagaggagcacggggcaggccacatgaaagacgtcgtcgcagccggcgatggccgccgccacgctaccgtagtcaagcaggtcggccttgaacagccgcagcctctccgaggcgacgtccagagacatcaggtgggcgttcttcgcgtcgccttcgcacaaatcatccgcacaagcacaccaatcaatcaatccaccagaacaagagcagaacgccatgaatatcaaaaactttgacgcatatggaggggattggggaagtgggcagcagcggctgcgactgcgagctcgagtcccgggccccgtcagcgccacgctgaccgtgtcccgtggctgtgagcttgccgtcgccgcaactcgtgcagatcgatgcagcggcgccggaggaggggggaggggggcgaggtcatgcagctccggccgccgctctctcgcctgccgccgcgcgctcgccggccggctagggagctcgaggaaggatgaagaatgccgggagggagaagggacaaggacgacggcgctggggagatagagagcagggtgggtcccactatttttaatgactgacacgtgggtccgaccttttattttgcttccaagtgccacatcaccgccacatacgatgaggactaagtcaaattagccacatcagcgccacatcagtcaaaactgccatctaaaccgctgagggacctcatctacaccggttttgacagttgagggacccatggtatctggtattgtgattcagggacgaaaatcggactcagtgtaaagttaagggacctcatatgaacttattccaactccccatgactcgaaagcccaacacggtaaagagttccagaagttatgtctataatgaagttgtggaaatcgctctatctagctccgctcttttttgtctagagcgtctggacttcaactccagaagaaataaaggtggagttacagctgtgctaaatagacataagttacgcaaagcggcaaaggcgatggaatgatcgaccgacatgatggccgggcagccactactcgagcgcgagcttcgctttgcccgacgttacgcgcgtacgcagacgagatcgacgaggcaaccaggccggcaaatctcaccgattctttacgcgacggccacgctcgatcgctcgctgatcatggccgcgcgcgccgtacgtgcgtgcaacgtgcacgtcgcgtgactccgttactatgtttgttctcaccattcgactttgctaattgctataaacatgcagatgatggcctctgtctctcccggaaaaaagacagacaccgtggcacgctgataattactactatctctgtctcatattacttatcgctttgagttttatttataatatttaatcatatatcttattaaaaaatttagaattattatttattttgtttgtgatttgctttattatcaaaaaatattttatgtatgattatcttttttttatatttgcactaattttttaaataaaacgaatggtcaaatgttataagaaaaagttaaaacgacatccactgtgggacggaggtagtagtgtggtcgatctgagtctcatgatgattgagaaaaatgcccatggcaaaaggaggttgtgaagattaacaaggcttgtgcccattcagctgacggctaaaagcgtgtgctttttctaatttttactctaacaacagctcatctactaccctactactactcatggatgcaggtccacctacatacgtactaccacaaggcttatgttatgtgtatgtactttggtcgcatcgatcggaagaataacgaatcaagaagcattcacgtgccacatcaacttgatcacgaactttgaatacaaattgaactatccaattatcatccatcaccaactctccataattactgatttggatacacgagaaagatataaatattctggtaaaaatatatactccttttttttcctaaaagtactccacgtatttgatagtaggaattttagcatcaaaattgcttcgttttcactctggaaggcataaacataacgttcttcatgattacagttggtgaaactgtactgcttgccactaagcatcagcggcagtataattgctactcacatgagtttggttgaaattgaaacgatatgacggaaaagttaaaagtttgtatgtgtagaaaagttttgatgtgatagaaaaattagaagtttgaagaaaaatttagaactaaacacggcgtacatggagaggaagcgagtcagtgactgttttcaagtgcacatgaaaacagcagcgtcccaagtgaagtgtagtgtgtacacccaaccaaaaacccaacctctcctcaccgaaagcaaccaaaccaaaaacccctcctcctccatgctttcctcgccttgattaatcccgtgctccggcgagctaattaaccctacaaattaataattactacctcgctttgagcagttgacctgtgtgcttctttgtggattaaactctcgtcgttagcgatggatcattccgccgccgccatggcgaacaagccgtcgctcgccgtcgcggcggcgtcgcggcagaggtgggcgctggccacctcgctctgcgcgctcctctgcctctccctcgtcgtctccgccggcctcctcctcctcggctcgacgcgcccgttccgccggccgctcttcgcggcgccgcagcagcagcgggaggtggtcggggaggcgccgtgggagaggtacgtcaagctggcgcaagcggcgtcgccgggcggtgcccgtgatcgcgcgcctgatcttggcggggatgagggggcggagggggacgacgatgatgccatcagcaccgcaccggcgccggcgccttcgccggccgccgaggagggaggagatgaggagagctgcgacctgttccaggggcggtgggtgcgcgacggcgcggcggcggggggctacccgctgtacgaggcggcggagtgcccgttcctgagcgaccaggtgacgtgccggcggaacgggcggccggacgccgagtacgagcagtggcgatgggagccgcgagggtgcggcggcggcggcggcggcggcggcgggagtagggaggcggcgctggcgctagcgctggagcagtgccggaaccggagggtggtgttcgtcggcgactcgctgaaccgcaacatgtgggagtcgctcgcctgcctcctctacaccgccgtgcccgaccgctcgcggtcgcgcgtcctcgacgtcgcctccgactacaggatcttccgcgccatggtacgtgcacgccaaacaaattactacccctccatttcatattatttcctcgattttatattacaaatcattttaattttttaacattttaaaatttaattaagtttttgataaatttagcaacatttatataaccaaattagtttcactacaattaacttttactatatttcgataatatgtttattttattttaaagtgttgctatatttttttaaaaaaattgattaaacttacttaaaaaaccaacgacttgtagtatgaaatagacacaaactagagggagaatattacacgattgatttaatccgccgatgagttttggcgattgtgtcgccagagttgaggtagtgttgacctacgggacaaatcagtcaaatcgaagaatgctctgtcggctgtacatgcgaaattacgggggtgttttttctttggacaacgtcccagaattagtgcatatgtacaggccgagttttcttattacaaggcatgacacgcaacactatccaaaactaaaccatgagatgcaacggccttcatattttccttactttatcagtaaatgttaaatagtttacactttgcgataagggaagcccaacttaagttgaaacaatagtatgaaacatgtattaatgtcctctatattatcattttcgatccgctaccagtctacgacccccctcgggtatcaaatagacataagtgaataaccgaaaataagacaaattctggacatgcttaggaaaattctgatgctccaactaagatgacacttgacgttgaatagcatgccaattgccaagtactccctccgtcccaaaattagtgcagccgtgggaatccgtatctaacatttggctgctcgtcttatttaaaatatttataaaaaaaatagtcacatataaagtattattcatgttttatcatctagtaacaataaaaatattaatcattaaaaaatttcaaataagacgaacggtcaaacgttggacatgaacagtgatgaatggtcaaagaagtacagctataggtatccgtgtctaatgtttgaccatccattttatttaaaaaataagaaaaatttatagaagttaaaaaaattatttacacaaagtattattcatgttttatcatctaataacaataaaaatattaattataaaaaaatttcaaataagactaacggttaaacgttgaatatgaagaatgcaaaactacgcttattttgagactgacaccatattagtaacaaggaaaggagatgaaagtgagagacatgatgggagaaagttaatagtatcaaattagcggattgaactactagtgtgtgaattgggaagtcaggttatgaattgggaagtcaggttatgtactaagggctagtttggtttggttccaaattgtgccctaccaattcattggcaattttcaatagtgtttctatttgtttggtttggtgtcaaatttttaacaacacatcttttagatagtaaaagttttggccatccaaatttggtagtgctaaaagttgcctaaactttggtactaccaagattttagtatagcaccaaaccaaactggccctaacttttaggtggcaatttaaaagctatatatttgagataggctgtgtttagttcggcccaaagtttagaatttggttaaaattagagacgatgtgactgaaaagttgtgtgtgtatgaaagatttgatgtgatggaaagttgaaagtttgaaaaaaaaaactttgggctatgtatcaactaaccagtgttcgtttagttatcaatccgtacatcgaatgacaagcaggacctttctaaagttctgattacatatgtgactcaaacatgcacaggactacaactgctcggtggagttcttctggagcccgttcctggtgacgctcgagacgaagcaggaccggacgagggcgctcaagcttgaccagctcccggctacgctggagaagctgcgcggcgccgacgtcctcgtcttcaacaccggccactggtggacccacaccggcaacctcagagcgtaagccactccgctccagagcgtctcctctctggctctctctctctccagcagggcagtgaagccgagtgtgttactgcaggtgggaccatctggaggcggacgggaagccggtcgagatgggaggcgaggaggcgttcaaccaggcacttgggacatgggcgagctgggtcgaccaaaacgtggactcggccaggaccagggtcttcttccgaagcatctccccagaacacaagaggtaaaagttaacttgcaccacccgcggcacccagccacaatggacacctctgatgactgatctaacacctgcaaatgcagcgaaaactggtgctacaaccagacgtccccaatcacggacgagacgaagatcgtcccatggttcccgaggggcctggtgtccatcgtcgagaggaacatccggagcacgaggacgcccgtcacgtacctcaacatcacccgcctctccgagctccgggtcgacgcgcatccgtcggtgtacaccatcaccagggaagggaagcccctgagcacggagcagcggcaacagccgctggtgtacgctgactgtagccactggtgcttaccggggctgcctgatacctggaacctgctcttgcttgcctccttggcgaggtctccagttaatgtacactagcttaggataaaagagataatacacagttttgcagctttgcaattcctggtaatgaatggcacagctgaggataaactaaacaagcacagcataggcagcatcacgcatgcaagttcatacgacgagaaataaacaagcccgtcagtgtgtcaggaatcaacactgcgtaagtttgtagcggcaaacaggtacaccaaaatcgtggacaaaacaaatcagcgccacaatgatagataactagcacattacaattatttaattatcacagaatcaaaattcaagaatcaatgaatacatggagcagcattctcatacgatgagtattatttagttcgcgtgccaattttttttaagtatacgaacacacatttgaagtatcaaacgtaaactaataacaaaacaaattacagattccgcctgtaaactgcgagacgaatttattaagcctaattaatccgtcattagcaaatgtttactgtagcatcacattgtcaaatcatggcgtaattaggctcaaaagattcgtctcgcgatttacataaaactgtgcaattgttttttttttcgtccacatttaatgctctatgcatgtgcccaaacatttgatatgatagaaaagttggaagtttaaagaaaaatttttgaatctaaacaaaatcatggtgattgaattgcatacagaagttgcaattgcgaatagcaaaggcagtagtgcaagccaaaataatttcagtgaatgcaaaagcacaaatttgacccccaaaaaaaggggagcaagctgctacactccaagaaaaggacctaagaaagatgcccctcagctcaatggcagaaaatgttcaaactctcacgtaacagcaacaagtcatgtgattgtacacttgaaaatactcctaacaaacgcatgcaatgtataattatgtaggagtacacaacatatgttgaaaactaactcacaagagcacagtacaagcatatatagtacagtctgacaaaatgagaaattatcagtcgaagcaaaatgtgtaatgatgcaggagcacaacaaaagaacgtagtacagtctaactatctaagaaagaatcactagaagcaaaacgtgtaatgatgtagatgtacatacacaagaaatgttgaaaaccaaatcacaagagcacaacagaaccatatagcgtctgaccatagaggaaattctcactccaagcaaaatgaagtatctagcaacaaggatggctcgatgaaactacaaatgctaggtacaagagttggggatggaagtgggtaagtacaacatggattctttcttactaaagatccaactcagcagatagtcatatcaaaatacaggaggttttctaataaatctgcacgtatctgcagatggtaaccataaaaaaaaaatcctgaagtcattcagtaaaactgctgttatatatagctattacaaaacatcagacacatattgataacaaatggttcgccaatcaagttgccaccaaataacatgtcacgcaaataaaccaagcaccagatgtaatcataagtaactggatatcataagacaatgagcattacacaacaatgtgaaacgacacctcacatatttatgagaaagtacatgtctaatgaagagatctcagaaaacactaagctagcttgaattatcttgtaacagaaaaattgagagcaaaaaactgatttccatatcagaggcagccagaatatgcaagacatccatgtaagcagacaacttctgaattcagcacaaccattcaaagcatatgctcccaagagttgtcacacacctgattcacacattcactggaattcaatcaatagttcaccaattcacaaatatacaaacaaaattaagataatataactttaaagtaaaataaaagatatagtattgcttaatacatcaagctcaaatatcacaagcctaatcctaaaggggaatgccatcaagcacaactttgaaacttgagaagaaatatcaagtgaagtaaagatgcataaatattgataacaaaaaaaaaaagaaataacaaagaaataacaaaaaaaaaggattcatgatagagaatattgattagtcttattatcttgtataaaaatatggcaacttcaaaattgcaaatgttttgagtaaaacaataagctgcatgccaattatgaagcaaaaaaggcaaaaaatgaaacaggtagaatatcgtcaaacagcaaaccaggcaaatggatttttaaatgtgcttgtattgcgaaaacatattcaggagtaacctacaaaaaatatccacaggccagagtacccaagaacgaacaatcatatgatgtactgcaaacaggcaggattaacagttttaagccaaaaggatcatactttattatatatactcaaatagcagatcaacctcaaatttcagacagttgccttcactttaacctttcaaagaaatgtggtcaagtatataatgcaacattgtccgaccaagcaaattaccacacaggtacgcatgatatagcattataagaaatcaaataccttgaatattacaagacagtccactttggatgcaaattagagtccaacactacaaaaaacacatgaacaaataaaagcaacacaggcactgaaatcaactattgcaacaacaaacaagagcaacattttaccaatcaagagtgtgtaatattactatgaatgtattatactgaaccttgatgctaccaaaacaaggaacacccaaagagatttctcagcataaaaatatacagaacgaagtaatcagcaactagagcacattaacatactaaacctatattgtcagaagtagcatcctataaattctgcactactctattgccccatatctctacagactgtcagtgtgtaaccagtgagagtttcttacatatcactatttcagtcacatacacattcacataaatgcaaacacagcatgcagcaatcacaattcaaacacaaattaagttaatgttcaggcataaccacataacaagacaattatcaagcatttgggtgtaaaaagcctaagggaatcaggtacaaaattcaagacacggaagggttgcaaaaaattacctcagaaataaggaggcacattggggtacataggagctctaccacctggtccaggtgacattccaccctcctgaccccggaaaccaggccctggaagagggtagttaccctcaccatacccgccagaaggaagcccacccgaaccctgttgcatgcggtacagtgatgaggctccacccatgcctagacccccataagcccccatcccaccagcaccaaactgggatgagcccccaaatgaaccaccacccaatcccccaggcccgtacgcaccagccccagcaccacccatcccagaaggcatctgattgcccaatgaacccaacccagctccgccgccgcccatggaagatggcaaattcgcatacggattgggaccacctagcccagcgcctacacccccaaatgcaccatacgaagacagactcccagggccaccatactgcgcacccatttgtggtccaccaagcccaagccctgaacccggcatgtccggcggcccgccttggagcatttggggcggctgagccccaccaggtccagattgctgctgctgctgctgcgattgcttcccctttttcccttcgatcgctagcttgcagacaagctggtgcccgtcaatcaccttcaccgagtccactaacgaggcctgcgcaccctcgggtgtcttgtacacaaagagggcaaagccccggaacttgcccgtctgcttgtcgaaccctagaggcccctcctcaatctcaccataggctgcgaaatgcgcaaggaggcgctccgacggcatgtcggcggggacgttcccgacgaagatcttgcggagggagacgtcggccgcgggggcgccaccggcgccggcggccccgcccgacgcccccccggccgcgccggcggcggcgagctgcgtgacggtcatgcggccgtcgatcttcttcgagggctccttgagggcgaggacggcggagtcggcgtggcggaacgtgacgaacccgtagcccttggagcggccggtggacttgtcggtgatgacgacggcctcctcgaggtcgccgaaggcggagaagatggcccggagcgagtcggagttggtctcccagccgagcccccgcacgaagagcttgcggagggccgggtcccggtcggcggcggcgcgcacggcgtcgagggccacccccgaggcgagcgcggcggtggcggcgatgtcggcgagctggtcccgggagagcggctcgacgaggcggaggaggtcgtcgcgg

SEQ ID NO: 64146 - DNA, 1988 bp, Oryza sativa
ggggggaaggattcggattcgacaagggttgggttggggtgggatcggtcgaggggttttatcgggtcaggccggcagccgcaggatttctggacacgggcatccgtggtgtccaagccggacgcgtcaatgacttgtctaaaaaaggaattatagttatagcaagtacaatagcagactataagctagctgtaaataaatatattttaagaaaataaatgagaagagagaaaagcagcgggctacagatttatagccagctgtagcatggactccaagatgcagtgagtatatgacagatgagaccagatattaatagtgtagtatgtaactattgtatgaataagctattagattggctatatatgaattggagctagtagttggctatactgttaaacttgctcttacccttatttgacttataaagtttgtttatctgaatttcatattgaaaaaggctcaaattttttttagtgactgggtggaacatacgagaagatgagaactccagaaaatcggtataattttttttaagttttagtttatctattttctcgtatatgcaccgtagttcaaacttggatgctcgcattcatagcttcgtccctaatagtacattgatattaatgttagtaaaataaatagtattatattttattgtggtttgtcatacatggaagtagtggagtttttctatggttgttttacttgtcttttctgaagactctagaacgtagtatgttttaaagtataaatttaatcacgtgcatagaacttagaaagatggccaccaactatggggtgttgtaaatcctaggcaaaatatcgataagatacgagacgttatgaaaatagggtagatattaattgaaaattttcaactcttctactttgcagtaaagaaactttgtttgggattgaaagattaagcattggaagtgagaattgtgactattctttaaaaaagtgagaattgtggcaattgttaactagggaaccaggatgttaggttgggatttacaggtcgacttacattaaaaaaaaagaagacgtttcaagaaaacggtggttcaattttctacttgcacctaaacactatcacgaccaaggtgagcagcaactatattaatgaaaccaaggatacagttactgaaacttagtatttgcctgttccatcgtactccttaacaaaatttcttaaaacaataaggaacatatgctcaagtagttttcagatcaaacatgtcgatgatattctccccatgatttaccttgctgactgaatagacccaagtagcctgtgtggaactacaacagcaagaccacagcgtttctgaatctcgtttactatcctgattatataactttgttttctaaatttacaacaagaggcaccagtggtctagtggtagaatagtaccctgccacggtacagacccgggttcgattcccggctggtgcaaaatcttagtttttgagattttgagttttacttttgcactgttcttggttcaagaacaatgctttgtgcttttgtccctttgtcacctcggacaattgacatattaattcggataatccacaggttgagttttacacttcttgatggtcttgtgtacgctttacaagttccccgtgtatgtttccatggttgcttttgcgtgacctttgatataggactggtagccgggtggacattaccagaaacttcatccatgattgggttagtaaactttctttttacaaaaaacccatgcatttttattgatagataattagatacatattgatagataattagacacatatgaagtttatccctagaggggagttaactgcgagtgcaagcacttttgcaaaagaccctcttgaatatggtcaaattaacataagctcttgaaattcgtctaggactaactatgaaactataaaaggcaatcaaatctttctcttcccaacaagatagcaagctagatccatgactg

SEQ ID NO: 64147 - DNA, 9704 bp, Oryza sativa
atagattaaatctcaagcaccaagaaagtagtacaacggtgcactgtgcacacaacatttggctatattttaaggttgcaaagtttatgcgctctgacgttttacctgattttaggactcgtatcgtcgctgacactgataaatctcgactctctttttgttactaataatgttcttttcatttttttaataagaaaaagtcctaattaccctctaactggctcatcgttctttaaactttttatgctgacgagattgccacatgcgcatcacgtaggagtaggaccaaaaccgctctagatcaaatcaggttgggggatgtcatctgtccggtatgaaaatttgggggtgtctggttttgtggttttgtggggtaaatcgtgtggtccctatagttagggggtagttcagtccttttcttttctaataatgaactaacaataatgttttaaattttataatctttacagttaataagctgtaaggagaaaattgattttatgccataatatagttgaggatcatctctgtttatctaaaagtttattgactctaaaatgtaaaaaaaaatagagaagatgtccacttctttttgtcacaagtaacacttatacaactaaggacggatatatctttcttcctcgttctcccgccaattgctcaccaatctctcagcgtgtagtagagcccattttcaaggttggcaaaacttggggatggggctaccggacataagatgtgagaccaacaaagcatacagacgtagtttcaaagcttatgttggattgcagaactcaagtctagggctaggcagtgatgctcgcgcacaaagccatgaagcttgagcacaataatagggcttaggggaaatcgattagcagatctaaagaccggccacatgaccatagagctcgagtggtgagtgcggaccgacagaactcatgtgtgtgagtgtggagcttgagtgaagcggtcaaagcttgcactatagttatcaggattgagcaccagattgatggtatgtgatgatcgagctcggtgcgaaccaacttgatagcattttaggtgtcaataaactttacgacaaatggaaaacgatcatttacagtattataaaagagtaatttcttattatcgtgcggtattaacccgctataaactgaagagttgtaccgctataaaatctcacattctaaacaagtcatgggcaatgcgatcatattttcgcttatgcttataagacaaaatttgttttttcaaccttaaatttagagttgattataagggttttttttatcatagtttatttttcagtcgttgcttttagatcgtcaagagcatatatatatatatataaattttattcacaaattattttttatttgtagatatattgtatggtttattctcggaataagccaatggagccggacatctctaatctttcaaattgagccgaatctaagcaaagggtatataccgtgaccctgatcgccacaccgaccggatacgtggaatgaaacccaaaccggaagcaacaccgatcgatcgggtcagccgaacacgaccgcaacaccgcacctaaacccaagaccaaacaggcgtggccgaccccgaacccgacgcaaacctctcccctcttcggcacttcccttccccaccttcctcctctcccaccgctctctctctctctctctctctctctctctcagtctctctcccccccaagaagaaatccattcctctctcacgcgcctccgcgtcgccgcattcggggacgcccaccgccgccggatccggccagccttcccccctccctcctttccccggccgctcccctcctcggtaagatccggcgccggttccatgtcgagcaccggcgagcagtcgcaggcgaaggcggaggccgaggaggcggtggagctcgtgctgttccaggtcgctgagtgctacgtctacctggtacgccccgtgcgcccccccccctcgccgccttgttcttcctccggtttgtttgactgtttagggtgtgtgtagtcagtgacccgcttcgtgcccccgtgcttgtgttctcttgggggcgcgcaattcgtcgagcactatgtgtgcgtgaacgtgctaatgttttttttttaatcctctctctctttacgcagatacctcccaggaagacagccgcctcctacaggtatatactagtcttggttcatcaaaaaaatcccgatagaaatgggcttagtaggattcacatttcaatttgtccgcgggagcaaggctatgtagtttgaaggtttgactgtgtgaggggctagacagatcaaagataacaatctgaattagctataggtcgtcctgtttcgagaactctcgttccattggccctatcgaatgcggcaatcttggattagctcactccattgttgtacttgttctgttctgattttggtatgaccttatgagccgagagcctgagtcacattttttaaaccgtgggtatcaaccagggctgatgaatggaacgtcaacaagtgggcttgggaagggactctcaaggttgtcagcaaaggagaagagtgcatcatcaaactggaagataagaacacaggtacaaaaaaaatcacggtagtgccgttggtcagtgcttgtgtgatcaccaatgttgattcctcggacacatttttaggggagctgtacgctagggcattcctcagagaagacgaaccacatccggtggaacctgttattgatagcagcaggtctgcattttttccctgccacatggtggtttaatcctgtggtgacttttgtccttagtgtttctattctgcataagttactatgtagagactgtataaagataacctgaaatgattgttgctactccaacattgtttttgcagatattttgtactccgtgttgaagagaatataggtgataagctgatcttctcatgatttttatgactttcttgtgtcttaatgttttttccattgagttggtgatcatagtgttgaggtggtaagcatagtgtttgaagtggcttatcagttatcgcattgatccatacgtagaaatatattaagttattaaaaaaatcttaccacatattttcagatggacgtcagcgccatgcctttattggtttaggcttccgtgaaagacctcaagcatatgatttccaagctgctctgcacgaccatatgaagtatccttgtgttcattacttgaagcatgatatgtattcgaatgttctcccatgtaatcactcaatggctggggactctgtatgtgaatttgattcaattgcagtatcattaaaatggtctaacatgacattgatttcctgttaacacgcgtacgtgtgagattattattttgaatgttcaaccattttattattaaaaaggtctaaatgaacccaaaaaaatcctctacccatacaatcaattcataggatgtacttttttgcttgccaattatgtttcttttggtcggtcagatgaaatgtttctgtttttggtcacaatgaattcaatttgtatttcctttttgcagttgtagttgtgtatggtaatatttttatccaataagttctttttataacggaccattttccggtatgatttgttatttcttacatcatcaaagatatctaaacaagaaaaagactgctgaagagatggtacaacactatgagaaatcatcatcagtggattacagcctcaaagaaggggaaactttggttttgcagctaaaaaatgtaagttttcatgtgtcatattttggtggtcaaactagagattggtgatgtgaaattgtttctgtaggccttcatgatgtaattgttgttttattagctcagtactagagtattagcatcctacctaaagccactagagctgcttggttgctaaagtaattacacacaatgttattagatccagaccagacattgacttgtccgaggacttggatcagtaagtaagaggttgaatcgcttggtcaacgggtctcagaccacatgagcgtactacttcttgtgctattgtaggcgtgttaacagctagtagaaacaagcaagtggtgttagccgagttggtttgcccatgcaagcaattagcaacatcttttgagtttgaattccagttgtcactaactacttttgcaaattttgaatggctcgttacctgcctaggttggtctggtgggctaagaaaccggcggttgaaccgggattttcccttgtcagctattttaacggtcccattggccagaacagcctggcccaggtaccaggtccagttttttctggctgggattttctgatgtttggccttattctttctccaattccctaggtatttaagaacgatagttgtctgttcttattatcttgattgtattaccattttaaattcttaatctgtgtattcactcataagatgccttatatattgagtaggaagtagttcaacatttggtttcacaaacataattattatgaagttaatttttgtgtccactccaagcattgacacgcataaattgtcaaaccgtgaaatttattaagatgaaaatattatctgtgccaattctcagaattatcagttgtaaaaaaaatatatcatgacaaccaggtttaccatgcatatgacaatgcctattcatggctcgaagatatcaacccttatacggcatgtgtgatgaacgtgtcttaagtacttttgtattcaaacaaacttgttttaataagtttcttgtcttgttgaaatgaagctaaccgtataatggtttacaggatcctactatttctcagtaatattcatattagattattttgctctctagactattttccatgtaatgtgttaaataaaactgcatatttgtagatatatcagtttgagctgctcttacgtagggatccatcttagccttattgaacttaattgaaggatatttgcactgcccctacgccagatttggcacatcatttgagaaataacctcttgacgtctcttctgatttttgtagttatatgcttcttgtgcaacatctccttaatgtttgggtttgcttttgttctgtgcagaaagagtccggcgcaaagataaaatctgcattttttgagcaaggcctcaacaagctctcatttaacgaaaaagccaactccaaggaggccccagtttccctcaagctccctccacctccgccatcaccggtctctcctacagattctggcatcgcggcttctccgttcaaagcggagtttccttcccaagaccaaccagctgctgatactggagctgataccactcctttcaaagcagaatttccttcttctcatgaacaaccagccgcggataacgtcgcttcttccccaccaccgaaagcagaagctgctcctcaggagcaaccaactgcagcagagaaggcccctcaagagagcgtggacgacgacttcggagactttcaggcagctgggtgaatcatgtatcttgtacataccacatgttactcaaattgctcctttgattttccatgttccatcagttgtgacttctgccggcacatgagttgctgtacagtacagagagctagtaactatcttgttataatctataaaagaacagatggatacacaatatacctcctcttttgctgttgctgtccagttcttctgctgaaagcttcaaagttatttttgccaccgaatccgtagagtaagtcgggatgcaatccgactcgagctcagctccggactcggagcaataaaaggagctcgtgcacgggcacaactcgagccaagccaacctgtataggagatggaggagaaggagaagcagcagctggccggcgacggcgatggcatcgcctacggcgaccggagcaaggaggaggcggaagagaggaagaagcagaggacgcacgcgaacgcgcacgccttcgtgtgctcgctgtcgctgctcctggcggcgacgatggcgctcatgctgctgagctacggcggctcgccgctgtggctcgcgtcggagctggccgccgtgctctgcctcctgctctacctctgggcgtaccacgtcacgcagaacctcgcggccggcgccggcgccgccgtgcccgtggaggcgctcgtgttcgcgttcccgctcgtcttcggcgccggcttcctggccgcgctgctcgccgtcgccgtcgcccccgtcgccggggtgctggtcatgggcgccgacgtcgcgggagtttctgcgttattcgggttctgcctcgccgagtacttgcggcacaacgaggcgcatgcagccgtcgacggtgcagctccagcaagcgtagaaacatagaaaacgatgcgatttaacacggggacaacgttctcttttggaattgagaatgggaacaacattagcattgaatattagcaaagtgtacatttttttcccctaggttacaattgtttgttgcaccagagattggtaatgtttacactgtgatttgctagttggttaagaagaggctattcgagattcaagaacgccattctcatcgtctgatggactaagtatgcgtatgaattgtatttacacgtgttaacatcatgaaaaaaaaaacatgcaacacgtcatatatccatctcgtcgtcatcgtcaacttcatcaatccactcgacctgagaataggccgctgatttcatcaagtcagtaaggccggtgaggtcttccagataggttggttcgttgatcacctgcatcacaaaatccatccctctcctatggtattcagacaacacctgcaatattttgcaccaaatcacatgaggaagaagcaatacaatacaagaaagaagttctaaagaaactgttccaaatcatgcaatcataaatgtttacttactgcattggaacatgcggtacaattgctcgaggaatagcccaatagggttagtaagttgtactgcgagagtgatcctcgtatctgatgcggcaatagaccaagtggaccctcactgcttgtgccagcaatctctcctggagcatggatcctgcagaatgtagtaaagatcaattaaatgcagttggtttttcaatcaccaaatgccgccaacattttccctggaaatgatatcgcgcaagttcatattatgttcaggtatccagtcacttacccatctggatgatgtaacattcttgtgaagaggtctgccgcacagccagatgtaatggaggacaatccaggccgtgttactgtacattgttgatccagtgttcggttggacacggactacatcacaagatggttaaggaaaatgatgtgacagttgcagaatgtagcatgttaagtaaaaagagtataatttccaaagtttaggcaacattacatcaacaggagcaacgacgtcattgcagaaataacatcctagtctctgacgaccaagaacatcttctgcagacagtgtatcagcagcagcaaccacatctggacttccacaattcgtgcctggaccagccccatgtcgcatgacaaggtaactgtcatatcctaatgctgcagtaatagcaatctgcggtgcgagggatattatcatgtaacacttcacaagtctacattagtgaagaatacacacaagaattaccttgttttcatttgcgcagagaagtgttggaagccacctactttcccttgtgtcggtcagcaagaagacagcatcatgagaagataccaactcctggaggcgtttgcaatcttcaagcacactgactgcttcattaggtgatacaggatggcctggcattggtatttccattttaattccttttgcatcctacaagggaaatatgctcagacatgaaagggagcaagaatgtgagaaaatgaagattgctttgaaggaacagaattgaaatttaccactgaaggacatctctctttcaaacgccctagtattgctgatgcttttgggctgtcacgatcatcagatgtgtagagtgactgtcttgccaaattcgacacaacaactcgaccactgtcaactactgttagtttccgcacaccacagtcctgaaaagttttgtttccaccatagtcaaagaaatgttttgttaagtctgttcgtagttcaacataaaagtagaactggacaaagactaaccataagaatacgagcaacatcacatccaagtgttccagcacctaaaagtagacatcgggcactggacagcttctctaggtttacaggaatgctggccgaagttttagaaacaggaatgctggctgaaattttagaagcaaatggttttttcaaatcagatatgcctgtaaggtctttcaaatatgttggacaggtgatggcctgcgttacaaaatcaaatcctcttcttctatattctgataaaacctgtaatagcatgcagaaacattagaataaatagaattatgagaatttagtcctgcatatgttctactttacgtacagcattggaacatgcaatacagttgcttgaggaattgcacagcacagttgacaagacacactttgagagcgatccttgcatctgatgtggcaatagaccaagctgatgctcagtgtctgtaccagcaatatctcctggagcatgaattctacaagaagtaaaattctataaggcatcatcttgtttttatgttctcatgtactaggtcaaccaactattcaactatcacagacaatgctatacaaatgtatgttgcactttacacctatctttcatgtaggtatacttactcatctggatgatgtaacatcctagcaaagagctccactgctttgccagatgcaactgaggtcagcccaggtaatattactgccgactgctgatccagtgctccattatgatctgactgcaaagaataagattaagcataccaaaattatgtcataaatgcaaaatcacgcgataaaacacaaataaagtaattttccacagttatacattaacaagggaagtagtatcactgcagaaacagcagcccaatctttgccgaccgagagcgtcttgtgtggacaaattctctatctgagcaatcccttcatccatacctccactttttgttcctggaccagcaccatgtcgcatgacaaggtaattgtcatatcctaacaacacagtaatggcaatctgcagcggagccaactcattattagttccaactcccaagggcactctatgtgatgaaaaatggaaggcgaagaatactaaactgagttgcatggtcaatctattgacagatttgccactcaagcctgatctcctaaaagtgcatgatattcacttctctcttatgagaactactcaaaaggtccttaattacagagtggttgtctacgatttaccttgtttttgtctgcacataaaagagttggaagccacattccctcccatgtttcattcaacaagaagaccacatcattggaatcaactaatgtttggagacgcttgcaatcatcagtaatacttgatattttgctggcagaaatattatactcaagctttggtattcccatttggatgccttcaacttcctgcatgatagcaattgttaccgatgagagaaatatgtaaacaacatagattttaagataaggctgcaaagactcaccaccgcagaacatctttcttttagatgtgggactattgcagtcactcttgggacaccacaatccttatcc

SEQ ID NO: 64148 - DNA, 8247 bp, Oryza sativa
  unsure (1)..(8247): unsure at all n locations
agcacccaacaaaagacaacggaccccagctaacttgtcaagattcacagggaagtggcgccatcccataagcttcaagtgcatcagctgtttttcttcatcttgactgtgcttattaaagcaatcaaaggtaattcaatcaattactgattatttccaaatcccagaaaaaaatgttaatctaccttgctggattaattgaagaaagatcaatttctttcggtttcatctctttcgattccttcccggccgtttctccttcccatccaattgcttcaggcacataatcaggttcatcccagcctgctattacaaagcataaccagtgtcagctttaaaagcttccaaaattactagttattttgataggatcccccctccccctatttttttttctcagatgtacgaaattaccatgaggtgccggaaatgatgcttcgccgacaagggactgctgtatgtcaggacgtcctcgtttttctcggtagcagaaaaaatgaactttctcaatcttccaacgcaggctcacgaatgcaatataatttctaagagcccatccaggaaaacctcgattaccatgatcataaaatccgaatagcaactgcatcagcaaattcaaccattagcacatgaaattaaaggtatgcatgaagaatgataggtaaataaggagtcttctaaatcacttgtcagaactcatctggtaaaaaacatgaaatgacaaaatgtattgcacaaaacagaccttctggccattgccctggcaagctttccaatccttcagctgtcttatagtagcagatgaatctggggatatattgatcagaaagaatggaacaactgcagaaatttcaatataatacagtttaggcatcaagtgacataaccaagtaaaacaatcccaattaggtattcatctcaaacctgttgtttcacttgatttacgccactcagtaaatgcattagacaaggatgttgcctgcagaaatagaacaatctttagtgccaacaaggaaatggtaaaacaagaaaaatcttttgtcaactgtaattctataaggttcaaaggaacatgacctcttcttgcttaagcacttgtgaggcaagtttcaagctgagcaaagttatcttggagtcaaaaatcaacgaggggaatgcgacattgtaatatactttccaattcttcagatcagcaaatgatatcacaaggaaccttagtagcaaagcaggattctcttctactttgccagatttaatatcatgcaagatctgcaacacatattacatgctttaatttttttttaagaaactagtagtgttagtggtaatgctagcaaaattccatgtcaagcatgtaccttctttgcttcagctttcagtagaagtgctctgtccaagttttggaatcctctcatgttattagtgtttagtagggtccctgggactggacaattgttcctatcgccaaaggaattggcagaaggtggcagtatcgattctgggcatatcctaaagaggcttgcaattttctcatattggcgtggagtataataacctagcaataaagttcagcaaacttgttcagttgattgagaaatcaaaccatgaaaaaaccattcacacggcaacacatggacgaccaaactaaaaaaccaaaatgacctagcaaaatttgaattatatttgctaattgctagtacttctcttaggattctcaacagacaatctgaaatacatcactgtttgggtgctaacagcaatattgcagaaagagcaatcagtaatgacaacaaacagtagggcttcgggctagaaattgatcattaaacaacagaagaagttctaaaatccaaattactatacacccattacgacgacaaaatcatgaactcccgcacggagaccaactcaatgtggcattcaggaaaacctcgtatcgccgcaacctctccctaaacaatattccgctcacaaaccaccaactcaggcgagcgaaacccctaatctacaagcatccacactcggcatcgccacccataagcaaacaatacggctcttaacaatcgctccgacgaaccaccaccgcgtccgaattccatgggggaagcctgggagacgcggggatacgcacgcttcccgttccccgctcgagacggcaggttttcggggggaagaaaacatcggaactaagaacaacaaaagcaaaggtaggggaggaggaggaggggttcgcaccggtgatggggatgggggagtcgtcggtgccgaggacgtccagcttgaggcggcggagcgcgtcccagaagcccgtctccgcgcagacgccgatcgccgccgcctgcagcggccgcggcgccgccgccgccgcctccgcccgcgccgccatcgccgccgtgtcttctccctccgccggcgctgcgactgcgagctctcccttctttttttttctctctccttcgaaattaaaatctgtaaactgtaatcggatggttgctttggcgtgtgtataaaaactttggaggtttcgtttcgtggaagagttcgattccagctaatataatacgcctagcaagctgaggtggtagtatgtttacaattgtgactggtgaggcagtatgtttacaattgttgggttttaaattttaatttgagaggcaattgcttatttaaccctattatgaaatctatctatcaaattgaccctactatttaaccctgatttttgaaaacaaacaccccgtctgaccctgcttctacaacaccgttaagaatcatttttttaaaaaaataaatataataaattttcgtagtgaccgaaataccctccaaccttatccacatctctgtgtatcccatcccatatcattctctctctctcgtatcccttctctctttcccccggcgagtggcggcggcaacgcacggtagtaagcggtggcaccggttggtagagggagggagcaccggtggcagcggcggaccgtggagggagggaggggcatggatctgctgcggtgccggctgtggagggagggagcaccggcgacggtggcaggccgtggagggaggtaggggatccgcgcagacggtggttgcgtatggcggcggtgggagtcagttgcggctgcttcgcggggtagcggtgggaggctactgctgagcggggcggcggcaggacttggccgcggctgctgctgagtgtggtggtggtgggaggcagccgcggctgctgctgatgcggcagcggcgggactcggctgctgctgcgcgtggcggcggaactcggctactgctgctgcgcgtggcggcggtgggaggcggccgtggctgctactgagcgcggcggcgacgggactcgactgctgctgctgtgcatggtggcggtgggaggtggcttctgctgtggcacatggtggcagcgggatgtcggcggttgctggtgtgcgcggtggtggtgggagcgcggattcagctacaactgtgtatatgcttccttgaatttgttggacatgaatttggttgttggttttgactttaactatgtatattcttccttgaatttgttggacatgaatttgttgttgtatttgactttaactgtgtatatgcttacttaaatgcaattttggatcacaaaatacgataatatgctgttgaaattttttaaaaatcttctataattgtgtcaacaatctgtcaaaattgatatcaaatttatcaaattgaattgttcacctcaattcttcaaaattgataacatggtcaaataagcaaggacaaaagagataatttgtccatagcttaacaccgttaactcaccttaacggattagggtcagatagtacattcgtttttgaaaagaagggtcaaataagcaaacttcaaaaaagtagggttaattagggttaatttggtagttaggtatcgaaacagggtcaattactaaaaataagtaattgccccttaattttaggaccaattttgcataaaccaaagaaaaaaaatcaaaattttgccaaacataattctgcaagtgtattttacaagacatttaggctctttgatttaaaagaaaagtataggtattttgtatttttttaggattataatcctatataggatttatttttcctatatgaaatgatcttgatgtcgcctagaggggggtgaataggcgattttttaaataaatgcgaaagctaaaacaaaacaggatcggattgtctgatatcaggtcggatagtcctatgtgatcagatagtctgaactgagatcagactatctgacctgcacaacaacaatacaaacaagagaacaacctaagagctctagattcaatccacaagcaaagaggtgagctcgaccaataacaatattagcatagcacaaagcaatggtacaagaaggtaaagagagtgagcatatcaccgaggtttacgcgccaatgtatttcccggagttcaaatccttgaggggattctagtctctgttgaggggctcgcaaagagccgggtctttttcaaccctatcctcgtgaggttgcacaaatgcactcctccttccactaagggtatctcttttcttgcggaggcgagatccggccttcacaaacttctcttggccaaccacacgtagatcggtggcccaagaacgacacctagccgtctaggaatcctcaacctccaagagtaataaacaccacacgactcttggacaaatcctagtgctcaagataaagagaaacacacactaggctcccaaacaccaaatccacacacaaagatccaagtcacaaagaacaagggggatttgagatagagagggagagagctcaaagatccaaagcacttagcacaaagctcaacccaaagcaagattggaatgaaatcagtttgggcaaccctagaaaagggttggtggggggtttatatagatcccccaaaatgtgaccgttggaggggaatctttcagcccacgtcggatagtccgatacaagatcggataatccgatattttaaaccttcaaggcaacgagaaacagagaacgaagttccatgaaatttcggactttccgagacatcgaactatctgatgttaaatcagagtatctgatattttagaagcaaaaacttcgtcctcaaacagagactcaagttctatgaaatttcggagtctctgtatcatcgaactatctgatccaacataggatactccgacacttagaaaaactcactcgaaaggatttttcaaacaaagacagagaatgaagttctgtgaaaaatcggatagtccgatacatctgctcaagtaaaaatgcaataactttttactccgaactccgatttcgaagatcttggactctatggaaagctagtttcgtgggctatcaaacccaatataaaacatggtccaaaaccttcaagagatgttgaaaaacttgcaatgaaacccgatgtaagtgttgtgacaagtgaaacaactcgggattaaaattttggcttaggtttttcaactcacacaaacatgaagcattttgagcactagtattcaaccaattatatgcatgtggtatccctcttaatagtacggcatcctaaactcaaatttaaaaagcaaagttataccaataggagtaccttcacaccatattgtttcttcacttggagggttaccaacgtcaaggtcatttgatcattgggaagatctcatcttcttgatctttgacatttcatcttccatttctcaaatgattaatacggataatccatggcttcaaatggcctcgcacggttcatcacgacacagtcttcactcgcccttcaccaccggtttcggttcgtcggcgctaagccccttgcttgcccttcaccactgcatggtccattgtagctaagcgtcgcttgcgcttcaccatcttgccataggtagtcacttcatacccgcatcttcaatatcttctctttaattctcatccatctataagtctatttcctagcttcttcattgttctaatcacttgcttatacactcaataagtgcattagtcccttaatcgtttgtcatcaataaaccaaaacccactaggggcataaatgcactttcactatatgaccctttgaaataaagaattggaaactattgaatcatatgagattcctaaagaatgtctcaatccatacaaatttaggaggatttttacgtattgacaacctgttaattatgtatataaggactcggctgctgctgcgcgtggcggcggtgggaggcggccgtggctgctactgagcgcggcggcgatgggactcagtagcactatacaatagttaaaagctctatacataggtcccatttatatggactatttttgttatatacattattgttacccttagaaaaacacacgcggtttaacgatttgagaaacgtgtgcgtgggaaaggaggcagtacaagttaaaaagaggtaaagatgggaagaaacgttgtaaacagcagcaattttgtacttatgctgatatcttttcagataaaacgattgaggacacacatctcatttgtcgtataacgcattgttcaaagagtacatacgtactccgtagtactttttattgatgcaagaatttaaaaaaaaaaaagctaaccgtgaacacacacatgcatgagcacacacacgctcatacacagctttatttatttatttatttatttatttatttatttatcatactggaccatatccagaaatacttgcatggacgtacacttgctagatgtatgcctatatcggggtttcagcttaaccgattgtgggggtctttgccactgtgtcgacccagatgcgaacgcgattctcgtcgaactcttgagtgacgatggtgcctaccggaaccacctcaatcttgagatctggacggtctgctttgatcttctccttggcctccttgatcgtccggcaaactagctcgggccactccgtcttgggggtctaagaggaactcatcttcgcaaggaaacaatcgagaagatccaagttgcctgcaaattatgagtggttaattcatgattactgcatcttcagatcatcaaagaaacacctttctatgttaattacttgttgaatcatattttgttctttaaaattgttgcaaatgggaccttaattagagcctcatcttttcgcttatgtttatgcttattaattaaaatttaaatttttaaccttaaatttggagctgatttcaaggttttttttatcgaagtttatttttcagcctttacttttaaatcgctaagaacatacacataaaagttttattcataaattatttttctttacaaatatgccgtgaataagcgaaacgatgactccaaacgccactaatcaaaaaacggaacctctcctcatgtgtagattcaaataataaagaacctaaacaggtagacacatacggtagagacaggagtacgtacttggtaacttgaattgatcgatgcttcttctctgcagtgggttttggttttgcaccgcgatgtgtggatatggatttggatttgtgtaacgtatatgcgtgcatttataggaccatatgaacggagcaatttggtctaaaaaaaaacacagcacaccaatacatcgagcaacgtgtgtaaataacgaagtttcaaagcgggccggtacgtggactagtcattagtggataggcttcaatcttcatgcatgtgcacccacgtgtagaggggttgttggatgcatattcaacgatttggacatggggacatttggccatatggtgcgtggctacttgtgggttgcagatttgaattttgacgatgaaccttgcacatatagagctgagtataattaattcttctaaacgcatttggagctaggaagatttaattaatttcgagctaaataatagtagtagctatgtggcgcagagaggaaatgaaaccataatcatggtagaaccaaaaataagcattagtgatatgtcagtgcttagctattcgatgcatttaacaggcagcggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64149 - DNA, 993 bp, Oryza sativa
cccggttagggcatatgtattgtgagcatgatgtgatgtgaccctgtagttctggttggagctgcctttaagttcggctgcttagtggaagctctatgatttagactccctttagttgctcttgccgtgtggacgtgtaaaattcgggcaggatgggtgttgtatgggtattttgaatttattttgggtgtgtatttatgtatctaacattctaactacgcatttatcgctgtttcacgtcatgtatgtaaccgtgcagttattagtttattgtcttcattcgtgcttagcataacgacattaatggcttaccttgttattcaattgcggcggcagcctctgcgggctcggttcactgctccatccaatgtttccaaatatgcggatgcttctactcaagtgttgtcagcaaattttcctggaaaaggtgagagcaagtactgtttccttttttatgcttttgtttcgcactttatgccgctgttgcgtgatgttcctttctcaaataggaagtctcttacacttgttcttttctcttgcctcttatattttgatttgctaggcagtaatagcctgagtctctcaagtgcttttcctcacaaaacagttgctccaagttataagaagacaacgagggtgaatcaagggcttttcaaacctggcaccaatcgaaaccttacttggcaaaagcctgtgtcaagtgataaccttgtgataagtttctctgatgatgatagtgggtccgactctggaatgtcaaagcaagataagagaggcaggaaagacagttcacaaggtacatataaaacagggattaatgtgcacactggaattatgagggaagaagcacctcaacagaagatccatgctgcaaaggttggatctgcaaattggtcagctgttccactaacatataggaattcacgggtaggcaggggattgagtgccacctttgctaggagagatccacctgtctcgcaagtcactccccaa

SEQ ID NO: 64150 - DNA, 5966 bp, Oryza sativa
tcaagagcatagaaggaagtgcgaagtagaggaaagagaagctctaagagcttatcgcagagcacaaagagctttaattgaggccaatgaaaggtgtgccattcttcgcagaaaaagagagctttgctctgcacaagtccatggttttatcgctgaaaattcttctttggcacagcctttgagtattcagaatgctggacacggtcttgtaatgccatctgtgctcaactctcaagctaatgcagatggtcagatgcctggaaatcagggtggcaggtctggcagtccatacccagaggagtcccctcagcagccagttgataagcatgaggcacgctcacacaatttcaatgataacagcacaccttcagattacatggaggatgatcttctacccccctcaaagcgggcaagatcagattgtatttcaaatctggaagatcacatggaagaaactatacatgtttatcctgtggaaaacagacaaatttctggtgaaagtgtgcaggactatgagcttttggaagcttctttgagatcaaggttggtggagagatttgggaagaaatcatatttgaataattctggagaagccactgaagaactctcctttggaaaagtatctgagattgagcgtgagaaggcatatgtgggacctctgctacaggaggctgatgagaatgttatgacaaacattgaaggttatacgcatttctgtattccccaagtccattgtgttcctattattgacttttgcgttaaacttagtgatggcctacgtacatgtcatgcatcaaaatattgccagttgccatcatactggagatctagcatgttttcatctgttaaattaatcagtcatcttgctatctttgcaataactaattactatggccaagctcttctaaacacccaaaacatggctaaaattggtcgattgaaataaaattgagtgggcattaaatcctacaacatacagagtagttctttatcttctatatccatcacaactggaggacatgttgagtgtatccttgcatgttaattaaaaatgtggataagtatggcatgtctttctacagtttaatgacatgaggtctattgcataggtatggtggagcttgggaatgatgcacatgaaaagagagctgattctagcaatgcgccttcaattggcaactatgatcatgaggaaaatatttcctcttttggagaattatgcatgccattgagcgtgactcatcccattattccttcttcagctccacaaaatgctgcaagacacatgaagggtttatttcctgatttacacaagaaagcttcagactacaaaaatgactgtcagaccagcaatgcagcctctgtagcaacggttcgtttgccagatgttgccaaggataatgctaagatgcactcaacaactagaaaggatatggacattgtgagtggtgcggttgatcccttctggcctttctgtatgtttgagcttcgaggaaaatgcaatgatgaagaatgtccatggcaacatgttgagcatcatgcttggagaaagtcaaagcacacaaagcattcaaagccctcattttcaggtttgttttatgttcagacaatattaatcttgttgatgattgattatggtgcatacatgtatggttttcatattatgtttgctgaagtttctacattaatgcctggaattaatgcagggtggattccttatggtctgtttcagcatattctgcccgtgccaacttatcgtgttggttcaaatcttattagggctgatctgaacttgatccagtcggtgttggctagcagcatttggcagtattggcaaagggggttttgtgcttcctttccttttcctttatctgttcaaagggtgcttccatcagatgctccatccttacaggctggtgatgattcgagtgcaaattttgatagggacagacaactattgaatcttcgaatgctggatagtaggaaggtgggtaggattcgtcatatcacagttatcgtcagaattgtgggagttatcagtatctggttctccgctctgaacttatcctttcaagtttgctgtcctgcctaatattgtgatggctctggctaactcttttcggtgctcaatttgtgttagtccactcctttcattcttctccttgcaaaaaaggaagatagatacagatggaattttgcacccaaagtggacaaattattaaatttgccattgatagtgttcttatttgccacatctgttttcttagtagctgaaactcatgacttgacatacttcctgctagtttcatactatctagtttcttgccctattctcttcttatattttgactagtgttatttaactttgtgtgctgtagaataagattgtacagggatctgttgatgctgaactattcttagaaggggcactaattctgtattttggaaaaatcaacaaacctgataggctcaaggtgatcttccccgttgagtgttttgagatgttctagctctttcaagtttcaactttcaacacattttaattgggcttcatttattttctacctgcttatctcaaaatattcatcctgcaggctcttttatatctagcacgtgctattgaggccgatccaagcacagttatcttgtgggtgttttatcttcatatttactatcaaaaggatgaaggactagggaaagatgacatgttttcccatgcggtagactattttatcaatcttttgccgatcggttcacaccctactatgaaagtttcatagtaaaatgcgtgaactgttaatacttttttcttttgtttagcctgcatgtcctgttttacttttatgtgctgagtggttggtctgctcaccttagaaatgcaaaaggctatatcataatttcatttaatttcctacactgtttcgattccatactcagttcgttcatttataaacacttgatgagccctttcatgctatgacacgcttcaactgaagtatgctcagtgacggaggtttgagcagtgaaaggcttttatgagtttgtattcactttgtacttattggacaagacataactagatggtcaactgagaaaaaaaaaactagttggacttcttgtcagaccaaaatattggaccattggtagcatgagcattattgtatttctagaccatgtaggctatgacacaatgtatatttgctttagtttgtatcatcttatactaatattatgtggtctttgataaaacatctacttttcttccttttaggttcaacacaatgtttgctcctatgaactatggcttatgtacattaacagcaggttgcgctttgatgatcggttggatgcttacaatgatgctttgagcatgctctgccaaatgacagctgtcacagacatggaattgaaagatagaagttcttttgtcctagatatcttgttacagatggtttacttcttgtgcatgtctggaaatgtggacaaagcaatttccaggatttatgggattctgccgactgcaactcccgactgttctggtgacaagttgctcgctgatgtcatttcttgcttgaccatttctgacagatgcatattttggatttcctgcatatatgtctcaatttacaggaaacttccagaggaaattatagatcaactggaatttcttaaggatttacctaattcgttagtatggtctcctattgaacttacagtagataacagaagtcagattttagtactattgaactatgctgctggtaagattgctgtagatattaatgaaacggttaaaaacggggatccatcttacctgaggctctcacaattcctcgctgttaaccacattaattgtctagctactcttgaaggcttccaatcttgtgctaatctgctggtgaagtatatggaggagtatccaatgtgtcctcatattcttgttttctcagctcggctacatagaaagtacggttcatgtcctggtctgaaaggatttgatgaattgctcctgggttggcctaaagaggtgcaaggaattcagtatctgtggaaccaatgtgctgagcatgctctggcagataatatcgagctagctgagaagttgctgactcgctggtttgaagaatatggaaaagatggtgatattcaaagtggtggtgctactagaccaatggagatcagcaatgaagagtctgtacggtcatcagtttcctctatacaagaagttggttctggtacatctacatcagaggatcaaatcttttggctattaaacctctcattatacaggacgatagagaacaatctacaggaagcaaaagttgctatggacaaagcattgaagttagcacatggggagagctatgagcactgtataaaggaacatgctgcaattcacacactggagaaaacgtcatcatctacagatgttcaaactcaagcaaccttcagtcttatcagtggttatcttgtagatcaacggaacttgcccgtgagggatctgctgtcaagaaggtttatgaagaatgttaagaagcacaggcttaagcggttgatagatgagactataggcccaacttccgcgaatcctgctctgataaactctgtcctcgaggtgtgctacggtccatctctccttccagaaacgataggtgaagttaagtacctggtcgattttgttgaatcagtgatggaggttcttcctgcaaactaccgtctggccttggcggttggtaaattcatggttaagcattgcacaggtgatgactctatttccatgggcacccgattctgggccagctccattctgatcaacgccattttccgagctgttcctgtcgcaccagaatcagtatggttagaaggtgccagtctccttgagaaacttcaggcagcagagaccgtgaagagattctaccagcaggcaacctcagtctacccgttctccttcaagctatggcactcttacttgaactcctgtaaggccagtgggagcagcacagagagcatcgccgaagctgcgaggcaacggggcatcgagctgagcgtaacgcctccctagcaggggccctcttggtttgatgacgtggcgattcgccaggtggagctgtagttagtgttgtgtttactggaaagtgagagtagatacacccggtggtgatggggcgactggataattttcttcttgtttaggcacaggtttagtgacacataggcggtggataccaaccataccatacatcacagcagctgctgttactgatggtgtgacttatggatcaaaaaaagaggatataggcatacggttttgcatgcccccacagagtggagttttggctgactcgagagtatgatgtttttgtaggcagatttcttgatctgtttcaggtttatgtttgtttaccctgttgcagtgtatggcatgcacaactgttgtttttttgaaacattatgatcgatcaatcatgaatgtgaatgagaattttgttaaaccattgcgatgtgtttgcatctgaatccatagctgctgcatcgaatttttgttgattcgcgagctcatgcgtctcatttttgttttcatagcggattgctggtgttaaatagccgaatacaggggtcggtgtttccattaccgacctttgtttgctcggctagtggactcgattaatagtcagatttcttttaggcaatgattttcaaatgttcacatagtttttagccagggacgtgtttatttatgcataaacctaaggaacagaatgtacatttttgttagtactggcactgtgattcctccatcaaattatcagtagtacttcctctgtttaacacattataaagatccacatatgtgcttataatgtggaaacagtggaatcgaagggagtagaaggtttacgcaaatttttagtcaaattttgtgaaatttagtactccctccgtccctaaatataagagattttggc

SEQ ID NO: 64151 - DNA, 8005 bp, Oryza sativa
cccactcaagtactctactcacaggtaacctctcccctccattttttatcgatccatccatcgctcgctcgctcgaacgacgccgcggcgcgatcaagatcgcacccacttcacctcgatccgccactccggagaagaagcggcgcggcgcaccgatcgatgcatccgctggtgggggcgctggtggcgggggcgcgggagcggtggtggtgccgcggggaaggcggcgcggcggtgcggcacgcggtggcgtgggcgggggcgctggcgctggccgtgtccgtggcgtcgttcgcgccggaggccgcgttcgtgtgggcgcttaccggcggcggaggaggcggggggagtggggagttgtgcgcggcgggcgcggtgcgggtgccgctcgacggcgggggggacttcgtgtgcgtgccggcgaggatggcggtgcggtccggcgccgacatgatcgtgcccccggcgttcgccggcctcgccgtcggcgcctccgcctgcttcgtccgcgccctcgccatcggccgccgcctcgacgactactagcgatcgaatccgccgccgccgccgctcttctcgtcgacgagatcaacggcatatgctctcttctctccgcgcttacaaatacgcctcctactttacaaggcgtatttctattcacattttcttcgctcacaaatacgccttctatcttggaaggcgtattttgcttcacattcctttcctgtaatctgaaattctgaataatttacttacaaatgccggcaatctttggtgtaatcacaagattatcaaacaagaccatggaaaatgtgcacacaagctgcaatttctgagtgatgattcgtagtggttacacagaaatcaccattttcaaggcgtattttgatttcacatttttcttcggttacaaatacgccttccaccttggaaggagtactttacttcacattctatttctttaatctgaatttctgaaatgatgtacttacaaatgctggttaatctttggtgtaatcataagatcatcaaacaagaccatggaaaatgtgcacacaatgtccagtcttttgcatacagattcatagctgcctagttggttacacagaatttgccattaatcatcactgtgttgtatatgtcaaattaacttgtattgataatttctcactgtaaaagacctaattaagcagctatctctaagatgattacatgcatgtttggtgatctacaacactactatcatgtactaggtaagacttccaactccatcaccttttagatacataaacaattaggtgtaggtatccacacatcattttcaggaagagatgactgaatgtcacctgaaacatagaagctgctgagacaggacaacaggagcatatttcttctcctgtcaagtttttttttctttttttcttttcctgcagtgatcactagacactgctttagtttccaagcatgacaacaacaagtgctccatagcataggagcaattattcaggagagaaaaaaaaaggctgtttgtataatgcctttatccaagatcttgtagtccataattcagaggtgctgctgagataggtcaatatgttttttttcttcttctctagtcaagcatttctttcttcctgcagtgatcaactagacactgcttaatttccaggcatgacaacaagtgctctatagcataggaggaattattcaggaaaaaaacacaaaaacttgtacaatgtcttatctgagaatctgtggtccttaggatgtaccgtgaggtatcaccacacttcaattatgcacatatataccatcatcaaccccaattcaacatctccatctcctgactcccaaaaccaaaggaaacccagcgattttcattgtttaccaatgaacaatgcttataccaatatgagtccattgggtgatcaaatcctggccgtccggtttgtgcccggggacggccgccccagatcgacggccggcgaggcgaccagctgggtgaagctgatgggctcggcgtagcgcggcgagccgtggaagaaggcgtggacgcagttgtggtaggcggcctgggtgccgtgcaccttgtcccagaagatgtagttgtcccggtccgggcacaggtgggtggtcgccgagcagtcggcctccgcgttcagcttgccgtctccgcagcacgccctcgccacctccctcacccctgttccatccatccaaccacacataattaaaaagataaggtgaaaaggagctaaccacagtggccctaatcacgaagataaaggaagaggcaaaaatcttgggctatggcaggagccaaacgtctagctgagatgttaccgtagacccggaccattgtgctgtaaatattactctttttcgttacttgtaaatttgcccttctatatccaatgaataggcaagctttgcctttcgttcaaaaaaaaaagataaggtgaaacctctgtgttctttttttcttttgaagtgaaatactgtaggaaagaatcctgaaggagaaagctctgtctggaacacaggaacttcgtagaagttttttataggaaagaaatgtgtatttttattgaagtataaagtgacttgtctatccttcgctatcaaccaaaataaacttctatttaaacttgttaatttaatggcgggctaatgataaatatttctgaatatatattaagatgctctcctggtttcaaaattatctaagagtttcttttatgtagtttatattgcaaaatgatgggtctcctatgaatttctaattatgagtatgagaatcgaaagacatgaagattctcaattctccatggcatctaggagatggataattttttagaaacaagaagaccagaagtatcttactctctattcactaccatttcacaaacatcttcgacttgtaacttaccagccgaagatggattctttatcatgtcgtagaaggtgtagtaaatgctgccgatggagtacaccaagtccggcatggaggctgtggcggcggcggtcatctctcgtcggaggagacggttgaagagccgtgcctgccagttgtcagtgccactgcatgaaccattttcaatggggaccctggagatcggtagacaccctagaggtagcacgtcaagtatccccagcctccgagcccctagattgtacagtgtctgcatcacgagcaacacaacatgaacatctttttaaaaagaaataagatgcatatatgttagactgacatgtttccccctccaatgttaaatgcaagtcgtttgagactgaattatcgacaatggaaatcaatcaatccaacctctacatccagtaagttgtttgagactatagtcaatctaaacagaagttgctaaagaattttgagacactatctaatttaaattttgattatatcctttgtaattgaaggcaaccgctcttattttccaatacgtgccaatagggacttctttggaataaaatagttttataagattttcacaagaattggttgttcatttccaccaaaatttccacaaaagttatccattccaatggaggcctaaacaggggggaataagaacatagtacttcttttcacaagtctaagagaaccttgttaggaaaaaaataaccgttgtttggaattatgaaagtacatatacaccttgatatgcttgatgtaagtggcaaccatgtgggcgatgaaggccggcgcgtcgctgacggggacgatgccatcagtgaaggcattgtagtcgttgccgccggtgcaggtaatgaacaaggactgggagagcaagttgtcgatgttctcaccgtcgacctcgccggcggtgatcattgcctcctttgttttggtgaagagcttgacctgctctccaaggctgattgtgccgttcccctgcatgtcatatcatgcaattgatcaaactatctgaacaattcactcaaaaaaaaatcgaagtatctgaatagaatagggatagtaatactgattgtcttttctcaagagaaaaagtaagaaaacaatttaattttagaccgttcgtttttcatcgtagaaaaggagcttttcgatgccttcctctgtttcattactaaagtaaaagaaattaatcaatattagtccatagccactagtccatatctctgttcttcattatgtaatgcaggtagaacagagtgttcaatttgtgctagactgactagctgactttagatttcgttgctgtactttgtaacaatctgtgatttatccattgatttgttctgtgcaatacaatctctgcttccaaatgggcaatcggatgcaagcatggtacccaactcatcagcgtgtgcataactcaatgcatttcaaggcacatggatggtgctgagagatgactccggttcattcgttgcagcaagaacaggatgtggtgtctgttcgttgcaggtgcactttttctgaagtttgggcctgccgtgatggagcgaaattggcaatcgaatggggatgccaaaggattgtggttgaaacagagtatcatggaattgttcaggtatggaattcgaagaaaggccatcgctcaggggtgtttctttcccctcgaggggatgtcccctcgtttcttatatgacattaaaataattatggaaactttttaaaaatatattgttcatgattgtaatccttcagataaaatacaacttcatgtttacatcccaagataagagagagagagagaagggagtaggtcatgcatcactaagcatcaaattttggattgggtttcaaatttcagtatggtatggccaacatcctttatatgattcaaaatcttcaaaaattgcataaatctagctgaattaatttgttctgctaaaagcaaaacagaaattccagccgttcttattctgtgaacgctattacttacaatgaagtcgaggatgccggatccgctggaggcgtagttggcgccgacgaggcctcgccggagttcgccgtctcttcccggcgtcgtcagggagaggtacgccggcgggctcttcttgaaccccacatgctgcgctgcaaatcaatatatatgcacatgcgtaataatttgatttttctttctttctttcgtcggtaataatcaaataataagagatccatacacataaaaaaattattcctctttttaaaaatatatatagatctttgatttatattttttggggctcaaataaatgattttctttttctttctcgaatatagaatataagcaaaaaaaaaaaagcttcctcagctgatgtttaccgatgacgtcggcgaggttgaagccgttggtgaagcggccaccgccgccgccgtcggcggcggcggcctcgggcgggaggtcgatgccgcagggtggctccggcggcctcggcgccggcggcggcaggaagtcgttgttgccgacgtccaccagcgagtcgccgaacacgtacatcgccgggaccgtctgccggccgaccccctcgccggccgccgacgaggcggcagaggcggcggccaccacaacggcggccactcgcagccatccagccgccgccgccgccgtgctccacctcctctcccccgccatggctgatcgatcgaatcagctgagctaccagcgaagtgatggtcccgagctcatcgattagtagctgagctgagcttaatgagaattgagaagtggcgaattatatttagttaactagtaataaaaacacccatgctttgtagtaatgaatgaaattaaatatgttataatatatcatattttaattaacatgttagtatgacttgtttacttatttatttaaatatatggtattcacttgtttattaaaaataaatataggaatatttcacaacattgagaaaatgccaagggctaatttgtacaaagtgtactactaaaagaatggtgaggtggaagtgcgaaagattttgatgtgaaacacgagcgagagagccgagagcgaatcaaaatcaagaattgatttgccttgttaatctcctgtggtgcagaaggatgtggggtagaccggtggagtgtgtgggccaggcattcagtcctatgaattattgttgctctgtgacgtttgttgttgcctgcctgggctggatagatagtacttcatcatttttaaaatatactttctgtccttctaaattatactccttttgttgtagaatgtaagaagttttaaaattaaacacggttattaaaacaataggtagaagttagtgctggagggttgtgattggatgagtagtagaggtaggtggaaaaaataaatggtagacggtttgtgattggttgtgaaaaaaatgttggtgaaggagttgttatattttgagataaattctgagggttaataaaatacccatgggtaaattggaaccatgctattataatttttcaaagtttaagatatgccatcggtaaaatacacatgctttgtaatgaataaaattaaatatattataatatatcatacttttatcaatatgttagtacgacttgtttacttatttaaatatatggtattatatggtattcgcttgtttattaaaaataaatataggaatatttacaacattaagaaaatgccaagggctaatttgtacaaagtatactactaaaagaatggtgaggtggtagtgcaaaagattttgatgtgaaacacgagcgagagagccgagagcgaatcaaaatcaagaattgatttgcgttgttaatctcctgtggtgcaggaggatgtgggtagaccggtggagtgtgtgggccaggcatttagtgtgaattattgttgctcggtgtcgtttgtgcaattgtgcttgccttcctgggcctggatagatactactcctattcgatagtactccctccgaaaaaaagaaaaaaaataacctagctaaacataggttgagtttttttagacgaaagcagtgggtcggaatttaatggatgtgttaggattttgagttagacagagtaagctactactactcagtaagaatttggaatatcaatttcaatatatgactacatgtttttagttttgtaattaatacctccattttttagttattatatttttacattatgtttgaccattcgttttattcaaaaataatttaaataaatattttttttattttggcttgatttatcaataaagaaactttaatcagtacttgtattattaagatttacataattttttaataagacaaatagtcaaagattgtaacaaaagttaacggtgttatatattaaaatatgagtgagaatctagactagtactactatttagggagctagaaattacgagagaagctataactaacaaaaactcttcaatcaagatcggactagatacaatcatacaatacactattattcttgttcttttcttttatagactgagttctaaactttaaatttaaactttcttgtttttcaaactgttaaacgatgtatttatgtgtaaaaattttctatataaagtttttttttaaaaagaaatcaaacaaatatatttttcaaagttataatagttatacttaattaatcatatgtcaatgagtttcccatgctgctaatatgctagtccgatatggagtttcaaacaaacccataggatcgttggcaaagctccagctccttcgggcctagccaaacagtttcaactccatccataataggagtggagcgagctaaagtagtcccacaatacgaactattgaggtgaagctttgcttaggatgtagttctatcaaatatgcccttagtcaccaaactagttgtctagcacacgtcttctggtagaattttaaatatatgttcattgaaaaatatagccgtacgaaattgtttcatcgtttactcatattttcttaacatgttaaatagtaatattttagtcattattattagtgattttgcgattttaaggtttaatagtatgtattctattttttttggaagggaa

SEQ ID NO: 64152 - DNA, 7595 bp, Oryza sativa
aaatcagtcagaattttgtctttttttgttacaactaaaatacaatgaatttgaagataagatttcacacgtaggtgtaatactattgaaaatatatgtccaattttttctaaaattttctgtgatatttgctagttggtgtgcgcattgcacatgatatgttcctttttagacatcatttatttgagagcgaagggatgctctgctgtgaaatttccgtgtatgaattgttcgttgcgtgtggataagcagattgtggttcacattctaatttctcccaaccggattttttttccacaaaccgtttgtggagtgacattatgataaacggtgtagtcatggcatgtagtgtgttgtcaaactgatgcattgatgagacgtatagaaaaagacgtgttatatacgcttttatgcattttgtgttattgatgccgataaattgggaaaataccaccgactagtttgacttcgttgagggttgagctgagattctattaaatgattgggaagtgtacagcgactatactgacaacgatcattggccatgttgtttgctggcttatatttagtttggaatttctttgttttcaaacagatttaatcaaatgtgcacgtaccgaagggagtaacttttttttttgtcatgaaaccacgtcaaaatagcacccatcctttttcagaacaaaaaagcagctattacaaacatatatatttgattgctgttagattggtacaaacaaccacggaacagaaacaacggtaccaaacaagatttgctacaaggccgacttcccaattttgaatgcaatcacttcaattcagcaaaaaaatcgctgaaacaaatggcagacagaggggtgttgtgttgtacatcaactgacagatacttcatttccttttggtttcgtatcgctcgtgcatacagtgtgtgctgcttaggttgttggtaacactgatgaagaagatgtgcggtgaaattggcaccactttggaattggtttctgttggacaaaaggatttcctcacgatctggtggtcgatggcttctccacaacaagtgtaagtaacaagaatgagccgaaagagatgatgagcgcaatggccatcaagataagcatggcttgtagcgtgatatttgggctcaggaagaagatgactgcgatggcacccgattgccaaaccctccactgtgcaaaagctgcctcctgcatttgacatttttccaaaataaatatttcagtatccatttaagcatcagcaattgaaatgtgattcattatatttttccgtcatcgataggaagaatgctactgtgcagatgaaaagctgaagaaaactaaaatgagactaccttgacatcctcgaacagcagcccaagtaatgcgcttaactgtgtatgtaagacaccatcaccaacaccccataaagcacctataaacagtggaactgccgcaccaagcaatccacccattggactgtaggcagtagaaagatgagctcattgtgataccaatggcaagcataactgcagaagaatggtacaacagcacaatgatgattcatgaagccaaacctgtaaaaaagaagtaaccagaacaggactacagcatgaagaatagctccaaccgaaacgatagatgtagctgaatgaagcccagaggtcaaacgtccagcaaccaatgcacactgcagtgtcagacaaccatcaaaagtcagctaaaacataaattatggcattttcaatagtttagcatgatatagattagttatagatagctgggaaacaagatatgccatactttcacaaagcaatagcaacagtaggaccctagggaaacgataatctagagttcagactgaaatgccaccaggatagtgctaacaactttagtgatttaaacttacaacagcatcggctgcaccatatattgccatggctccgccaactccagagacgccaagaacaggtgttacaatatttttagtgaatacagccctaaaaattacacagcattatctcacagaaaaaatattaataaatcaaacagcaaaaaaatgtccaaaagcaatttgtgctactaagtgcttaccatacaaatgccgcttgtaatcctgaatatactataagagggatgataagaatcatccttcggtccttgagaggggcaacaatatacttcatcatggccccaaatgaggaatgtgttggagcagtatttcctttctcatcccttttggaaagtaaacacattaatacaatgccgacaatcatgcagccaagaaacacaacaaacagcagatttttccccgtgacacttcatcctggagtaacaaggaatcacatggacaagcatgattgttattaagaacataaaaggtttcaaaatttatcaaaagtcatacagaccttaactagtatattgatcaacagcttgaacaaatacttttgagggtttagacttctgagtattgctaacctcaggagtcaggacattttataatagttaagtccatgggaaattagagtaggactgctaatattttagatatttattttaaaatgtacatctaaatgataaacattaagatttattttcggtagtgctcattgtgattcttctatagttgtcttgtagtgtgctgcaatatttttgtttgcgatcattattttgttacaactaatatactgatgcattttgagacaattttggcataatgtaaacctagcagaattttgaattgggtatagaggtataacagaagtttccaggatagaataaaagaaacaatgggactctccggttaatatcaaaactatattttctcttactacaacaaatcatgatgctaaaagtacatctcatgaagctcactttagttactagttagcagtacacaaatcacaatacataacaaatgacagtctaggatattctaataagacatgagaagatcaaaattaagatgctaacctttccatctctcagtagtgcaagagagatcagatttccgatgacctgcataattcgaatgttgtattaagtcatagacaccttgtatctgtagagcccacatgtgcagaaagaaatactagtagacgctgcgcttgtggtatgaagaacgaatactaaaatatgtcttggcaagttttggtggagaatagctttgtacgagtacgaccagtcgaccatacctgtgtgctagcaaacattccccagaactctccattgaagttccccaaagtttggccttcaggcaaattattgtctcttgcatgactgagggcagcagacgtgagatatgtaccctgcagtgtgagatatattatgtgagctggattactggatgcaacagaagacttcacaagctcactggcaagtaaatacctgcccaacccagatgatcgatgcagaaaaacccagatacagggaggctggcaccattgtgtacctgacaatttgttgtgcaaattaacatccatatatagaatctcagcataccttaaatataatgtattcatttttaataatattttgcacagctgaatcatttagtagtatattagaaagcacatcaactagggccaaaatccatcggccatccatatcttttgagagtgctatatataaaagaaaatgaaacatgttgctggtaaatagtctagtagaaaacttgtcgatagttttaactaggagtaattcgctacatgtgctacttcagatttcactctcagctacaccaaaaaagggtaacacagcatttgattaccagaaaatggaaatgccctccgtccacaaccaaacactcaaaataaactggtgagaccgcatcccgaatcaaacatgagctacacactacaccgccaaattaagactatatgatcgattaagatcagtaataccagtgtctgagcgaaaggagcatcatatcaacacggtctagctagctaggcatttcatcaaacaggcgtgaggcatccaaaccagcacgcccaattaggcaccagcgctaccatgcgcgggacggtccatgtgaaaactcaaaaccatgcgattcataggcgagcgcacgcaccatgtcgggacgaggttagcgaggatgaagatgacgtagccgctggtgccgacgacgagcgcgcgcttggagccgagccacgtgaccacgggcgacgcggtcaccgcgaagagcgtgaaggaggtgtacaggatccccatggacaccgtgcccaggtcgccctcctgcagccagcatcacccacggatcaggaaaggcggcgatcgagatcagctcgagaccgatcgccgacgacgacgaggacgacgagagatgcacactcacggtgttgaccgagctctggaggttctgcgcggcgcagtaggcggagaagatgaagaggaacgcggcggagaggacgtgcaggtcgcccgcgtggctccagcggtggcccgagtaacccaacggcgcgacgccggcgaggagcggcgccgtggcacccccgtcggcgccggcgccggccggccgcctcctcatcgccttcgtcgtcgcggtggtggcctcctcgcgcgtccatggcccgcggcggcggaggcggaagcttctagaagcgatcgatccgcgcggcttgagggttgaggcgggaagcttcttctagaaggttttttttttttatatagatagaggaggagacgaggaccggcgacggcgaggagagtggagcggaggcggcgaggtggggcccacatggcggtttgtacctacctgcatgtggggcccacatggcgtttccttcctgtccccgcctcttcttgtcacttcgtcagtggccttcgaagattctttttttcttcttcacttctatttttcaaatatgttatttgaatacggagtatatggtattcacttgtttaaaagaaatattaaaatattctataatattactacatccgttcaaaaaaagactgcagttttacatattttcatatccaacgtttaaccgtccgtcttatttgaaattttcttatgattagtatttttgttgttattaaatgataaaatattaatagtattttatgtgtgactaattttttagtttttttataaatttttcaaataagacggatggtcaaatattgaacacataaaccctcaactgcatttaaaatgtgacggaggtagtaataaaattttaagggctaatttataaaaaagtgtaaaagaatgttgaggtggtagtgccaccaccatatttttaaaggagtatagattttgatgtgcacacgaacgagagagccgagagcaaatcaaaatcaagaattgatttgcgatttgcgttgtttttcttgttgtggtgcaggaggatgtggggtagaccgatggagtgtgtgggtcccgttcgtttccactacaaagagtggataaatttttggatattcgtgatattttaaactactaaacggtgcgtttcgtgtgaaaactttctatataaaagttgttttaaaatatcagattatttttcaagtttgtaataattaaaactcaattaattacacattattaccaccttggttttgtgtgaaacacttaatctttatcttcatcttcatctttagaagattcaaacaccacctgcgttgtttttttctccaacaaaagttggataaacttttggatactcgtagcacgtttttcaaactgctaaacggtacgtttcttgcgaaaacattctatatgaaagttgttctaaaatatcagattaattcattttttaagtttataataattaaaacttaattaatcacacgttattaccacctcgttttgcgtgaaacacttaatctttttcagaagattcaaacactaccttagtgacgccgataatttgggaaaatattgacttcgttgaaagttgagcagagattttattaaatgattgggaagtgtacagcgactatatcgacaacgatctttggtcatgttgttttctggcttatatttggtttggaatttcttgttttcaaacagatttaatcaaatgtacacttctggagcatcgtttcgacatatttgcaaacgaaaagtaatttatgaataaaacttttatatacgtgttcttaacgatttaaaagcaaaggcagaaaaataaacttcgatgaaaaaaaatctcaaaatcaactctaaatttaaggttgaaaattcaaattttgactgataagcataagcataagaaaaagatgaggcccttcatatattaatgaccgaaggagtaaccttcttctttttttcatcaaaccacgtcgaaataacactcatcctttttcagaacaaaagagcagctattataaacatatatatttgactgatgttacatttggtagaaacaaccacggaacagaaacaactggaggaaaacagattttgctacaaggccgtcactctaattttgaatgcaatcacttcaattcagcaaaaatcgctgaaacaaatggagtcagggtggtgttgtgttgcacatcaactgacagatacctcatttccttttggtttcgtatcgctcgtgcatacagtatgtgctgctttggttgttggtaacactgatcaagatatgtggtgaaattggccccactttggaattggtttctgttggacaaaaggatttcggatttcctcacgatctgacggtcgatggcttctccacaacaagtgtaagtaacaagaatgcgccgaaagagatgatgagcgcagtggccatcaagataagcatggcttgtagcgtaatatttgggctcaggaagaagatgactgcgatggcacccgattgccaaaccttcaactgtgcaaaagctgcctcctgcatttgacatttttccaaaataatcatttcagtatccatttaagtatcagcaaatgaaatgccatatattatatttttccgtcatcgataggaagaacgctaccgtgctgatgaaaagctaaagaaaactaaaacgatattaccttgacatcctcgaacagcagcccaagtaatgcacttaactgtgtattcaagacaccatcaccaacaccccataaggcacctataaacagtggaactgctgcaccaagcagtccacccattggactgtaggcaatagaaagatgagctcactgtgataccaatggcaagcataactgcagaagaaaggtgtaacagcacagtgacgattaacgaaaccaaacctgtaaaaaagaagtaaccagaacaggactacagcctgaagaatagctccaaccgaaacgatagatgtagctgaatgaagcccagaggtcaaacgtccagcaaccaatgaacactgcagtgtcaggtaaccatcaaaagtcagctaaaacataaattatggcattttcaatagtttagcatgatatagattagttatagataactgggaaacaagatatgccatactttcacaaagcaatagcaacagtaggaccctagggaaaggataatagagagttcatagtgaaatggcatcaggctatgctaacaactttagtgatttaaacttacaacaacatcggctgcaccatatattgccatggctccgccaacgccagag

SEQ ID NO: 64153 - DNA, 5147 bp, Oryza sativa
gagaggggcaacaatatacttcatcatagccccaaatgaggaatgtgttggagcattatttcctttctcgtcccttttggaaagtaaacacattaatataatgccgacaatcatgcagccaagaaacacaacaaacagcagacttttccccgtgacacttcctccatcctggagtaacaaggaatcacatgatcaagcatgatttttattaagaacataaaaggtttcaaaatttaacaaaagtcatacagacttttaactagtatattgatgaacagtttgaacaaatacttttgggggtttagacttttgagtattgctaacctcaggagtcagggcatcttataatagttaagttcatgggaaattagagtaggacagctaatattttagatatttattttaaaatgtacatctaaaagataaatattaagatttattttcagtagtgctcattgcaattattctatagttctcttgtagtgtgctgcaatatttttgtttgcaatcattattttgttacaactaatatatcgatgcattttgagacaattttgtaaacctagcagaacacatattttgaattgggtatagaggtacaacagaagtttccaggatagaataaaagaaacaatgggactctccagttaacatcagaactatattttctcttactgcaacaaatcatgatgctaaaagtacgtatcatgaagttcactttagttactagttagcggtacacaatatataacaaatgacagtccaggatattctgataagacatgagaagatcaaaattaagatgctaacctttccatctctcagtagtgcaagagagatcaaatttccaatgacctgcataattcaaatgtaaatagtcaaagacaccttgtatctgtagagcccacatgtgcagaaagaaatagatgctacacttgagttatgaagaacagatactaaaatatgtcttggcaagttttggtggagaatagctttgtacaaccatacctgtgtgctagcaaacattccccagaactctccattgaagttccccaaagtttggccttcaggcaaattattgtctcttgcatgactgagggcagcagacgtgagatatgtaccctgcagtgtgagatatattatgtgagctggattactggataccagagaagacttatcaagcacactgtcaagtaaatacctgcccaacccagatgatcgatgcagtaaaacccagatacagggaggctggcaccattgtgtacctgataatttgttgcacaaattaaaatccgtatatagaatctcagaatatgttaaacataaaggattcatttctaatagtattttgtgtacctgacaatttgttgcacaaattaacatccatatatagaatctcagcatatgttaaacataaaggattcatttctaatagtattttgcacagctgaaatatttcatagtataatagaaagcacatcaactagggccagaatccatcggccatccatatttgtatgagagtgctatatattaaagaagaaaatgaaacattgttgctggtaaatactccctacgttttttaatagatgacgccgttgacttttgaacacatgtttattcattcatcttattcaaaaattttatgcaaatgtataagatataaataatgcttaaaatactttgagtgataaaacaattcacaaaaaaaataattagataacattttttgaataaaacaaatgatcaaacgtgtgacaaaaagtcaactacgtcatcaattaaaaaactgaggtagtagcatagtaaaaaaaacttgtcgattgttttaactaatttgctgtatgggctctcagctacaccaaaaagggtaacagagcatttaattatcagaaaatgaaaatgcattccgtgcacaaccaaacacttacagtagactggtgagacgagctacactgcaccgccaaattaaaaccatatgatcgattaacaacagtagtacccgtgtctgagcaaaaggagcatcatatcaacacggtctagctaggcatttcatcaaacaggcgtgaggcatccaaaccagcacgcccaattaggcaccagcgataccatgcggaccatgtcaaaaatcaaaaccatgggatccgtaggcgaaggcgtcaaaacccaaaaccatgggatccgtaggcgaaggcgagcgtacggccgcacgcaccatgtcgggacgaggttggcgaggatgaagatgacgtagccgctggtgccgacgacgagcgcgcgcttggagccgagccacgtgaccacgggcgacgcggccaccgagaagagcgtgaaggaggtgtacagaatccccatggacaccgtgcccaggtcgccctcctgcggccagcatcatccacggatcaggaaaggcggcgatcgagatcagctcgaccgatcgacgacgaggaggacgaggacgaggaccgaggagggacgagatggcacactcacggtgttgaccgagctctcgaggttctgcgcggcgcagtaggcggagaagacgaagaggaacgcggcggagaggacgtgcaggtcgccggcgtggctacggcggtggcccgagtaacccaacggcgcggcgccggcgaggagcggcgccgcggccgcctcctcctcctcgtcgcggtggtggcctcctcgcgcgtccatggcccgcggcggaggcggaagcttctagaagcgatcgatccgcgcggcttgaggcgggaagctccttctagaaggccttttatagagcgggtagagtgaggtagcgaggggatgggaggggagcggaggcgacgaggcgcggaggcggaggtggggcccacatggcagtggctcgaagccgcggggtttgtccccacctgcaggtaactgctttggcgtttccttcctgtccccgcctcttgtcattttgtcagtggcctactggccttggaagatttttttttctagttacttccaatttttcaactaacaaggaccacttggtatcaggatagagatcagtcgactgcaccatgcctttgtcactaataaatgagcccgacgacacatcaggtccacatatcaatgacaaaggcacggtgtagtgggcagtgactgaagaggatcccaatcgcttggcataattggtggatgaagttcggcttcgtttacacaaatttttaaaaaacgatggtagaaagtagagatgtttgattcaaggtaaagttagaaagacaagtaatttaaatgagagtaaatcgtttttcctatcttgccgattgtattctcttatgctgtgtttggtaatgggagttagggaactctcccaaacaagtaaaatgaagcagtcccgttcgttagtcatgaaaagggtggattaaattttagattaaggttgcacgcttttcaaactgctaaacggtgtgtttcgtgcgaaaactttctatatgaaagttgttctaaaatatcagattaatcctttttcaagtttgaaataattaaaacttaattaatcacacgttattaccatctcgttttatgtgaaacacttaatctttatattcatctttattttcaggagattcaaacaatattatgagtatgcatgattttggattattggcttaggtatagtgtagactaagattcaaagactaaaaatttagacaaattttactacatggcactcaaagtttgtgtaatttgctaggggatatcgtaaaaacgtgctacagctgaaaaatactttaaaactagcaatttgctagaacacattttcaatccaattagagagagaactttttagaataacgagaatgatcttgagactctaaaatgatcctatcctaaaaacaaggatgagtccaacccatcttacctcatccccaaatcaaacacatgctaagctgcctgcaaccccagtgttgttatgctcttggattttttttcaaggatggcagtgacagtggcttggccgttggttcatatcctaatccaatgctgccgttggagctaaatagttaatcgcatccatttgcagctcaagcagtatcatacaatttgggggatcttctttgtcaggtgacgcatctgatcaaatcatggaactactaattaaaccatctgcctctccaacaaaaaaactaaaccatcagctgccgacgagattatcctactctgatgataatttgctccggattcgtcgcccgtttgagccaaaagtttcagctcggattcatccttactttcttggtgcaaaatgctgcagcttctggtcggcaacttggcagtcggcagttggcagtgggcaatgcatgttcagaacttcagatgaatcagatcgttgcgtttcaggctttcagctcggtcactctacttcttttcgttgcctaatgcatagaaacaagccgctatatgtgattcgcttatacttcatcgattcaaaaagagaagatatcacaattcacaagttatcggtatatggaaggactgcaatgaatttggagataggccatctagcgttgttgagaaatatccgccgaactgattcatctaaactttaggaaaggtatttttggtgtttcgaggctacgatttataagttgaagagacattggctatgtttagttcctttcaaacttccaacttttccgtcagatcaaatgtttggacacatgaagcattaaatataaacgaaaaaaacaattacatagtttgcatgtaaattgagagatgaatcttttgagcctaattacgtcataatttgataatgtgatgctacaactaatgatggattaattaggcttattagtctacatttaatacttcaattgtgtgtccgtatacgtcaattttttttgccaaaacaaataaacacctaaacatggccattatcaacattcttatagtatagacaggcaatcggatctttcaaacaaatgaagacacgtgatcaatgttatgaaaaatacatttttaacacgagaattttatgcttctactcttaccggtcacaagtcaaaactgagtgacaaaagcgataaaataacctaaattgtttctaaaattcaaaattggctacggctcaactgcgagtgtagataatcaagacaaatctttaatttaaacgcttccga

SEQ ID NO: 64154 - DNA, 3350 bp, Oryza sativa
gaggaggaggaagggatcgagcaggttggttaggttttaccaggaggggacgaggttggcggcgatgaagaggaggtagccggaggtgccgagcacgagcgcgcgcctggaccccatccgccgcaccaccggcgagcccaccaccgagaacgccgtgaacgacgtgtacaggagccccagcgacaccgaccccaggttctcgtcctgcaaccccacccacccaccagcaatgcaaaacaccaaatccgatcggattaatctgaatccatggaggccgcgtctgcgtgatcgatcgatcggtcgaattgaatcgattcggctaccgtgttgacggtgctctgcaggttctgggcggcgtggtaggcgaggaagacgaagaggaaggccgagctcagcaggtgcaggtcgcgggtctgggacgtcgccgccctcgccgccgccgcggcgccgcgtctgccggataccagcggggcggcctcctcctcctcctcgtcgagggccaccgcgagctcggctccggcgggagcgtggccgtcttccatggcggatttggggggaggagttggtggtggcgtggcttcggtgccaaactgcgcgagcactctgctctgcttgtgatttgggggaaggggggaggggcttgtttttctaaatttaaggtctacgaggggtgtttgtgataaattaagtggtttcaggagaatagcagatagtttagggggtctttgtgagaattttagctgtttcgtgtccgaagaagtccgaaccgcccgatgacaggcgtttgtttgttttaagaagagatagtagcttttacagggtgtggttagtttctgaaaaaagttgaaagtttgaagaaagttgggagtttagaaaaaaagttagaagtttatatgtgtaggaaaatttttggatgtgatgtgatgtgatggaaaattggaaatttggggtagttggggtgaactaaacacggccatagagagaaaaaaaaaacttcgtgaaatgatatttgggccatcttagtcacttaaatacggcaaacacaacatctaacctaagcccattttataggtggcaattaatcttatgtacttggacggacgggtatatagctataaatacaaacatatattttaatgagtaggtttcactgtaataaagctaaccaattgagctacgctcgcttcgttatataaaatggtgtttttgttgttaaacatagcatacatatctagtgaaataacttactcttttatctttgttcaagtaaaattttccatacgcttgatgtgttttgagtaagggtgaaattgaaatatgcatttttatagcttagccctttaagattgtcttggttgttggttgtttttgttgatacttatggacaagataacagatcacaagtagacatgtgcaactaaactatattgaactaatttagacttcactagcatagttgcacagaggaaaccattggataacctattcggttctgttggactctaattgtgcttttttgtctcttagtttttaaatcgtataaagattaaatttgattttatagtaaaaccaagtccatcttttatactttctctgttcaagtttaaatgtcatatatataaaaaaacggatctccacaaattgattgttacatttgcattggccacccattacgtctcgggtccaatgccctagccctttttggctcttgtgcaaaattactccgtcatcacgcattgtgcatcgggagtgatcctccactactcgttgtgttgcggctctacatattggatcaataaaattgacaacaatttttggttccaattatattgcgataatgtatctcttttctccatagttcgtcaactacaacagcttgcatgaaatggacaaccgtccacatgtagaaggtgtcatggaagtggagggaagcgagcaagtggacgctcttttggagagggagcgttatttcgctaaggtggtcgtatacgattctgcagatgtttatgtcgatgtcttggaggactacgtagctagtgacacgaaaattcccgattcccaagtcgtcgtagacgtacaaaagatggttgtcaccaaaagcgagctcgatagtgcgcatgtggtcgagagggagttttatggcgttcatatgattcggtgcgagtttcatggccaatacgaaaatacaatggcaaacaacatttattttcaacgcacaaatgcaatcaactaaaattcattcataaaatcagaaaaaaaaactgtagattcatttctatgaagacttaggaagaatgcaatcaaaggacaatccgtacaaaaccatactcgctcatcgaggattagaaagtatttgatcgttgacattgtgaagatgaaggcaaataatttccgttgatcttgaattctgatctcttacacagtccaataagagacaacctcatctttttcttatgcatatatttatcagctaaaatttaaattttcaaccttaaatttagagttgattttgggtttttttatcgtaaattatttttcagattgtgcttttagatcgttaagaacacgtatataacagtttattcacaaattattttccgtttgcaaataagctaaacaatggtcaatgggactgagaggaagaataagactgtctttgaggagaggagatagaggagattgagaagatacgcaaaacgagatgagctattagcacatgattaattgactattaagtattttaaacttcaaaaatggattaatatgatttttttaaagcaacttcttatagaattttttttaaaaaatacaccgtttagtagttcgggaaacgtgcacgcggaaagcgaaacaaaactcactacaatcacctagatcaccaggaaagaacacggcattagaatacgagaaagtgaagaaatgccgtaaacaccgtcagaaaagggtaaatcggcaaacgcgttccaccaaaaccctccacgtcagcatatcaacatccaggcccaacgcgcagaggatcccccgcaccagtcaacccaccctctatgacagtagggcccagcacgcggtggggcccaccccgcagtgaccgaaaagcctccccgtcattagcccggacagcgaccggaacccccttcaaaggcaccgccaatgccactgacaggtgggcccgtggttcatcggccccagatgtcagtgacaaaggcacgtacctttgaaggtagaggagcctcctgatcccccctcccacccgcacgccctcgccgccatgtcgtccgccaccgccgccgccaccgccaccatcgccgccgccgccgcgaagctcgccgacacccccggccccgccccct

SEQ ID NO: 64155 - DNA, 1801 bp, Oryza sativa
  unsure (1)..(1801): unsure at all n locations
atagtgaacttcaaactatcattgaaaatgcttaaaaaatacctattatcatgatattaatcttaaagtacttcatgattggattgcaacctgttctttgccaacgccaatagaattatgatatggatgaaccattctttgtaatggagctgaagttacattcttgcatttcagcttcaaaattcacactggcgctgggctaatcattcctgaaatacaaaatgatggcaaggtaaatgccttttagttttttagttattgtttacttttaagcatgataatgccttttgaatttgaaggtataaaccactgtagtttgccattcacctccctcaatcgattttatttatatatctgccattatatggtttttgtttcttggtctgtataacctgcctgggcttgtatgcttcttgcaatttactagcaacatgatactttataccattatgaaggactcgcacaattgttcatagattcatttaaatacagaaaaacctcatgaagtcatacagtttacatttctgtacttctagttgccattttgttcttatgacttcaacttatatttcagtaagtatgccataacaactttcttaagtcatatggcaagcatgtcgtactgatggtttcagtctagcatactgttctagctcttgcaattttattggatgtgttaaaaggaaatatgttggcctgagctttcttagctccagtagtcttgataatacacctatcctgtcaagcgtaagccattaattgactgattcattcttgttgaatgtgattcccaaaaagtatgaaattattttattgatagatccacttgcatttatcttgttcacaggtaaaggttgatatgggccagcccattctctctggaccagatattccaacaaaactgccatccaccaagaatgaagccgttgtccaagctgatttggcagttgatggctcaacatggcaagtaacctgtgttagcatgggcaatccacattgtgtcacatttggcacaaaggagctcaaggtaattgacttgcaagttcatattctcgtagttttaaattacattctgtcaaaaccgttaatatgcctaaatatttcctatacaaatatgttaaattgttgcctattgattcatgtggatcttgcaattattcatttatggggatatcatggcttattaaaacatttcaatattttttatgtttccatacaggagtgcttgcttaggcccaaggtctacagtctagaactccagatcaatttaacgtgttttaatcctattatcttttgtttagtttttagttaaattaactgctgatcctaccagttggctttgtgatccacttgttcattaccacaagatttgctaatattgttgctttcacttccaataaatgtttgcactttctatgttatatacttcatgcaagcttgagaaatgtctctagatgcttcaatacgtgattgcctctgtttattggcccatatgttctgatatagccaacaagatccccctagcaaccataaatatttttttctgctagtgattaggttcctgtgttgtttgaactgtatatatcctagcctatccaggtccaggctgtccatataataatttattgttgtcttggctggaaaaacaggttttgcatgttgatgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcag

SEQ ID NO: 64156 - DNA, 7408 bp, Oryza sativa
caagatatcccataaaatcaggaaaagaaaaaggaaagagttcttaatcttaggtttgccggattttattgcacactgtgtacctgactctcatgaatcttgcaaactttataaaagattaaccggttgcatctttcatctacattttatggagatcaatatgaagtacctaaaaataataataatccttattactatgtgatttttccagaaaagcatcagttcattagataagatttctaaaaagaaaacaaaggaaagcatcccaagattccatttggaatacaagtctagaggatgagctgaaaatggataattagacagatttctgaaaagaaaacaaaggaaagtatcccaagattccatttggaatacaagtctaaaggatgaagtgaaaatgggataattagacagatttctgaaaagaaaacaaaggaaagtatcccaaaattccatttggaatacaagtctaaaggatgagctgaaaatgggataattatactttttaggcttcattcggcactaccatttcccagcttatattccctcattttccacgcgcgcacttctgaaccactaaacagtgtgtttttttttttgcaaaaattttctataggaaagtggctttaaaaatcatattaattaatcatacgctaatgagccatttcgttttgcgtgctgggatgagcagatcctgacctgctcatccgaacacacccttacttggtagagaactgcgagttgatatgtgttcagaaagagtacacgcaacacaagataataagatggaaaagtgaaaaccaaatatgtgtacctgatgcccaatgaacctggccctccttaagcattcacggtacagctacaacatgaaaaaaaacaatgttcaacagcaaatgacatttttgcctcatctgacattatttcatttcattgcaatggtatctcataaataaacacaacgaaaaatcaggctacacgggcatgacagacatgttttggaaaagcttttgtaaagttttagggtgattcactgatagagctgctctaactatacatgtaaaacatttacaagactgactgtagaactgttctaaccaaagaaccatacatgtagaaattagggaccgactatagaaatgctcaaaccaataaccatagatgatacatgtaagaaaattcgggactgactatagagctgctcaaaccaataaccatacatgtaagaaaatttgggactgactatagaactgatccaaccatacatgtaaaaattcaggactgactgctcatcaccacacacaggtcgtgttgatgtcgtcgatcggaaaaggcgtaacgcagaactgagacttactctgatcacattatcagcaagctctggaggcaaagccttttgaatcgaaggcatctccttccacccactcttcagtctctgaaccagtcactgaaaacatgtaaccaaaaaaaaaagatcaaacctctagttaacccacaaaaatatccaattctaccacaaccaatcgccctgccgggcattcttccccacaccagaccaaccatcgatctgaaaacttccccacaccagaccaaccatcgatctgaaaacgaaggttaacctaaccatcaagccaagcccccaatgaactaggacagtgggaatcttgcagtgcagctccgacatggaatcgaacttggcgaatcccatgttcttggccccgctagcctgaggccttaccagctcttcgtccgtcgtcatcggaggaagaggaggagcagggacagaaaagggcgcagacggggaggggtgtacctgtgactgccacggcggtcgccgtggggagggggagattgccggtggcggtggcggcggcgcacgggcgggaggggacgagagcggcggcggcggcgtcgtcaagctgcggcgcatggggaggaggcgttgcagagatggccgatgggatgtttatgggccggagtagagaggcccagcccaagagaaaatttggcccatgggcctctggctctctgaaattgggcttacacgaggagacatagccccacaattgtatatttgtcgacacatgtaattatagaatattatggagggatttttaaaagtaacaatgtaattacaccacaattgtattataattatatttgttaaattttaaaaagaaaatttgttgacgaatgtataggtaatatctaggtgacatatcgtgagttcgggcctaatagtgaatgttcaatttggtaatgttaaattttggcacattcggcattactgagtttcggtggtgctaggatatgttttagttaaagccaaattttggtagaattttcaagggggagacttaaagaattatcaaaatttgctacggtgacattggtaagaatatgtttagtttgttgccctatcggttaacattgaaagtgtcaagaaaaataaagaagccttaaaacttaactttagaactgatttcaagtatttttaatgtgcatttttaatattggtttttaagtcactaaaatacgtatataaaaattttacttataaattattttttatcgctaataaagccgatttagcttataatcaactcctagttaatcgatgggggcatttgtctttctcttgctctatttcaattgcaacaaacgatctgttttttttttctcatgaacttcatttcgatggcttgaactaaatttgattcctagatcgtcaatctcttcagttcaatttttacatatatatttccaaattgattcatgtgcggcaatggcaattcttttcacttccaatatttctgtaaaattattctgtattgggaataatttgctctttcttttttgggaagggaataatgtgctctttctttaatgcaaatgttagagtatatggtagttagagttatattaggataggatttgtttgtttggattccttccatgtctgtaatccttcattatctcctccccatgtactcctatatatatcggccccccgagtctcaacacaatgagtcccacgttacgcagtatacctctcctatactatccaacatggtatcccccgaggctcaatacaatgagtcccacgttacgcagtatacctctcctatactatccaacatggtatcagagcgggcgatctagttgcctctctcacgcttccgccgctgtcgcccccgggagggttctgatctcctcccgaggattgtcgccgttgtcacccccaggagggttctgatctcctcccgggggcggccaccctctcctatactatccaacatggtatcccccaaggctcaatacaatgagtcccacgttacgcagtatacctctcctatactatccaacatggtatcgagcgggcgatctagtcgcctctctcacgcttccgccgctgtcgcccccgggagggttctgatctcctcccgggggcggccaccgttttttgataccatattaagttgcatgcatcgcctctctcacgcttccgccgctgtcgcccccgggagggttctgatctcttcccgggggcggccaccgttttttgataccatattaagttgcatgcatcgccaggccaccgttttttgataccatattaagttgcatgcatcgccaggccaccgttttttgataccatattaagttacatgcatcgcctctctcacgctttcgccgctatcgcccccgggaggtttctgatctcctcccgggggcggccaccgttttttgataccatattaagttgcatgcatcgagttgcatgcatcgcctctcacacgcttccgccgctgtcacccccgggagggttctgatctcctcccgggggcggccaccgttttttgataccatattaagttgcatgcatcgcctctctcatgcttccgccgctgtcgctcctgggagggttttgatctcctcccgggggcggccaccgttttttgataccatattaagttgcatgcatcgcctctctcacgcttccgccgctgtcgcccccgggagggttctgatctcctctcgggggcggccaccgttttttgataccatattaagttgcatgcaccagccagttgtacctaaaagcctaagctgataggaaaaggcgggcaattcactttatacactccaacactccccctcacgcgagaccccctcaagtctcaagcgtggaatattggagtgggctgcaattattttttttaattgcgcgccagccaggattcgaactcgagacctctgactctgataccatattaagttgcatgcatcagccagttgcatctaaaagcctaagctgataggaaaaagcgggcaattcactttatacactccaacagcaaagaatcatgccatttgcaaaaattgctccatggaagacatgaattagtgcttgtacctttttagcggctcactgtttgcaggcatgatatgttgacatgttgttacctataaagaagttccttaatttgataagttggcatcattcacttctttgttggctagcccacaaatcaataaagtgtcctccataaaagcaaaaaatcaggttgggtctcttgattaattgtagtaacagtacctgcttacaaaaagtccaagaaagcacatactgtccattttcgcaggttgctatgtgaatgatgagatggttcccgtgaagagaagagctagctcttacctctcatgtgatcggtttagagcaaatttaaaaccaaacgatcagacaaaggtttttgttgcctagtttcagattataactttacaagaaagctagtagtaaaaagatgcttaattagatgcatgcatgaaaaggaaagtgcatcaggtgatgagtgtttctcatcgaagttcctttatagcttcctgtctagatacgatggagcaattgcttgaccacgtcattagcaagctaaattcaattatatctgggtcccacacctttacccaagttgtagatgactctctttagagtaggtacaatagcaggctattagtcagccgtaaacatattttaatgagataaaagataagagagaagagcagcaaggtacaaatctgtagccagctgcagcgcggactccaagacgcaatgtgtgtatgacaggtgagaccatatattaatagtatagtaagcacttattagatgaattggctgttaaattggctatagatgaattagagctagtagtgggctatactattaaacttgctcttaggtggccaaaggaaaaggtttatctttaattgcatagcatggatcatgccaattaactaatgagttgctttgtccataatttagtagatagatttattgtaaaaacatgaaagtacataaaattattctaatgtacgtattttgtgttagttttactaccattggagtgccatattcattactgaagccattatattggctattcatcatattgcaacaaaatcgttaagctccaaccacaacataccgtgagtaccgtccaacttatcattctattagtggcttgattcacctttattctctatttcggcgattggacccaacttcttccttcactatgatggtcggtcggatttagacttcccacactcgtggaagcgtcaggaccctctagaaacaaaatgtgcgccggagatgcccaaggcaccagcccggatgatcccacttcacttctcttgctatcctcaattcctcatgtccccatatcccttcatctccctatcctctctcctatcaacggccacctttgcacctacctccacactcgtcatctttctctcctatcccagtgcatctcagctctccgctacgacaaccatgtgcttggtggtcaagtcccttggtcatttggcgctcacatgtcgacgctgcagccgattggccccatgtagataattagtaggccaaggaggaagctagagcttatgccacatgagggtcatgcaaatgtgtaggtttgcagctgtggctcgatgatgacatcgcttttcaggacgatgcaaagggagttcgtttgctagggcaacggacgcaggggcattcggtttttctttttggctcgaacgcctagtggagaccgtttcccaaatctaattctctcatccaatcttggctcatccttgttcagctgctcgggaaaatcctatcttaattcccatgtatgttttatgttggatgagtcaaatttatggcaaatttgttttgcttgagctaaaaataatgggattagctacatatatctttatatagaaattctctccaaaaaaaacttttatgcataactatatataatgtaattataaatttgatataatttgaatataattgccttgtaactcaacaaatgtgttgtaccacagtgggggatagcgcccgtcattccaacaggatcatccataacacatatccgacgggtgaaaatttgaaagtttatatcctctaattttcttgcgacaaaagaacatcagttatgaaaataatttcgggtccacaaatataatactacttgaaaataatttcgggtccacaaatataatactacttccgtttcaaattataagactttctagcattgcccatatttatatagatattaatgaatctagacacacatatatgtctagattcatttaacatatatatgaatgtgggtaatgctagaaagtcttataatatgaaacggaagaagtactatttagggtatgccgttaatgccaagaataataagatttaaaatcgagaagaaaatacgaaccggagatcgagttcaattgcctcttttcttgaggcatttgcaaatttaccacatgttttttcaatattacaaggatgccacttgaatgacagttctagtggcatttttgtaattttctagtgacagttttatgataacgattcaaagtagtactccctccatttcaaaatatttgataccgttgactttttagtacatgtttgactactcgtcttattcaaaaaatttaagtaattatttattctttttatatcatttgatttattgttaaatatactttcatgtacacatataattttacatatttcacaatttttttaataagacgaacggttaaatatatgctaaaaagtcaatggtgtcaaatattttgaaacggagggagtagtaaatttgcaattgcctctcttctttctttttttctttttgccgttgcccgttgctagctgtatatacgcatgtatccttggctcgcacgacacgaaacatcaggatcatctacgccgcgtagccacaccaaacaccgaaaaccacctccactcaaatcccgccacgcgtccggtcgcggactgacagggtgggcccacgagccccacccagtcacgccccgccacgcgtcccccctcccttttattattatt

SEQ ID NO: 64157 - DNA, 11142 bp, Oryza sativa
ctgcccgttgctcctcctccgcctcggcgccgccgccgccgctccggtcctgtaggcgcgctgatccgaggttgggagcccagtctcaggacgaggcctagggtttcgtacaccccctcggctgctcggcggtgaggaggggggccgcggcgtcgctggagatccgatctccccgggctcggcggtgaagggggggcgcggcgcggaggttggctgcgctcgatttgggcggtacccccggaattcgagctccctataggcgaggaggacgaggaggaggaggaggagctatggcgtcgagcctgctcacaacggacaagaggttcgcgatccctcatcacccgccccgagccgccgccctcgtgcggtcgggcgattcaatttaattttttatttttaatcgtcgcgagcgggatgttggatgggttgggcatgtagaaatctgtgcattgttgcgaacggagagtttggttatgtttgtgtaatagcctgaaattataggaaaattttagattatttaccaccggtttgatagggtgtcacttatgctggtatatgaagctttggtttcgtttgatttgtgtggatagtagtttctggtggtgtgtaatataggtcatgtgttctttgggtggattggtccgatctagtgtttgtgggggcaatgggcaacggttgcgagatgttcagaagatggttttaccagtgtggtggcatgagaatgatatttaagaaaatgattgtagttatctattcgtctatgaacagagtgttctacttagtatttattcagtgtggacaatttagaaatgtgcagtgttcagtgttggcatacgtgtgttgtacacgtgcatgcatgaagtttgcgataactgaggtttcgtaccatgttaggtttcgtccattcgcagtaagcatgtctgaggaattccaaagcctatccaactgtccagttctataggtctactgatttcacttttgcgccttggtcaagtggcttttacgtaaagttggaagatttgttgtgacatatgtcgtcaagcacgatttggcatattgctgtcgtttggatttttggtctcagacacaattattcatgcgatttaaatgaaatcatcatttcttgtgtatgtgcttctttgttgatggcattttctaaaacgcctttgggtattcccgcggtttctttgcatagtagatgattatgcgccatcagtttaccattcaagactgtatattttattttatttttcaatagtattccttttatgcttgtgtactcaaggtagttcctttaattgttactccctccattcaactatataaggcatggtttacttgtatgcatgttcaactatataaggcacacactattttcagagtaatattttttttgctccatttcccctgctaacttggttctgcagcatagcatttaatacttcaaatgacaatttagtttctgttttgacgtgaggatctggctctttgcgatgaaatgcatgcagttgttttggcttcatagttattgcattgaatgtgcatgcgtgccatagtagttttcgcggtaggagttatgaagttgcatgtatgtaattaaggcactaattgggggcagtttagtcctttctgctggatcattgttctacgtgcaaaaagaaaactcaccttatatagctgaacggagggagtacatggttacgtcagcatttaagcagatgaggtactctatacttcattctttgatacattttgcagatgggctgcccctgcaaggaaatctggcatgaccgttcttggaaaaattccaaaacctattaatttgccaagtcagaggtattcgatttctatctggcctacccataacttgactttattgatttgtttatatgtgaactgattcacgagttcctcatgaaggttggaaaatcatggtcttgaccccaatgtggaaattgttccaaagtaagcagccctctttgttatacttatcacttgcttatgatttaatatttttagatatgcaatatgcttatttggagttctcgatgtttcttgtgattgctattgtgatgtgtttatggtatgtattttaggggcacccttacatggggtagcaaacccacacctacaaccccaaatgcatggaattcctcttcactcctttctcccaagaatgatggaagttccaattcacccagccactttaatggccgaccgtcttctggtggaggatcaagaccttccacagctggtagtgaatcccttgactcacctaatgcttggggttcaagttctcgaccatcgacagcatcgggcacacttccatccaatcatttacaaacaacaacaaatcgtcctcgaagtgcagagacaagaccaggaagctcacaactttcccggtttgcagacaattcttcagagaatatgaaagtatcaataagaactattgacaaatcggtaataaccacaccaaaacctattataactggctgggatgtaacatgtttttcatattattgatctgaactatgcagggatcttcatcacatggacatgggtttactctaagtaccggtgatttcccaacacttggctccgagtcaaacagtcaacgaggtaatctgcatcgtaagatgtctcttgttatttttcttttggatttataacattgtgctctctgacttagcatgttaaattcttaactatattgagcatgtggaacatagacaaaagctattgccattagaacagaactattttggccaattgcagtatttttacgaatgcgttgatgtgcgaatgttctctttacagtttacatccttttattctaggtcatagctctaagggccgcccgacttctagttctggtaaagagacagcgcaaaatgaacaaggaaagagcataacagctggtattactaattaaattgctttttcatcgatgataatgctcattgctgttggaaactttcaattgccttactgtgtggttggtaatgttttgtgtgctaggacctgctgaagaaatattgtcctccaatagccagtctgcggataacataaagacagatcagcatgtgtatgatggaggtgctcccttcccgggtacaagtctgccaaacaaagctcagcagccacagccttaccctggcaacttttgtgtggcccaccacattttgattcatggcatgcgcctccaggtcatcctcctgatggaatgtggcacagaggagcagcaccaggtgggccatacagaccactaggcccccctggtggtggtttccctgttgaaccattcgcttattatggtcagttccagcccagctcagaagcagcagcaaggcagggcccaggacacggtggatatcaacctaaaaatggagacgcgtatctttctgtgcctcctagttcctacatgatgaaccagcctgtcattccagttagaccagtttaccaaggtccaatgtcttacgacggatattatggtcctccgcgagcaaatttcaacaatcccaatgtgagagatccaccttttgttggaggtctcatcaacctggaatattaaatcaattccccaaccagcacgagaagttccatcctggacatcctcagaacagacctggcaaacatgaaacagctcccaatgagcatttcgaatctgatagagtacatgttatccagcgaggacagcctaggattttgcatgataacttaagaggtccccgtgaagtcgagaggaatgctcaacctgcaccaccacttcttccacatccaaatggaaataggattgatgtgaacaagaggtcagatataagagaatcctttaatgagaagaataggatccttatgaagtcagcacctgaccatagaggtccagctggtacaagccatttatctattccagaaaatgtacattcccacccccgggaagctgatgatggtactctccggaagaagttcaaggaagataattcagttgttcctgatcagcagcctgtcattaagaagaatgtggcattaatagagaaaatagagagtttgaataacaaagctagaaatgttgatgcacgtaatattacagaaccattcccatccaaacaagccaaggagatgcaaaaaagtacaagttcaaaggaagatcaggtgataaaatatggtccatctgctgtcaccactacaaattttgccaccatttctgtctgcctgcttatgtttcttatatttctcctatggtgcagaaactaccaaatgaacctgttcttgaaccttcacagtctgaattaactgaaatcatcacagctggaaagcttggcgaatcaactcgtgatcgaacacataggagaggtgattcttcaagaagcagtcaccatggttcttctaaagacaggttagttaataattttgcaggagaggggctgagagaaaattctgcagctgattcttcaccaattgttggttcgaggaatagccaacatgaacaacctcctgaggatgctttgaaactggcacctgtgatggtcactgatgacacttcactagattttgaatctcaggtatattgctgtagatttcttacttattttttcaatattgaagagcttatctagtaccttcctagttttcaatttcttaccatcacaaaagtatacatccatcattctactccagttttcaatttattgctgtagtttttaacaagctttctcaagattgactgccaatcagtgtagtatctttatatatctgttaaaaggattataatacttcatactaccttgattatcttttatttatagtaacacattccattgaaaaagagttgcatttttttgttcagttgactgtttcatcaagtttccagttcattaacctgtactgtcaatgtatttgagatgctggtcattcttcattttgcagtttaaacatagaaatatagaatcattgtctgatagctttaaattaggacatttactgctctactgtttgtttccaatttgccatgttacatgcttaggttaatcttttcattgttttgggttcaaattttatttgaaccttgtgagtacaaacataaaataatatatttaaatatataggatattctggacgctggcatggttctccaatatcaaactgtgatcattatagttttaaaaaatataaattatcatatcactatggaaatatttttttttcatgttaatctaatgaatgatgttttcccacggccatctaaatagtgtatatataattaaaattaaagaaatttgactgcatgctttctataatgtcatatatttctgaacagagcgcaatacaaagttatgtaccaatttctggcgacttgaaggcttgtagctatgcatgtcgcaaaactttgtattaaagttttttttcttgtccttggatgtgaactttttaccttaaaccgcctatagtgttgttgttagttacctacttgtgctgtatgtttttgccataattagatcagcatttagcaagctaccttgactgtagagttttttaatagaatgtagaattatttatagggatgcaatggatgaaatgttgaaaacaggcaactaataatgtaatatctagtgcaaggtaggaattcataaccatgttcttactgactatttttttattggttcttccattcagcgtgcaaaaatgagggagctggctgcacaacgtgcaaaacagttgcaagctgaggaggaggaacggacaaaacaacaaagagcaaaagctcttgtgaagttggaagaactgaataggcgttcatcagtacatcagaagagctcaaatgatgtaccaccagatattgctgatgtgcaacaaaagcaaaaggttggatttgaagagactgccaaacctgctaatttgtctgctgaatcttgtgatgtggcatgtgatggtcacaattctcttcagccaccaaatgatcctaagcatactgaattttctgtacagcccaagcctactgtgctaacacatactctaggtgttggtaaagaccctactattcataatactacaacgttggccaggaactcagagcatgaagcccagaaaggtgtagcgcaatcacatgacattaatgttccaaagcctaagcagggctacagaagaaggcaagctgtgtcagaggaaaaaaatcctagtgagaagtccagtggagcgataagcacggaaagtggtaagaaaattgctgaggccttttcaaacacttcaactgctgttgttacatcacatgatgacaccctggcccacaacaagaagagtgcccgtcactctagaaataagaaaaaggttgacgaagctccagttacttctaagcatccaccagtagcgctcaatgagcagaatgcagtcaaagtccctaatgagccaaaaccacaaactgctggtgttatcatcagtagttccatagttcctactgaaggtactgttgtcactgtgggaagtataatggtgggtggtatttcatttggatctttgaaccaggagtgtgtcaaaccgcaggagagtgtcaaaccggcagatgaagttcatagtagtacctcaaacagccacccaaaacgtcagcaggcaaaaagatcaggaaagaaccagcagtccatccagcctattgagagaccacatgggaatgagggcgctgtatgggcaccagttaagccatcaggacacagcgaacaatctggcgaagccatgtggagcacaggagtagttgctcccactcaaccagctgggctgaacaccaacgatggagagaatgttacaaaaacaaaaagagctgaaatggagaggtatgtacccaagcctctgtccaaagagcttcagcagcagaatttgaggcaaattttaccatcagaaaaatcctgtgaggagaacaagattcgtgacaaggaaatagttgaaaggtctactggtgctaaacctgagactgcacctgaggccaagaaatgggagggcaagaaaactagtaaggggcatggaaagtctcatccttcatggcgtagaaggaatacagatgaatcaactttggtaggaccaaaagctactgagctagcagacaactatcaagagtcacatgaacttcagaagcatactgtgcatcagccacctgaacctgacaagcaagcagatgctcctgccaggaacagttcagttccagctgaaacagtttcatcagtagtcactgttgccaaagaacatggtgcagctaacaagcaaaggcgtcagcatgttaaggctcagagaaatgagggaagtaactacccgaatgagaataaggatcaaatggcagcaccaccagcaccgggcattgattcaaactcatatgaacgtagaaacatgtcaagatctgatgtgaagcacagtggaacagtaccacaacctagatctcattggaaacctaaaaccatccctcagtcccagggaaattcgcatggcaataatgctaaggatgggcatgtggatagtgctactccacaagacagcagcaacaacaaccttgctgaaaacattggttggaacgatgaaaatcatgcacacagtgaagaagttaaaggagaaaagaggcatgtagacgattaccagaagagcgagagccatgaaaatgcagaacagcagcagcagcttagtcatgcgccacgccgacagggccaccacaatggtgggaggtaccacagaggaggtggcacaaacaggggaaggggttatgatgttgggaagcccagccatgtcacaaacgcagaaaggcggaggggtggcactcatctcgaataccagccagttggatcctataacaaaacagcagacttccagcagaacccaggtaccgatgagcgaaccgaaggggctccactgcacatggagcgcgtccacaacaggggtccacgccctgctggccagttggtcaataggaaccctgcctccaccccagctgctaactcttaccgagatgaataaataactatcctccaccctcaagatcgctaaaactgcaagctatctttagttgggtgatttacatttcgcagatgaatggagtatttggatcacaacctgacgccagtgactggtgtgatgcccgatgtcatctcgaccccgtcgtgtctaacatgttcagagattagcaggtcaaaagctatggctgccgttcgccgtctttgacggcggagagtagtagtaggatgtaatggattttgtctgtgcagggccgtttggccctttacgtgtgattgttaattgttctcaggagcatccctcccttgcttcggtgagatgtgatgtgatgttgatgttggaatgtactaacttggagttgattgagaaccggagttgattgagaaccggggttatattagttagtagtatgtaaacagaaaaaatagttcgttttgggcgatctgttgtggggattctgcaggacagactctgatattatcatatcatgttcatatcgtgtttgtgttatctggggaggtcagaattgagatgcttggttttattctcttaatagacatatggttcatgatcctggcaatttgcccaccagtctctgtggtaatataaactcattctgccaaatataggattgagtgggatcggaaatgatcacgtagatttgaactatcgtgatggagactatcttgacaggaaaagtattatctgcttgtattaaacgcaaaggtgagaaattttagttccaacctacaacacatacccaacctcctatcggacacaaatatttgtgcaggcaccggtgtctgatcctccttaaaaacgaccatcatccgcttagaaagatgacaggctagcagatttcaactacattattattactaaaataaatttatgttaagataaattggtttagattggagcgtaacattttaggccgcatttgcaaatttaccaccggttttttcaatattgcaaggatgccactcgaatgataatttcagtagtatttttgtaattttcgtggtagttttgcaataatgattcaaagtagtggtaaatttgtaattgcctctaatttattttaacatgtattcgggtctccttattttatttttaaaaaagtttatctctttcttcttaaataattaagctataacaggcttgttttcctcggctcccgtaaatgttcaatgattacttcgcgttcattaaagattcttgtaattttttaaggaaaactgagtcacggtatcaacacataattcttctttctactagtactgtacaaatttaggtagatcgccaccactgttggctagtgagcttttttgacataacttttagggcagtcccaatccatagtgtccataaacagtgtctatagtgtcatgtcaataagatatcacaatagaaactacactctacaacccatgatttcttaaagtgggccattaataaatacatcatctcttttctctaccaattatatttattcttcatctattataaagccactattctctcccaatgcaaaacttgatagtgtctagtgcataggttctcgtgttgaagctgtgtcttgcatgagacccaatttcttcatctattcactctctctcttaattaatatagtgtcacataagctaaaagtcctacatgacaatgtagttaatgccatagacaccatcctagatagagagttgagactgcccttaactattgtttttttaatggaacagttctaactaatgttagttgtgcaaaattactacttgttcagctagaggagcatgtttgtcagttgtcactatctctattgatatgaatagagtaccgccggctgtgatgcggatggagtaaaaagtattgacgataaataccctgcaatggactgtaaaatgccaagcatcaagtaaaaaaataggtctagctttggtctattatatgcaaatttaatcaatatatatagcatttacattgtttaagttggcttttttaaacaaaaaagcttcattttgtattgtacaccaaaaccccaatttttatggacggactttgatctcccatgatttaaccaataaaaaaaatgcagtgtggaatgtagtgaaatccacctagttgtaggaatctctattgtttatgtattcttttggccaaacaagaaaaaaagtttttccccaagatataatattttagacattaatcgattaacacagagtacaaaatgctcttacatttctgaacacagtgaaggagtagtaatatactttttttttctttgatgtggaagagcagcaagtaactatgatgtttttcacatgttgcctgacactagtatatggatacaatctctaactaacaacataatgctactttattattacttgtcaatatgtgattatatctacagaaattactctactaccttaaaaagctaagtcgtcctatctaatattttatccctaatctgctcatagcccatcgctacttatatgagttactccctccatcctaaaatatagcaacgtagaatgagatattaactagtacaatatgtccagatatattttaaatattatacagtaaggttctatctagtttttatgttgttatattatgtgacggagagagtaaaagttaaaaggataactatctgaaaatgttttttcatgaaaaagaattatgataatataatttttcacatataaataaatcccacaatacactttcaagattttaagtatacgctcagtatcaccaagcaaatatttcgagattcatcagagactttcagatattcagagcaatcagatattcagatccccatccatccaacccacccccacccacctcagctgccgccgccgccgctgcctcactaacgcctataaatacacccacccacatacgtcagcgcgcacgcgacccaagccgatccgcccgcacccgcacacacatcgctcggtcgaaggaggaggttctagaaacttctggaagcggcggaggtgtggggagagagagagagagagagagagagagagagaggcagagagccatggcgcggaagaagatccgggagtacgactccaagcgcctcctaagggagcacctcaagcgcctcgccgccatcgacctccacatcctctccgcccaggtacacca

SEQ ID NO: 64158 - DNA, 3177 bp, Oryza sativa
gggggggagggggggtaagggttggagttctgaggtgttttggactcggaggtgtgctccgattaggcgaaattctgctcaaagagggctcaatttcgtgttgtcaactggtgattgtagctgtggctgtagctgccggctgatgtggaagtatatgtgatttgttagaatggttagtacctggcaacgaaatctgtttgggtgattgggcaaaatacatttgaattggataaaatgagaatggggaattgtttacagcaatcgtacacttccactgctgctaagcttttcgcatatttgatgcaacctgcgatcatcggagcatcctttgtgctatgggatctcattagtggtatgatggtatgatgcttttgtttgtgggttggatgggtcatgtgatgcacaaggtgtgtcttagatctgttgcgatgatggtgtaaactctgtctgaggtattgctttattgtccttaccaaggttttggtttcggtgtctggttttcctaatgaaattccactgctggtaggtgaactggttggtagcttttgacttggagtgctctgcttttgatatttggttacctttcttttgatttttaaccataatggtagacgtttaatgtgcgctaccgaggtccaaagcttcatcttggatctgagattcaacatctctagtttgggttaggataatcttgctctgatggtgtaggctcatgttgaatttcagtaccatctatgaaaagctaagtgttgtcatatttctaaataccagataggaacaagcaatctattctgatttcctttgaactcaaaagcacactcagctgtgttagaatagctacgcttatgggtgaaaaagagtgaagttagttttgatatattcttgactgcattagcttttgttctgcagtagtttgtgtttaatagtgccgcaatccatgactaatttgaactgtactttttcttaggtcacggaatcaactgatttcacagagctcgtcaaccaagagccatggctctcgtctatgaagttggttgtgaaacccgacatgctgtttggcaaacgtgggaagagtggccttgtggccctcaacctagatcttgctcaagtccgccaattcgtcaaagagcggttgggagttgaggtagttatacattttcccatgctttgcctctaaaaccttgttagttataactattctaagctatccggtatgcctgttatgcaggttgagatgggtggctgcaaggctcctattacaacattcatagttgagccatttgttccacatgatcaagagtactatctttctattgtatcagagaggcttggttccaccattagcttctcggagtgtggaggtattgagatcgaggagaactgggataaggtcaagacagtttttcttcccaccgagaaagcaatgacacctgatgcgtgtgctccattgattgccaccctaccgttagaggtacgcttatacattgtatcaccttccccatgtcacgttgttttttttttaacatgttgacttttctcccattctggactcaattcctctagtgttagaacttattattgatgatacctattttggtctgcattagccatcttgtgctcatgtcattcacgtcttctgtctgaatttcaggttcggacaaaaataggtgatttcatcagaggtgtatattctgttttccaaggtaattcacagttgaaaaataaaaataatctggaattgttgttttccaagataactcagttcattctattgatcttctggcagacttggatttctcattccttgagatgaatccgttcaccatggtgaatggggaaccatatcctctagacatgagaggagaattggacgacacagctgcctttaagaactttaagaagtatgattcaggcttttttttttctagcttacatagtgtccagttcaatcctttcaccatgcttgtcatgctaaccagagcttccatggcataggtggggaaacattcagttccctctgcctttcggaagagtcctcagcccctctgaaagctttatccatgaactggatgagaaggtaacctcatatttctttctttcccctctgaagtctgctgcctgttagtacatatcacttaaatttggatacaaattgaatttcactgcctctgcatgcaaaatattgaatcttgaattgaggttgatgtaatttttcagacaagctcatcgctcaaattcacagtcctgaacccgaaagggcgcatttggacaatggttgcaggtggtggtgctagtgtcatatatgctgatactgtaagtctaactctatccagatcttttttaggttaagttttgaagtttatcagtgccattcacacactggacaatatcaccaggttggagatttgggatatgcgtcagagcttggaaattatgcagaatacagcggcgctcccaacgaggaggaggttctgcagtatgctagagtggttttggatgtaagggctccagaggaaccttttcggctgacagtttgatcattatgtttccgctctgacaaaatgatatttgaatctttgtagtgtgccactgctgatcctgatggccgtaagagagctcttctcattggaggtggtatagcgaacttcactgatgtcgctgctacattcagtggcatcattcgagctttaagagagaaggcaagtttcgattggatcgttgttctgtccccaaccactcccacttgttgccattaaaatcttcatccatcttattattgtctggcttccaaatctggtggcaggaatccaaattgaaggctgcacggatgaacatttacgttcggagaggtggtccaaactaccaaactggccttgccaaaatgcgtacactaggtgcagaacttggtgttccaattgaggtatggacctactggctacttactatgttcttccagcaaaccttagctcagccatttcctacactatttatcagaattcgtcagagattaactttattagacataggacaccattggaccatccccatgatcataacggacgagctgaattcactgaattgcaggtatatggaccagaggcaacaatgactggaatctgcaagcaagccattgattgcatcatggctgaagcataattcagacaactatttgcgctg

SEQ ID NO: 64159 - DNA, 2259 bp, Oryza sativa
  unsure (1)..(2259): unsure at all n locations
agaaagatcgtattgttagaataaactacatctgtaagtttgtaacgtaattacgcaataatgttaatgtttgtttctagttctgaattctctgtgccttggttggtggccttatccaccaaactcaaagagggttcttgattttgtcatgtatgagagacagtgaaatggagggcttagtgacaggaactgcgttgttgtggcttgattattgatgtagtcatatggtcatatattcatatacttcattctttttgccggacttttaatccaacttttggtcactgttagtgtttcaaatcacacctttgcctaaaggtcagatgtggtaaactggtaagagcaagtataataaaaggatgtgcataatatgtataaataagatataatatcatgattattaaaaccaaaacaaattaagattgcatggtattatgagaaaaaaaaaagaagagaaaatttaaaccatatatccatcattaaaatgctaaaaataattagggtgatgtggcttaatagataagaaagaaataagagtaactacacttagtaaggatgaactatatatatatatatatatatatatatatatatatatatatatatatatatatatatgggcatatataatgtagcaataggagggggtcttaagcctctaaagtagtccttatacactataaaaatagtccatacggtagtatttaggataagctctcaatatgcataatgcctacccataagaataaaaaataacaatactttctcttctccctcacatgtcatacaattaagtgggacaagtagaacccaggctaatgccttctcttaccatatacattgtagcaaacaccataactaatacgggtctcaccttattaccaagtactcgtggacataatacatcgagcatatgccctaactatataggattcccaatattttccgagtcgaagatccccaaacgttccggaccgttagatgacacaagcaacggtggatccgaagggataccgcagtagcccttcttcttcacggcagaggaatccaacatcccccggacgggacgaactgcagatcgagtcgcatcgcgggcgagagagagagagagagagagagagagagagagagagagaagacccggacgcggcggcgcacggcggcagccggagaagagcggggcgtggcggcaggcagcagctcgcgggcgtctcctccagtcttgctaacctcgccgcatggggatcggccacgtgctcggcgtcctcggcggcgccctcctcgcccacgccgcctacgccaccatccagtgtatgttgactgattcgccccccccccctccccctgcggttcgagtgattcccgccgcgggcttggatccgggccactgaggatgtggattgatcggatcggggcagtagatcgggtagggttggttcgcgtcgaaatttgtggcttgtatagtaattggtagtagtagttggggggatgaattggatggagaagggttgctgtttggtgggtggctaagttccacgatttgattttttttttgtttgtgcccgtttgctgcagatcgcgccgtgctgaagatcacggaggaggagttctcgagtccgcctatggatgtaagtgttcccccttatcccttcgcgatgctttcttttcttttttttttcggggtatgaatggttgattttctgttgcgtaaagctgtggtggtcaaaacatgtagtatttgggttgcttgatttgacagtgagtttgggggtagggtagatgatggccatgaattgtgtataactaaagtttccagatgacaaaaacaaaaagaaaagagtgatttaggttgtttgacaggagaaaagttgtttgttactatcaccgaatttgctttaagcatgccaannnnnnnnnnnnnnnnnnnncaagttatgggttgaaattgcggttggatgtgtatgagttgcactgtatgtttacgtaattacatgtgacccggttccaaattcgatcctggttgttctgatctagctgcctgttttattggcaacttgactctaaattcgataaattaggccttggggtgtctttgcgttgcataatttatgcttttgattatgcaggtgatgatgcaattgctcctggggttggccttatgcatgtgggcaggtcttgctgttccagcgaagttcctttcagtgctccctcactctgaggagaataggtaaacctgtttggagctaatttgttttcctt

SEQ ID NO: 64160 - DNA, 1086 bp, Oryza sativa
tgtgatacttggtagaccataagttggaaacaagaaaaatcttatttgtttattatgcaggaccttccaaacatagttacatggtatatgcattagaacaaaattattgcggcagaattatgttgctgaaacttattaattttgtgattgtgtaaagttggagcagtcataacacttgataggtaatgaatagaataacatatactgaataactatttgttgatgttcgtgcaatgcaaatcagaggacctgtacaaataaatatgtgaaatatttttggtgttattgtcccatgtcttctagtgataaattaatcctcaaagtttgtttatcttgtacttgatctccctccttttcagggcattagagtgttcctttttattcacaaatccttcaaatctaccataccatacctgaaattcacttattagcacctgaatttggaataatgtggatgatttatgggaattagatcttcctttttttccttttttttctagacctcttttgattcgctcccataatgcataatcttctttagtatcttgaagctttgagagcctgcaccagagctttttgtctgctcttatccaatagttgatggcttgatccacaataataccctgctattctgtactacatcatttctctctaatctgtgttaatgtcaactgcaggattgtttcactcccggctaacctggacttcatgatcttcaaccaccgcggaagggcgctaccttcagacccagacttgaagctgaagacatgattgaacatttacagtttctgttatttaccacagtaggatgatccatccagttattttttttgtgtcactcattgttgagggggagaaacatttccaagaacttaacgtctactatgtgtaactcaagtttttgtgtcacctgaattctatatctgtataccactcaatcttgtgccagtccatgtgaattaccagttattcattcactagcttgtgagagatattgcgatgcatggctctccatgtacacacatcacaattgtagtgttgtggagttcgcaaaaacacatccatttcagcactcaccagtcacca

SEQ ID NO: 64161 - DNA, 1721 bp, Oryza sativa
caaatgagattgtttctgaagtgtcaatttgatttgtttcagaatcgcctgtctgttcatgattgttgtcaatttgtcagtgatctctgattctctgaattctgaaggaaaaggaaattccattaaagcacggcattgccataggcttagcatgcaattaccctatatggaaatgaaaacagcattggtagactgtatcactataatggcaattaatcatgtagatctgaccaaaacggttcattaatccgacaaacagaagagaagaacaatgaagccggtcatggatgtcagacagttcagcaagttcggcatcaaactagtcacagatttcagaagagcatcatgcaagaaaaaaatgcagcatgaataatatatgtcattatgctacctgatacgacagatacctaagtttttcttccaagaactgtcaaatggatggcatatgctattctcatcaagaaaacattgtttactctgacaatcatacgactattagaggaataatctaatgcccataccttcagaaattatattaatatgatcattagacaagaatattcctctaatatctggaaagttatgggcattggattggttgaagagaaaatactaaggatggcacataacctttgtgctgtatgttttttttttccaaacaaaagaaaattttgggctgtttgtgtctgagtgggaggggttatcagtgaattatctttcggtgctacattacatctctgagacaaatctaaaaaccttgtacacataagacaaatacacataaaagattgcatcaacatcaccatatgtcgatcttttgctctatctccatcatcatggggaaatttcttccatgtttgacagtactacatgaagttgaatctacaggatgatgaaatactttttacttggcagcaactagatctaatgatgaatagcaattcttataaatattgatgcgtgaaatagtcaatgcccagctcatagcttcattggttggctactacgatttcaagttctcaacagataaaaaaaatatgaaaggacattgaacatcatctataatctttacgttaaaaaaatcatctataatctttaatatattatcttgttcataggctatgctgggaggcttaggtgatcctatgaggggctgagggcagtttagtttacaatcatatcttagactgattgtacctacttcgctgtcgatccaatgaacaaagatgtatatattgctctagcatgaatctgcttaagaaatcatgcttccatatatactccctctatattttaatgcataatgccgttgactttttttaccaatgtttgaccatttgtcttattcaaaattttttgcaaatataaaaatatttatatcatgcttaaaaaacatttgatgataaatcaagtcacaataaaataaatgataattacataaatcttttcaataagatgattggacaaacgttgataaaaaaaactcaacgacgtcatacattaaaatacggagggggtaacatttttctaaacacaaacacttcacatgccaatttattaagaagggagattttgcagtaatctagtgtcacagtcaaactgtaatggttagtccaataaatctaataattcaaatcaatataaataaatcaatgcatgctttgcatcgaaccgattcgcgatcatctatccttgcctgtggcacttactctttgtttttg

SEQ ID NO: 64162 - DNA, 3222 bp, Oryza sativa
aattcctgcagcccaaaagttgtccaatcttgtaatcaacatttacacaatcacacagggttgccccccactaacatggtaagctctccattctgcattttcatagcacaaatggaacacatgtggatcttaatgagggaatcaaaataaaagcaaactgaaccatctatcaatcatgaagcttaggtttgcatcagagaagtttggagtctagcacttcattcagatgaggagcattcattccatatggaatgccaacacagactgataaaaccatttgccaaataaatagagtaggtggcacaagaatggaatagtttatccttccaactatgcaagattgcaagccctgatatttctggcacaggcaagaacccctttttcactgaatggcactgatacaagcctataataaatgctagtctttgacaattatacagataataatgaacagtaggaaatatggggcaatatttggagaatagtcgagcaataaggcatttattctccttttggctatgagatatcttcatatctcttagcattgtacaatcatgctttcttgatgaaagaaaattttgcagttcattgcatcacactttagacatctagctttgcacgaaacaaatgccgtaccaatgctatataacttcaggcttgttttctcttaatatataaataaaaagtcaaaaattgactgccatttgattgtttttttttcagggaaaaagggacttcattaattatgaacctcagattaatcctgaaggatcctctgtctgacaaatttttaattatcttttttttctcgaatatgcaggagagttgtgtatctttgcatttaagaataataaatttacaagatggccaaaccaaaaattagacatcttctgagttcaagccatatttgctaattcatgactaactttattttgatctctatgaatcttctgaaatgtaaaacccctctttctggacagtagctcattcgtctccctgatcacaaaagcatgatcagatctgtccattttcttggtctgattgttagcctttcttttcccctaaaaaagaggtttgtgattgctaagtttgattgtgattgcttagttagatcgtgtcatcataggcagcaatgatatgaaaaatttaaccaaagcgcattattaacaacaaataactaattagccttgctgttgtcatgcttaaccatgtctgtttaacctagctaacaaaatattttgtctgttagtgcagtttgtttttttatgtcagtggaagctgcattttcagtctcaagagttaggctagcattttacaaattttagatgagctttttctgaatgatcctcaaaagactagtttaactagagagctttgtcagaaaagaaaactcaattaaagcacctgcacgtgtgcaggatgaagccaactaaatcctgttaaaagtgagcctcttaaaactaaatgctggtaaagtgagctcttagctttctttttctctctctatatcaaaccatgggctcaaattgagttctatttgttttttcttaagtaacaattttgtgaacaagggtgaggtgtgcatatcttaggacggatctacttaacttatttacccttaatttggtactatttattatgtagattatagcgcatgcatcaggccataccatttgcacttggttcttttgattattgtaaggaattagttcttcagataactaccgatagtcacttacaagttggttagctcacactaaaataatgcatgtgtatggtcaaaaagtaccataatcatgacctcataaaccatcagacaaattacttcaagcaacttcctctgtcaaaaaaaaataatctaagagcggatggaacacttcctgatacaataaatttggatagctatctgtctagattaattgtattaggaattgtctcatctactactagattggttttttctgagacggaggaagtacactttgaccttgtactccatgttaatcacgtcactcttggacttaaccaaagtgatatgatccactagattagagccccactagctaattgtacttggcacaagatttatttcaaagtaaaagttggaatacatactttgaataaattcataaatacttccttctgtaataggtttaaggttattttgaagtaaaaatattttcaatttatttatccatagttattttctttggtaatagattgataccgttgccagaaattatacttgattttaaaaaaaaaacatcccttattaataagacgaagctcttctattctttttatctttcagagtcgatcaggtgacactttgaccaccaaaatttagcattatatattttttaacaaaagttaaaagtacaagaatgatctgaaagtatttccatggcaagttggccagtacaatttttcagcattctagagtggaactttcatgttactggacagggtggtgattagttcctcatcaggcaacagtaatgacctacttttcatttactttgggcaaaaattaacagcacaataatgtcattggaaatacatgctccgtgactgcacacgaaagcaacagtaattaataatataattgtacatttatatgcagggacaaagttaaggtcaagtcattgtgatccacaaactgaaccaagcttcagtttttgtttcccctgaaaaaaaactttgatttaatttcttaattgagtgaggcacatacatccatgaacaggatgctggtttcaaggagatcctatgtcacactatcatgctaagcacattattttctatgagctgttaagtactagtagattagaaaaagtaatgcatgtgacatagtgaggccaactctgaacttgtgactgatcaatatgtagcagttgtaggttcagaatcatgctacagtacaatcaccccctttgtctatattttctatgagctgtaagtactagtagattagaaaaactaatgcatgtggattactgaaagccaactatataacttgtgactgatcaggtagcagttggtaggttcagaatcatgctactatactagtagtactaatatactagcaacccttttctaaagtttttttttttgaatagtacgatgatgtggtcataaactcgatcataatgtcaggtaattttagtaaaagcatgttgtttatacttgacattcagagaagtacagcaaaaatatactact

SEQ ID NO: 64163 - DNA, 2541 bp, Oryza sativa
aagtaaaggagcacacttctgaacatggaagcaacaaattttcaggattcatttggagttgtctcaagagaaaaataaagactcatttggagaatgggaatattcacatgttcgcagcggcggagccacctcgcgggctggttgggcagccaaccgggctccatgcaaacgtttccactatccttttgtcagcaaaacatgtaaaaaaattatcaatctctagcaaacgctcgttggccctgtttgatttagattattgagcgaggaattaccacagattatttagtcaattataaaagtaaattaaatattttaaaaaatgaacttaacaaataataaaaacaatgcctttggcttccggactcagatgatgccgttggctccgccactgcatgtttgcatatataattgaaatcgaagtagtatttcttattaaattcattagagaactccaatgtgtacttaggccttatttagttggggaattttttttgtttggttatcacatcggatattcacacatttgaagtattaaacgtagtctaataacaaaataaattacagattccgctaataaactgcgagacgaatttattaagtctaattaatctgtcattggcaaatgtttactgtagcacaacattatcaaatcattgcttaattaggcttaaaagattcgtctcacattttatacgcaaactgtgtaattggtttttttccatatttaatactttatgcatgtgtctaaacattcgatatgatggatgaaaagtttttgttttggaactaaacaaggccttaatagctgagagaaaaacaaatatacctaggaacaagcacatgtagtagatgttaatatttttttcccttgataaaattttcaaggaagctagttggttccttccctcggacagacagctaaagctggactggcactgcaaccaaaaccaaaccaaaaaaaaaaatcctcctatgtttacagttactaggaccagttattacagcttaaacctctaacttatcttacttctccaaaaaaaaaacaaagaaatgtatctttcacacaaaaagaattgaagccatgctgcattgctattacttgctgcgtgtcatcccactcagccgacctcgacaactccctcttgtgcttttgcttttcttttactcctcaagccttcccctgatcagttcttgatctgcactttttacattttcttttagctgcaaaagtttcaaactttctttttttttcccttttgtaccatggatttctcatttctctatactaaaaatgttagtagttgtggtgtccattctcacgtcacacctctactactgacatgtgggccctataatctatgctattacatcacctttcaatgcatgacccgtttcactattggttcttcccaaattttaaaatcacctacttattcaataaggaaaatcataatattacttaaactacataaatgcttattaattgattcaataaggtagaaattcaatttgttttccgttgcaacgcacgggctctaggctagtctttttaagaggtcactagactgatgacagtgaagctgcctcttctccactccactgcctatatatctgctgccctctatctaagtccattgccctctgagtctctgaaatcctgaagcttcttcttcttcttccttcctcctcttgctctcttgctcttcctatgctagcactctccatgctcttcttgcccttgtagcattggctccttggtttccatccatggatccacgctaaatgcattgcgaggctgcaaattggtagcattcccttccccgttgcatgtgctgcaactatgtaagcaggagtgtctgatttgacacgcctgaatacagcttctcagatcttcagttttgttgtttgtctgagaaaaggagagagagagaggcctcttttgggtccaagaagagaaaaatggaggagagcttcgtgcccctccgtggcatcaagaacgacctccatgggaggctccagtgctacaagcaggattggaccggaggattccgcgccggtatcaggtaaataaataaataaataaatcttatcttacattgtgttcttgatgaggagtaggattcctgtccggccatggtcccaagatcttgaaaagttactgtaaaagagggagaatatttttcgttgtttaagcactaggttcttgccccaagatcttgaaatgaagcaaatatttgttgtatgttttgtgtttaggatccttgcgccgaccacctacatattcttcgcttcggccataccggtgatatcgttcggagagcaattggagaggaacactggtaaatggagcagcaaaaaatagattgtttcttgtgtttgattttggttactggtaatgacatcaatgagcagaaaacattttaaaaaaagaataagaagcttattttgggtggtaatggttgtgtgcagatggtgttctgacagcagttcagacattggcatccactgcactttgtggcataatccacgggctgcaggaat

SEQ ID NO: 64164 - DNA, 1082 bp, Oryza sativa
tgacaggtgggcccgtggttcatcggccccagatgtcagtgacaaaggcacgtacctttgaaggtagaggagcctcctgatcccccctcccacccgcacgccctcgccgccatgtcgtccgccaccgccgccgccaccgccaccatcgccgccgccgccgcgaagctcgccgccacccccgcccccgccccctcccggcgccgcctcacgctccgcgggaaccccaccgcgcgccgctgcgtcgccgcgatggccgtgtccacccccaggtcggccgccgccgccgcgttcctcgagcgccgcgagtcggagcgcgccctccacttcgtcaagtaccagggccttgggaacgacttcatcatggtgcgacgccttactagcgcttccatttcacttttcttagaaccgatttgttgcttcccttcaatttttttaatcccctttgtaatcagtcgcttcgtctgcacgaattagagcagtctctgctgctttagacgcggtgatttctgtatttttttgatttagtcttggattttttttcttcaggtggacaatagggattcggccgtgccgaaggtgacgccggaggaggcggcgaagctgtgcgacaggaacttcggcgtcggcgccgacggtgtgatcttcgtcatgccgggggtcaatggcgcggactacaccatgaggatcttcaactcggacggcagtgagccggaggtgagcaatccattgcatttctgcagtgcgtgataggaaatgtattcgggtgttggtgttttgtgatatccgtagtgattcgtcaatcataaatgcaatgtggatgatatggactaatctaatgttagcatgatcctcattaggtaggatagtggaaagaaagcgcaaaagctttgcacgttctcaacttctcataaagtttcttgtgtccctgaattgttaggcggggatacttagcctgaaaattaactgtgcaagtgtgtactagctgcttatagctctccatgtagattaggccttgtactagtttaatccacactcagaataggtcatagggaacttaagtgaaatctgctggtactctatac

SEQ ID NO: 64165 - DNA, 1577 bp, Oryza sativa
  unsure (1)..(1577): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaagaacattgttgacgagtgtggttccttgctagtaatttctttgatccaaattatgcatggcttatattggggctttaattaattggattcaccatttcattctattctttttttaatactagcaaaaaagcatgtgctttgcaacgggtaaaaactattttaatattattattattattatatggtttagttacaattaagtttaccgtctaaagttagcatgcgagttttcttatatgactatttctgtatttccaaaagcgaacgaatttaaaaaccgactcaaatacggatatgtatttccaaaagtgaatgaacttaaaaaccaacttatacacagatgatgtaccaaagtaccggcaaaaacatctttattttttatatattttttaataattgtaagttgtgggcatcctataattattcaaacaaggagcctgtttttttctcactctccaaccgagatcaccattttttaaaaaaagtgaccggacacgagatgtgaagaaagcaagaatcattattcgctcctaccgtagattattgttaatgatcctgggataccagaactcagaagcaaccggtcacacacagcgcacatgccacaccgcattaagccagcacgaatctcatgaagatatgatgcatcgaaagaagggctgaggccctgtttgatagagagctccagctcccagctccaccttaagctggagctgaaccaaatggtttagattcatcggaaaggggagcggagcgggatggagcgctcaacctatttacagcgctactcgttatttttcaatgaaattacaagcagaatgccaccgggccgattcacacatccccaagtcacggtcacgcatcgcgtcttctccacgaggccgcgaagagagaagggggagggaggattgaggtggtcgcggcggtggcagtgacaacacacggcgcacggcggcggtggtggtggttgcctcctcttttacaacacctacagctcctagtggagctaccctccactggagttggagtttggagttaggagttggaagctggagctctaccaaacaggaccaaaaagccaaaataaataaatggcacaattaatttaaatagcaaaactgaacaagaattcattggaattgcgtgagcaaactcagacccttggattggatactacatatatatacccctcatgtcccgttagtgttgtggatattttcttcccaactcttgtagtatgcatggctgtttatcgagcatgaatagactttcatgtgttcaaattaatcgggaagtgatcgacacaatcaacggatgagaataattaagtaggaaatggtaaa

SEQ ID NO: 64166 - DNA, 6597 bp, Oryza sativa
gcaattaaaatcatctctttgctaggtcattacacctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcatatgacgtggacctaacttaaaatgtatagctcaaagacaacggttagtccacaattagtgcttgtcattaattatcaaaattaacaccgggggcctagatgcttcaatctccccctttttggtaattgatgacaaacaccacaaatatatataatcaaacatagagcacatggacatatattgtattgacaagcaaaagctccccctaaacatatgcataacaatcacaaatagcaaatatgaagccaatgcacaattcaatttcacatttcaacatatcacaaacacaagagcaatatctcaatgtgaacttcaagaaatattcattcatgagcataagatggtcacaaatatatcaatgtcacaccaaccatccatcatagcacaagttcacattaagaccacataaagggctcacaaataaatataggctattataagaccacgaagggtccaaatgacatagagaacaacaaaacgaaaaaggaacacacaatatagagtaatagcccatacccataccaaatatagcccaatcctccttaacctattaaatatgaggtgactaacctcactactactagacccaacccacaaaacataaaacacgctattctcccccttttgacatcaagcaccaaaaaggtcttcactcttgtggaggaaaaggaggacgcgccgaagtggaaggatgagaagcatcacggcggcgatgatagacaaaagcttgggtactctccaaggtttggacgcgagaatccaatacacccaccctagtatacaatcttcccaccgaagtattcaagttgccaacatcggtgcgcaagccacgaacatcctcatgcaatgcttcatgcccggtggataagtgttgaatgctttcacttagggtattaatagccccaaggaccgggttgaagaagtcatttggttgcattccaaagtaggcatattgaggatggaataaagtacttggatcatacccttgaggaggagggggggctgcacttgagcttgcaccttgatcaaaagttggttggctcacacgaggagctctaggggaggagagttggagacgaggcttgtactccttatgttcttttaaattgtgaccaatttgtcccaacttgctttgaatcaacctcattatgtagggagcataatagattccttgtccaatagtcccctttgagatggtaatctccttcatcataaagttgataacatcaaaccgacgaccatccataatggcatcaataacatgccaagcaactccgcgtatgtcatcattgttgccgcatcttgggaggatggtggcccttactatgcggttgatcacacttgggagagcccttaaacccgccacctttccatatgtgtgccttcccccttcttcataaaactgagaaaagtgatcaatggggaagggattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcacattctcaaactccggtgtctcaccaatgtgcctccaagagatccatttgtgttcggtgaaggctttcttggcatacacttgtacatacacggacttttggaaccgtgtatgaaatcttggatcattacaatcgttaggcctccgaaattgatcatgatgatggaggatagcgtattgttgagcattcctcaaattaagcacaaattggatggaggaatcgaaaggactcccatcatcacttgcctcatcatcttcaccatttccactctcattgtcatcaccatcatcacttacttccatctcatcaccctcaacattttccatattgtcctcatcactttgaacatactcatctccgcttgattcctcattctcactaacgggatcgggcgtgggcgcacgacgaccatgccgagtgcggggaggcatagctgaaaaacaaggagcaaaggatggatgagcaacaattttagaaaccacatagtgaagtgggaggaagggcgagtgctgcctgtcaggggcggtcagaccgagagccacggccggtcagaccgacggctcaaggccggtcagaccgccggccctcggccggtcagaccgcgtccggtcagaccgccactgacacgagcacacccaaatccttccacaatccacacaaatgattctaaaaattgctagaacagtgttgcacaagattggaactagaacatcaaggtgtaggtctattgaagcaatggggaaactacccttaaccctaaagattgaaatagaccgatttgagagcaatgcacaagaggaagagggatttaccggttaaaggagttgaatcacaccaagaaactaccctctattggtgcaaatcgatgaacacctcttccttcacctagggttccatgccatggatcacaaactcaataagaactcaaatcaatctatggaatagagagaggaagaggaggagattcacttacggtgtaaccggagtgattttgacggttgaaccggatggatttggtggagggaggtggctagggtttgggagaggagagaggaggagttttttcgagttggagaagagaagagatgagatgggatgaggaggggtcgggtagaaggaggaggaggaagaaaggacaaagtcctgggcccaccatccctggccggtcagaccggctatacgcggccggtcagaccgccaggatgcagccggtcagaccggtccctagaggccggtcagaccgccgccaccaggccggtcagaccgcgcatatagcgccggtcagaccgcctggccccccagccgactgtgcacagcccttgcacagttcggctacccccacacaataaaattcaacaaaaatttgatttttggagcaattttgaaatgtgtgagttgaaatattgccaaccattcataatatttgaaatttatgaagatttgcaacaaaactcacttgagtgctaggaggtgaccatttatggtctataggggtttttgggcgaatttgattttcaaacaacttttgaaatatttggattttgaatatgatttgaataccaaaaacatttcaaatcctcctctctaccaactttgttttgaaacttttctcagattccttctcaaactcattttggggtttaatctcattttggccaaaaacaagaatctagattcttcaaaagagagccaaaatagtatttttcattcaaaaatcatttttctagcaatgtgaggcttggaaaacatatagggacccttttgaaacattttccaagagatagttttcaaatttcattgattttgcaaaagttttgacttatgttgacttgggcattttaaaaacactactagcacttttagttgatttgcttacatataaaaggaagtagagcacatgcaagagtccaaaactcccccttaatgtgacatgctccattttcgcaatgaagaaccaaatggcaataagtccaaagcataagagcaaataggagcaaatatacaatatgcaaaagaagcaaccatggtgcaccatctcaagccacattagagaagtctatgacatttaactcattcctcaacttgtaaaagcgggtttcatcaagaggcttggtaaaaatgtcggctagttgatcctcggttcttatgtgactaatgactatgtcacacttggtaacatggtctcttaggaagtgatggcgaatgtcaatatgcttggttctagaatgttggaccgggttattggctatttttatggcactatcattgtcacataggagtggggttttggtgaaggatataccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccgacataattcgaatcggaatagccaacaagcttaaatttagcaccttttgggtaccacaaccaaatagtagaggaatgctttaaatatcttagaatccttttcacggccactaagtgacactccttaggaacggcttgaaaccgtgcacacatgcaaacactaaacatgatatccggcctagatgcggtaaggtaaagcaagctaccaatcatggaacgataaagctttaaatctaccggtttacctccctcatcaaggtcgagatgcccgttggttgccataggtgtcttgatgggcctcgcatcctccaagccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttgcaaaatacctcattagtaaaaccgaatatgatgtcatcaacataaatttgacacacaaagaaatcatcaccaatgatttttgtgaaaagagtggtgtcaacttttccaattttgaaatcctttgacaaaagaaaatctctcaatctttcataccaagcctaggagcttgttttaaaccataaagagcttttgagagtttgtaaacatggttaggatttttaggatcttcaaaaccgggaggttgttcaacaaagacaagttaggcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttgtgtgaaaccttgcgccaccaaccttgccttgtttctcaccaccaatccgttctcatcttgtttgttcctaaagatccattttgtccctatgacattgtggtctctaggtctttcaaccaaagtcaacaccttgtttcttgcaaagttgttgagctcttcatgcatagcattcatccaatccggatcacaaagagcttcatctacatgttttggctcaagacaagaaacaaacgagtaatgttcacaaattgaagcgacatgagatcgagtttgaacacccttactaatgtcacccaacacttggtcaattgggtgatccttggaaagagcggtgtgtattcttggaggcataggtggatcttgtgccttctcctcttccacttcaacttgagcttgacttgacgaggcggaagtagatggctcatcatccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacctggtatgccttgctatttgaggcataacctagaagaaacccttcatcacaccgactttcaaatttggttagtctaacaccctttcggtaaatataacacttgcaaccaaaaactcgaaaataggcgacatttggcttcctcacaacaattagctcataggaagtctttttcaagagacgatgcaaataaagcctattggttgcatggcaagcggtgtttatggcttccgcccaaaaggaatcggaaacaccatattcatctagcatagtccttgccatctcaatcaatgtacgatttttcctttccactacaccattttgttgaggtgagtaggtagcggaaagttcgtgtttgataccaagatcatcacaatagtcctcgatattggtattcttaaattcggaaccattgtcacttctaattttcacaagagtgcaactaaattcattttgggccctttttgcaaactttttgaaaagctcggcaacaatagacttatcatgcaaaaaaaacacccaagtatagcgagaataatcatcaacaatcacaagacaatgactattaccaccaatgctcttataggttgttggtccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgaggggctgcaggaatt

SEQ ID NO: 64167 - DNA, 8677 bp, Oryza sativa
atccactatcaagcacccaatggctcccaccggtgcggtagttcacctacaaaagaagatcaagctcttttaggtacccaaacttgtttgagtccttggaggttagagaccaaagctttgggcacccaaatggcattctttttaccaccgagtataggggaacccacatatctagcaacaatgctaccatcatgagccttactaagcatataatgagaatcaaacatacatgtcttaggaggcttaccttcggggcaatcactcaccaaatgcccaacctcacgacacttgtagcaatacttaccatttctcttgacaaaacgagtggcatggtgagaaggtttcttacccttctttggaatgaatccaagtccctccttgttaaggatgcaccgttgctcactcaaaattttgtcaagagtgttcttacccttgaagcatctctccaaactcttgttgagcttagccacttgctccttaagctcattgttctcaacaacaagtgaggcatcacaaatagaaacacacgagctagaactagagcaagggctaggcatatacataagatcatcacaagaggtagaaatactagatgatgcaacatgagcaatatggcaagtagcactatcatcaagcaaatcacaagatatgccaacatcaatgtgagctccatgttgagtagtggaaaggagattgtcatgagcttccttaagcttctcatgagaaatggtgagtctctcatgagagatctttagctactcatacaagacctccaaagaagcatgatccttctttagggccttgaacttgacaatatccttctcactataagcatagagctcctcaaacatactcacaagctcatcataggaaacatcatcacaatcatcatcactctcactatcactaagagatgttaccttagaggaaccctttgccatgagacaaattggagcgaagagtgatggagcctccttgatggcaacaacgaccatcttcttcttcttggagcttgcatcatcaccaccttcttcctcggacccggatgaggcggagctctcctcatttgagtcccattccccgatgaaagcctcaatcttcttcccttccttcttaagtttcttcatgagcttgtagcctccactcttcttcttggatgacttgtctccatcatcatccttggaagggcacttggaagcaaagtgtcccttctcactacactcaaaacacctcaagttggagagagtcttattgggtcttctatttcttctcctattggagttggagccccttcctctctcctttctccttcccaagagatcattgaaccttctagcaagaaggatcatctcttcctccaagtcctcattgacttcattcaccttgctcttgctcttgtcttcaacttcggcttggagagcaatgcacttcttggagggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacattctcatgaggcaacatggagaatgtctcatattggatcttgaggaagtgaagcttggcatccttgtactcacttgtaccctcatggatctccgccaacttgttccaaatctcatatgcggtctcaaggttgctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaaatctaagcagcggaaaaaataagataaacgacgcagacgactccactccacaggcagcttgaccagggctacacctaatcctccacaccatcagcatcactatagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcccggctgcacagttctatctccaaaccaggaatataccattccaaaccaggagctaatcaaattattactagttatagcatcttttattatgatgagaagtgtgagactaatcacgaaagacattgtttgacccgcccttaaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagctgttgcccacgctggcttgtggttggcacggttaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaagattgtgtttaggatctgtgtgacttgccttgctggccttggaactcctcaaattcttctcctgcgaaaacggactctccggaaacgtcggaatctaaacagaaaagagcaaaaacaccaaaacaacacataaacaagcatgaacagtacatgtggatatttttaacatgtagatctcaattttagaaaaatttagagacttgaaccaactaaatccgagctaagatgaattagttatgaattttcaaagattaaatcggattaaatcaattatatgggttttaattgaattatgacgcaataatgaattatttttgaaaaggaaaaaggggtttattgcgtcagcggctagggtttgcggtggaccgggtgcacggcggcggctcacagaaacgaacggccgagatctttccatccaaaacggacggccgagatcgaccggtccacggccggaccacgagagacgacgacgataacgtcagcggtgacgtcaccaccggcggcggctcgggcgcgcaagctcgtcggcgaacgagggcgcgacggcacgaacggagggcaccagcatgtagagagcgacgcggcgaactcaccggtgaccaaaacggcggcggaagatcaacggacggcgacggcgtcgaggaaaaggcggcggagaagatcggcttgacgacgacggcggtgctccggcggtctacagcaacgatggaggggcggacgaggacggcgacgcgacggcgaccacgacggcggccttccagagcgacggcgacgactggagcgacggcgacgcacggctggagcggcggcgacgacggcggcgcaaggctacacggtgctagggcgctaccaacggcgagaggcgaaagcaagggtggcggcgggtagcggcgggcttgggggtccttttaaaggggcaaggaggcggcggcgaaggcccacggcgatcggcgacgcgaaggaaagtttagggttcggaggagagggatcgatccgaatcgaactcgaatccacggatttccaaacgaaattagccgacgattccaaaagagaaaaggtagaggagatctcgggaaacatttcccctcaattgatttcaccggagaaggaaaggcgcggccgaatttggaaggagacggcagcacggctcggctagggttcgggcggcggccggccggaggtagacgacaggccccccacctgtcagcgggcggacgcgcgcgcgcgagcggacggctcggctgcggactgggccggcttgggccagggagagagagagaaggttttgggccgactttcggcccaaagccaaaagagacttttaaaaacctttttcaatttaaattattcattaaatgcaattccatttattaaaaatacttccttagctcaaataaatcccagaaaaatctaggaattatagagttaagcaaagtatttaatgaaattttatctggccccattttatattggaatttattaattaaaactagatcttcttttcaaggcttttaaaatcatttctaataattccaattaaacaacaatttatatatttaggatttttagggtgtgacagttgctcactctatcgaactcctcttggctcaaagagttgaacaaggcattcatggcttgggcattgagttggaggttgcggtgatcaatctccgtcaagggtgtgccagtgatggcaaagcctacatccacaatactccaaatatggaagctcatagctttgaggtgagtagatattttaattttccagtggagtagtttgtgccattaaacatgggagccttccctacatggttcaccttgttcgacatcttctctctaggcggtgaagcccaatcaagagagaccaagctccgataccacttgtaggatcgagatgtcgactagagggggggtgaataggcgatttaaaactaaataacacctaatcaaatctaacctaagttgctaggcttggtgagggtgaactctaactaagcaactaagttatgttttgcaaatctagggtgatagtggctcaaatatatctctaggaaagtaaatcacgctcctatgtcgatgttttgcaatcctagggtgatatgatctcaagtgtgtctctagaaatgtaaattgcacaaatgtaaatgcgacaatcaaatgagacaatgagacaagagatttttcaccgaggttcggaaactcgccggtttcctactccccgttaaggcgagcccaactccaccgctcaaccacgaagccaccgcacgcccccttcgtcaaagggtgggcaaggcgggagccggcccacggagaggactacccaagcctcgatcactcggggtagttcttccttcactccgaaggtggtgaactccaaaccattcacaaaccggcgccgggcctcctccacaatcttctcggagaggtcaccgggcaactcctccacaagccgcctaggaggcggcaaccttcaagagtaacaagcaatgacccggtgtggagatgatcaagtgccacactagctctacaatggaagcaaatgcacttaactcttgcctaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgcggccggtcagactgtgctactctgcaacggctagaaaactagccgttgtagccctgtcagagggccccatcggcctggccggtcagaccgacatggggcggccggtcagaccggcctcggctcggtcagaccgccatcggctcggtctgaccgactacggctccgtcggctctgtatcggccatcccgagcagcatcatctcggcctccaggaggccggtctgaccgggaaagtgccgccggtcagaccgccactatgtagccggtctgaccggccagggcacgccggtcagaccgccacatagtggcggtctgaccgcccctggtcaggccgaacccagtgaatttgtgtaatgaaaaagagagcacaaatgaaaatgcaatgatctaatgtggcaattaaaatcatctctttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcgtatgacgtggacctaacttaaaatgtatagctcaaagacaacggttagtccacaattagtgcttgtcattaattaccaaaattaacaccgggggcctagatgcttcacccgtgagtagttagatgggttcagttttgaaattaagtgattgagtcatttatgtttaaataaggtataaaatatgcccatcctctactaaaataaatcggaaaagttggataatattgaatattgagttgaaatgcaaaaacaatggtgaactcactatatgggccttttgtaaaacctgtgttagttgatgccaatttttagaatggttatggtaaaatgtagagcttttttaaggaaaacacctagcaacaccacggtccacgactgcgaaccacaccctccagcgtgaaaccagtgtttgcaatttcgttttcggtgaaaattttggtcatttcggtagagattgtagtgagttggtactcaatttgtgacttttcatcttttcaaagtaaaatagtatacactcatttgtgaaattatttggtagtttacattgaaaggatttagcaataaggattacttccaaactcccactgatattattaaagtgccaaattcaagttttttgtatggcaaaacatatgatgccttgttttattgtctatatgctcttggagccatattgaacatttgaaccttcttttgttttcaaaacataacatatgttggtttgtaatctagctacaatgaaagccatatttatacacacatggattgttatcgacggtgactatttggtctcatttgctatcgatattggttattcggccttatggcttgtcccccagatctcaagtcctggcttctgggtgcaatcgatctccgtgagcatcatttgcttagtgccaaatgaaacaagaattcactgaaaacgcatccaaaaacctggcccattggattggatacttatatatatacttatatactcctgttcgtcctgctatccgtattcacatcttagtcacaaactctacagtatgcagtatcgtttatatataagcattctaagcctgaacaaattctttcatgtgtttccaatgagagctgcaaacttgttcaactatacgctcaccaacattttcaaccaccagcaactttgccacacctatgttccatatggatgctttatcagggactgattaaattaagagtaaagtctatcaccggtccctaaacttgtaccgttgtgtcatcccggtccctaaactcgcaaatcgactgttcaggttctcaaacttgttcgaccgtatcatcccgatccttaaacttgcagatcacttgtttaggtcctccaatgtcacgcccagaaattcccgaatagaattccaagcagaatgtgcataaaaatccccgtccaggaccagccggggtacacaaacgacaatgttgacattcagatccacgtcttacaaacatcataaaagtcttacagaaatgcagcggaaaacaaaagaaacaggagctaagccttgacttgaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaatagaggtatgatgcagggaattacaaagaagagctagagtggttcatttgcataaatactggcatttataaacaggaatttaatgcgaaaacagttgtaataattaagcagtattaaacatccgctgtccaacgctaacccacgttgcgacaggcccaaccatccacctaaactatccaagttcaacaaattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggttcacccccactcct

SEQ ID NO: 64168 - DNA, 2511 bp, Oryza sativa
aggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccggagcggtggtactaatccaacattaccattagaaccaacagtctaaacattaatatgattttccccattgtgagctagttgaactaagcatggctaagcaattcctagtccaaactctaatcatgttataaccccaagctaacaaaggagcatggtatcaaaatagtatggctgtaataataggtaaccatcccatagtataattgcaaaacaaatgcgatatttgaaagaaaacattaggacatttgcaatataggatcaatatgatcaagtgacaagcatgacttgccttgctctgctgctggaggtacctcggcgactatttcgaagtacaccggagcgtcggagggatcggaatctaacgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaaaaccttaaatcatttattgcgcaatattaaccagggctgacgtcagcacggaggggtgtggcgccgacatgcgggacccaccggtcagcggcccgggagagagagaaaggggtggcggcgcgcgggcccactgtcagcggcacgggagatggaaggggcggcggcgccacgtggcagccgaaccgacggccccgatctacccaagggtagatcggacggcggcgggagctcgcggccggacgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcggctaagcggcgtgccacggctacacggtgcgggagagagagaaagaggaggagggcctcaccgacaacggtcgacgacggcgggcgacggaggacgatggcgacggcgggacgagctccggaacctcctaacgaacaaaaggagagggattagagggagagggaagagcgcgagagagcgagagcgccggccgaaggcggcggccatggcgtcactcaccggcgcacgacggggatgggtctccggcggcgaacctcaacggggaaggggcggccgaggtagatctcgaccccgcgaatctaacggcggcgacggcgcaagacggcggcgagcctagcggcggctagcggcggccgaagtagcaaaacggcggcggcgggtggttgcacggcgcggggacgattgggagctcgggaggggtcggcgaaatggggaaaaagtgagagggagtgccggcgatgcttaaatagggggagagagggccggacgtggccggaagaggcgggattcgccggccgacgtgggggagtggggaggagagagaggcgggattcggttttcgaatcccggccatctcgggcgcgggcgcgagcgggagagagaggggaacgggcgcgggggatgcggcgcacgcgcgggcgtggtcgacgtggcccggggaaggcggagacgtgggcgcggcggcggtttcgggcgcggcggcgcgagcgggatcggcgggaggagggagacgggtccgacaggtgggccccacctgtcggcgaccccgagagaggaggcggcgggcggcctgggctgccggactgggcctcggcctgcggccggcccagcaaggaggagggaaggaaaaagggaaacgggccgacggcccatttgacaaaaaggaggaaaaagaaaggaaaaaagaaaaagaaaaggaaaaaggatttttccctggaattaaaatattgcttgctcaattttaattggttaaaattatttctagcgctctgaaaattccactaaaaatcctgttaatgaattttgacatgtagaactcaagaaaaattccacatgtcacgtccgattattatttgcattactttcttagggttttctcctgattttacctgcattttcttggggtcatttgcaaattaccattttgacttgggaggaaaacttcggggtgtgacatccaacttgttcagttgtgtcaccccggtccctaaacaggacagtctaaaaactttatattaaaaaataattcataactttttcatgtgaactctaataaagacaaactttatatcaaaattgtagccctcgacgggctgcaggaa

SEQ ID NO: 64169 - DNA, 11529 bp, Oryza sativa
cgtaattaggctcaaaagattcgtactcacaatttacatggaaactgtacaattggtattttttttatccatgtgtccaaatatttgatgtgacggaatatttggaagtttgaagggaactaagcacagccacaatgcatcttccaacattcaaaacaagtgcaaacaaaattcctcagcttcccaattttagctgacatagcgtttatatggctcctttctacaaagaatgagaaaaatacatccattttctttcgttcagtttcaggcccaaagaaaaaagacgtcatggtactttaatactacatgaaacgtattaaataaatgagtgtaattgcaagttagaattacataaacacgaatcttaatgcaaaatcctataaacaaaatataaaaaaagaagccccaaaacctgtcacaagtaaaatagcaaaacctatctgtatggagaataatatagctaccaacataaataatcactacttaaaaataattttcctggacgaccacatcaatagattgcaggtggaccaagtatctgtgtctgtaaaaatcgactcacatttttacagacgatcctgttaagcagccgcaaaaaaaaataaggttatttttctagatggacatcttaagaggccaaacgggaaaaatatattttcgcagacggccatcttaaacgtccgcccagtagtttaaattatctcctcttttccctcatagcacttctattttttttcaagccatcctcatcttctcttctctctctcacctcctcttctccacatactactctctcactctctcaaactcccgtacacaaaaatagctattttcgtagacattttagtacgtgtgggttgtcctaccgtacgcgaaaatttctcttgagccatgagaaaaatcacttttgtcctagtggtagccctattggcaaaaaatcatctgcccaacatggtattgcagtgtcgttagggacagacacgagcagcacgttctgacaaatctgcatatatatcttcatcctgaatattctttatagaattatagtctacaaattcaaaactaatcaccaagcagatcatgagcatgtcatttcttctcttaaaagtgccttacagatcaatcgttacatgttatcatttctttcgccgggcaaatcatcatatattgtcagaatcgaataacaaaaaataaactgtgatcttaatccaaaatcaagtttaatttccatctacatgtccgcacatttagtctatggcatgcagtatataacccacacgcttctctacgtttcgacacagccaaagcttcaaaacaaaacatctcatcagtcgagtacggagctgtgctcagagcaatggctgacttccttcctctcgcgatcctgttcgcgtccctcatggccgccggcgccacagcaaactatggctacaccacaccatcaccatcgccgccaccacctccgccacagcagtacaccccgccggcccacagcgacaagctgctggtgaaggtggagggtatggtgtactgccagagctgcgcgcaaaggaacacacacagcctcgaaggcgcgaagccgctgcctaaggcggaagtgtctatcatctgccacgacgccaagaatcgtgccatggtgaggtgtcgtcaggccgtctccaacgataacggctacttccttgcggagctcgatgagaccaaagtcaccgacttctacatgggcgatccacgcaaggcgtgctatgtgcggcttcgggcgtcgccggacatcgaatgcaataaccccacaaacatcaactactctagcatcgagggtgcgccgctccgtgacgagggcaagcggtgggccgaccatggctactataacattatgtacgccaccggcccgctcgctttccggccggcgatctgccctcctaagcactaggctccctatgaatgtgcctacatttatgacacttgcacttgcacacttgcgtgtttcatcaatttgggagaaactagtttgatggtggatacgtggttcttttgtgtttctgttttaattgctgttgctcttgtgtgattgtgttgtaatttttttatgattttattagttttctgcaactcaaacttgatgtaatttttgattaagaaaacttgatgtgattttcagttaatcatttgtaccctctttcgaaaaaaatacaaggtgtgcatacattttgattcaaccctagtaataactcacgaaccataaatctaatataaattaaattttacgtgataaaaataataccgttgaactgagatttggatgtaatttttttataattatggcttttgtggtacaagcatcgtaatatataggacaaagtaaaaagcactaaatattttggaaaaccaattttaactataccttaaattttgaattttgagtacttacgtaatttgcttagtcagatacccttagcgaatgagtcgtaatttgaattttgagtacgtacgtaatttcgaaaattggcgaaagagtcggacccttgttgggccagatgtctgaggcccatacaaaatctgtaatttcgatgtggaaaaagtacagtggaggtccctcatcttatcaccgaattacaaaatcgtcccacgcatcctccaactttcaaaacaagtgcaaacgaagtttctcggtggtgttgtttccaattttagctgacatagcgcctatgcaactcctttctacaaacaatgagaaaaatacactcgttttctttctgttagttccaggccctaagaaaaaagacgtcatggtactttaaaactacatgaaacgtactgcataaataagtgtaattgcaagttagaactacgtaaacacgaatcttgatgcaaaatcatatgaacaacatatcgaaaaatagcaaaacctatatgtatggagaataatgtagctactgacataaataatcactataaaaataatttttctggatgagcacctcaatatattgcagacggacaataagtatccatgtctacgaaaatcgacttacattttcgcagacgaccctattaagcaggtgcacaggaaaatatattttcgcaggcagccatcttaaatgttcgcccagaagtttgagttacctcctcttttccctcctagcacttcaatttttttttcatgtcatccttatcatctctctctcacctcctctcctccatatactactctctcactttctctcaaactcccagacaaaaaaatagctattttcgtagatcttttagtgcgagcgggctgtccaaccgtacgcgaaaatctcttttggcccatgtgcaaaaatctctttcttagtagtggtagccctataggcaaaaaaatcatctgctcaacatggtattgcagtgccgttagggacatacacgggcagcacgttctgacaaatctgcatatatatatatatatatagatatatatagatatatatatcttcatcctgaatattctttatagtctacaaattcttaattaatcaccaagcagatcatgagcatgtgatttcttctcttaaaagtgccttacagatcaatcgttacatgttatcatttcttccgccgggctaatcattatattatatattgtcagaatcgaataacaaaaataaactgtgatcttaatccaaaatcaagcttaatttaacatgtccgcacgtttagtccatgccatgcagtatataacccacacgcctctctacgtttggacatgaattaaatttaaaaatatattgttcctcattttttttaaagaatagttgagatgcaaacttttttacagaaatataccgtcgatctcgcgtaatcgttacgcgaaaatgacacggacgtaatatcacggacggtatcgcgcgatgaaagcgcgagagcgcacagtctcgcgcaacaactgcgcgagaccgcacggtctcgtggaaccaaagggtctcgctgattgaaatagcgataccgcactgacatgcctgttgattaattatcctgattagcaattaattaatcactaatcaggataattaattactaattattattagttaatagttaattaggtaattaaccattgacggccgggactgccatgccggtgttgctgcttgaacaagcgataccgagcggactcgctctttgcttccgcgagaccgcgcggtctcgcgccactgccgcgtgataccgcacggtctcgcgctttcgtcacgcgataccgctggtgacgtcatgtccacgtcattttcgtaaaacgattgcgcgagattgatggtatatttgtaaaaaaaaaaatttatcccgaatattcctgaaaaaaattggataaacagtatattttaaaatttaattcgtttggacacagcaaaagcttcaaaacagaacatctcagtcgagtacggagcacagcaagctagctcagagcaatggctgccttccatcctctcgcgatcctcgtgttcgtgtccctcctggccgccggcgccaccgcaaactatggttacaccacaccatcgccatcgccgcccccgctgccgccacaggtataccccgccggcccacagcgacaagctgctggtgagggtggagagtatggtgtactactagagctgcgtgcaaaggaacacacagcttcgaaggcgcgaagccgctgcctaaggcggaggtgtccgtcatctgccacgatgccaagaatcgcgtcatggtgaggtgccgtcggacagtcaccgacgaaaacggctacttccgcgcggagctcgatgagaccaaagtctccgacttctacatgggcgatccacgcaaggcgtgctatgtgcggcttcggacctcactggacttcgaatgcaataaccccacaaacatcaacaactctagcatccagggagcaccgctacgtgacgagggcaagcggtgggccgaccatgactactataacgtcatgtacgctgccggcctgctcgctttccggccggcaatctgccctcctaagcactaggcaccctataaaaatgcctgcatttgtaacacttacacttgcacagttgcgcatttcatcaattcaggaggcatggaattataattggacggtggatacgtggttcttttgtgtttctgttttaattgctgttgctcttgtgtgattgtgttgtaaattttttatgtttttattagcttgctgcaaatcaaatttgatataattttcgattaagaaaacttgttgtggttttcagtcaatcatttgtaccctctttccaaaaaaaaacaaggtgtgcatacatattaattcaaccctagtaatatctgatgaaccataaatctaatataaattaaattttattagaaaagatgcccgtgcgttgcaacggccaacgggtaaactaaaattatagcaaatataaaaatattagatgattagggtttagtttttcgtgatatgagcccataaaaaaaatatgttgcttacaaataaaaaggttctaaaaaaagaaaaaaaggccccattggaccctatcggcctgctattgcgcgtccggcccataaagagcgtgtggcccaacagtgctatggcccgagatggaggccggcccgacacaggatcgatctaagccactcattttgatggacggctcggatcgattctaaatccatcaaaaccgttggtgcctaaaaccctaaccctaatcacactttcctctcccaccccccaccacgagctcctcctccccctcccatccactctcacgactggcggcaccgctcgtcctccgttgccccctctccgctgctccccctcccccaccgtcgttgcatgccccctctctccttggtccgagctcagcgggggcgctggatctggtgcccccagtcctctgctcgccacggagatcccctctgccggtggctcattctcatacctccacgttgagctcagcgacatcgcggtgttcctcgccgccgggaacataccgttggaggccgtcgtcagggtggtgcgcgcaatggcatggctgctgctcgcggcgtacctgcagttcacgcttgggtggcgccgtgaggagtggttccctgtgccgctgcggctctggtggtcacgccgccgcttgtgggtcgtatgcttcgccggagaagagagaagagagaaagtagggagagagatgaagagaggtaaggaagaaagaggagaggaggaggaggaagaggaagaggggcaattcggtcacgatgtttaacaaagtaggccccttctaggctcgtcagcacaaaaatactaatttaatggatgtggtgtttggtggcaaataactacatttacatagtgtcttctctcaaaagttactttgcgcggtgtcctacagctaaaaccataaagtcgcaatgtcctgtagcaaaatttgcctatattttacatagtccctccatcccataaaaaaccaacttagtattagatatgacatatcctagtatgtactacgaatctggacatgcatatatccacattcattgtctataatatgtcacgtcccgttctagatgggacggtgggagtaggaaatgacatgccatactccttttcagagtactgacataaatactgtagctctatcggcaaaaatcatctgcctgggtggagaacctggtatttcagtgccgttaagggctgcacgttccgacaaatctgcatatcttcctcctgaatattctttatcgcctacgaatttttaactaatcacctggcagatcatgagcatacgatttcttctattcaaagtgccttacagatcaatgattacatgttagcatttctacgcgggctaatcattatatatttcttagaatcgataacaaaaaaaaataaaatgtgatcttcatccaaaatcaagacagttaatttccatctacatgtacccacgtttagtccatggcatacagtatataatccacacgcatctctacgtttggacacagccaaagctacaaaacagaacatctcagtcgagtacggaacacagcaagctagctcacagcaatggctgccttccatcctctcgcggttatcgtgtttgtgtccctcctggccgccggcgccaccgcaaactatggctacaccacaccatcaccaccgccgccgcagcagtacaccccgccggcccacagcaaaaagctgctggtgaaggtggagggtatggtgtactgccagagctgcgctcaaagaaacacacacagcctcgaaggcgcgaagccactgcctaaggcggatgtgtctgtcatctgccacgacgccaagaatcgtgtcatggtgaggtgtcatcgggcagtcgccaacgataacggctactttctcgcggagctcgatgagaccaaagtctccgacttctacatgggcgatccgcgcaaggcgtgctatgtgcggcttcgggcctcgcaggacttcgaatgtaacaaccccacaaacatcaactactctagcattgagggtgcgccgctccgtgacgagggcaagcggtgggccgaccatgactactataacgtcatgtacgccaccggcccgctcgctttccggccggcgatctgcccgcctaagcactaggcttcctatgaagcttcatcaatttgggaggcatggagttctaattggacggtggatacatggttcttctgtgtttctattttttaattgctgttgcccttgtgtgattgtgttgtaattttttttatgattatattagtttgctgcaaatcaaagttgatgtaattttcgattaagaaaacttgttgtggttttcagtcaaccatttgtaccctctttccaaaaaaatacaaggtatgcataaatattaattcaaccctggtatatctcacgaccaataaatctaatataaattaaattttatttgataaaaataataccgttgaactgagatttgaatgtaattttctataattaggctttgttgttacaagcatcgtaatatataggacaaattaaaaatcacttgctatttggaaaaccttgctaaatttaactataccttaaattttaattttgagtacgtacgtaatttgcttagtccgataccagaggttacgtattttcgaaaattgaagaatgagtcggacccttgttgggccagatgtctgaggcccatagaaaatttgtaattttgatgtggaaaaagtacagcggagatccctcattttatcaccgaattagaaaatcatccctcgataaaaaaccagagacaggccaacttccaactttcaactaaacacatccacaatgcatcttccaactttcaaaataagtgcaaacaaagttcctcggtggtattgttcccaattttagccgacatagcgcctatatggctcctttctgcaaacaatgagaaaaatatacccgttttcttttcgtcagtttcaggcccaaagaaaaaatacgtcgtggtactttaatactacatgaaacgtactaaataaatgagtgtaattggaagttagaattacataaacacgaatcttgatgcaaaatcctataaacaaaatataaaaaaacagaagcccaaaaatctgtcacgagtaaaatagcaaaacctatctgtatggagagtaatgtagctaccaacataaataatcactacttaaaaatgattttcatggatgaccacctgaatagatagcaggtggactaagtatccgtgtttgcaaaaatcgactcatatctttatagatgattctattaagcagccgcacgaaaaaataaggttatttttatagatggacatcttaagaggccgcacaggaaaaatatattttcacagacggccatcttaaaggtccgtccagtagtaaaaatatattttcgcagacgatcatcttaaaggtccgtccagtagtttaagttatctcctcttttccctcctagcatttcaattttttttcaagccatcctcaccttctctcctctctctcacctcttcttctccacatactgccactactacataataggtttttacatacggccagcaattattttcacatgcggctaggccattagggaaatcatctgcccaacaagatattgaagcgccgttagggacagacacgagcagcacgttctgacaaatctgcatatatatcttcatcctgaatattctttatagaattatagtctacaaattcttaactaatcaccaagcagatcatgagcatgtgatttcttctcttaaaagtgccttacagatcaatcgttacatgttatcatttctttcgctgggctaatcatcatacattgtcagaatcgaataacaagaaataaaatgtgatcttaatccaaaatcaagcttaatttccatttacatgtctgcacgttagtccatggcatgcactatataacccacacgcctctctatggagaataatgtagctactgacataaataatcactataaaaatgattttcatggatgagcacctcaatatattgcagacggaccataagtatccgtgtctgtgaaaattgacttgtattttcgcagacgaccctattaatctgctgcacaggaaaataagattatttttctatacgaatttcttaaggggctgcacgggaaaatatattttcgcagacggccatattaaaggcccgcccagaagtttgagttacctcatctttctctcttagcacttaattttttttttcaagtcatccttatcatctctcctatctttcacctcctctcctccacatactactctctcactttctctcaaactcctgcacgcaaaaatagctattttcgtagattttttagcgcgagcaggctgccctaccatattgcagtgccgttagggacatatacgggcagcacgttctgacaaatctgcatatatatcttcatcctgaatattctttatagtctacaaattcttaactaatcaccaagcagatcatgagtatgtgatttcttctcttaaaagtgccttacagatcaatcgttacatgttatcatttctttcgccgggctaatcattatatattgtcagaatcgaataacaaaaaataaactgtgatcttaatcaaaatcaagcttaatttccatctacatgtccgcatgtttagtccatggcatgcagtatataacccacacgtctctacgtttcgacacagccaaagcttcaaaacaaaacatctcatcagtcgagcacagcgagctagctcagagcaatggctgccttccatcctctcgcgatcctcatgttcgtgtccctcctggccgccggcgccactgcaaactatggctacaccacaccatcaccatcaccgccaccgccgccgcagcagcagtaaaccccgccggcccacagcgacaagctgctggtgaaggtggagggtatggtgtactgccagagctgcgcgcaaaggaacacacagcctcgaaggcgtgaagccgctgcctaaggcggaagtgtccgtcatttgccacgacgccaacaatcgcgtcatggtgaggtgccgtcgggccgtcgccaacgataatggctacttcctcgtggagctcgatgagaccaaagtctccgacttctacatgggcgatccgcgcaaggcgtgctatgtgcggcttcggttgttgccggacttcgaatgcaataaccccacaaacatcaactactctagcattgagggtgcgccgctccgtgacggtgcgccgctccgtgacgagggcaagcggtgggccgaccatggctactataacttcatgtacgccaccggcccactcgctttccggccggcgatctgccctcctaagggctaggctccctatgaatgtgcctgcatttgcgacacttacagtttcatcaatttggaaggcatggagttctaattggacggtggatacgtggttcttttgtgtttctattttttaattgttgttgcccttgtgtgcttgtgttgtaatttttttatgattttattagtttgctgcaaatcaaacttgatgtaattttcgattaagaaaacttgttgtggttttcagtcaaccatttgtaccctcttttccaaaaaaaatacaaggtatgcataaatattaattcaaccctggtaatatctcacgaccaataaatctaatataaattaaattttatttgataaaattaataccgttgaactgagatttgaatgtaattttctataattagtctttgttgttacaaacatcgaaatatataggacaaattaaaaatcacttactatttggaaaaccgtgctaaatttaactatactgtaagtttagaattttgagtacgtacataatttgcttagtcagataccagaggttacgtattttcgaaaattgaagaatgagtcggacccttgttgggccagatgtctgaggcccatacaaaatctgtaattttgatgtggaaaaagtactgcgaagatccctcatcttatcaccgaattagaaaatcatccctcgatcgaaaaccagagacaggccatgtttagttccacag

SEQ ID NO: 64170 - DNA, 9319 bp, Oryza sativa
gcttagttagattatctcgcctcacagcgtttcctcgtctccttctcgcttccttgtctcctcgccttgccgccgcccgagcaggccgccggcgtgccgagcggcagtgaggaaggcgacagcggggcctttcggcggagaccacgacgcggctgagggctgtaccgagtctggggttccggcccccaaaatctggtggcgtggaaggtgacggggccgtgggcggcggtggccggccgggccgagcgcggctgcggaggtggtccggaggtacggaggcgcgcgagttggcgagcggcgttggccgaaccgcaccttgcgcgcagcagtggaggggtcgggaggcagtgcggcggcgggtcggcaagacgtcggcgacacgattctttgggcgacggtggatgctgtggagaacggcgacgtaagcgttgatgtccggtcctcggcaaggagaaggcggttccggcgaaggtggtttcgtagctagcgggcgaccctaggggcagcggcggtgtgcgagtccaagcaatgacctcctcggttgcggcagctgcagccctagaggcagtggcggcgtaatcaccgatgcagatggttcaggtgaaggtggatccaatcggcgatggcagcccttggggcggcggaggccttggagtccgggcggaagatgatgtcctctctgaccacggcaaaggacgttggcagaggtggtagtgggctgggaatcggagaggcggagaaggattccgacgttggcagcggccctatgggcggcagaggcttaggaatccggtgaagcagatcctttcagcccgtgtctagttggctagttctgactagacgacgatggatgaaggtggactactcggtggtgcgtggcatcggttcacttgaagcagatgaagaaggcaccagtggagattcgcagcgacaacgtactaggggcggttgtgactaaacgacttccactcatcgattttgactatttcaggagagaatgtcgggatgcagggatgtgtcgaggttgtaggttttttgttttttggttgtgtgttctcctctttattgagatttgagtttaagtgctcttatatcattttagctgtctatatccatcgtggatatagaggccggattaatgaaaatccattatctaaaaaatagataccagaggttacgtatttcaaaaattggcgaatgagtcggacccttgttgggccaaaagtttgaggcccatacaaaatctgtaatttcaatgtggaaaaagtacagtggagatccctcgtcttatcaccgaattacaaaatcgtcccttgaccgaaaaccagatagaacacatcctccaacttccaaaacaagtgcaaacgaaatttcttggtggtattgtttccaattttagctggcatagcgcctatgtaactcctttctacaaaacaatgagaaaaatacactcgttttctttccgttagtttcaggcgctaagaaaaaagacgtcatggtactttaatactacatgaaacgtactacataaataagtgtaattgcaagttataactacataaacacgaatcttgatgcaaaatcctatgaacaacatatcgaaaaatagaagcccaaaaatctatcacatgtaaaatagcaaaacctatctgtatggagaataatgtagctactgatataaataatcaccataaaaaatgatttttctggatgagctcctcaatatattgcagacggaccataagtatccgtgtctacaaaaatcgactaacattttcgcagacgaccctattaagtagctgcacaggaaaataagattatttttccatatggacctcttaaggggctgcacgggaaaatatattttcgcagacggccatcttaaaggtccgcccggaagttcgagttaccttctcttttccctcctagcacttaattttttttctaagtcatccttatcatctctcctctctctcacctcctcttctccacatactactctctcactttctctcaaactcctgcacgcaaaaatagctattttcgtagatcttttagtgcgagcgggctaccctactgcacacgaaaatctcttttgggccgtgtgcaaaaatcactttcgtagtaggggtagccctatcggcaaaaaaatcatctgcccaacatggtattgcagtgccgttaggtacagacacgggcagcacgttctggcaaatctgcatatatatcttcatcctgaatatactttatagtctacaaattcttaactaatcaccaagcggatcatgagcatgtgatttcttctcttaaaagtgccatgcagatcaatcgttacatgctatcatttctttcgccgggctaatcattatatattgtcagaatcgaataacaaaaaataaaatgtgatcttaatccaaaatcaagtttaatttccatctacatgtcctcacatttagtccatggcatgcagtatataacccacacgcctctctacgtttcgacacagccaaagcttcaaaacaaaacatctcatcagtcgagtacggagcacagcaagctagctcagagcaatggctgacttccttcctctcgcgatcctcgtgttcgtgtccctcatggccaccggcgccacggcaaactatggctacaccacaccatcaccatcgccgccaccaccgccgcggcagcagtacaccccgccggcccacagcgacaagctgctggtgaaggtggagggtatggtgtactgccagagctgcgcgcaaaggaacacacacagcctcgaaggcgcgaaatcgctgcctaaggcggaggtgtccgtcatctgccacgacgccaagaatcgcgccatcgtgaggtgtcgtcgggccgtcgccgacgataacggctacttccgtgcggagctcgatgaaaccaatgtctccgacttctacatgggtgatccacgcaaggcgtgctatgtgcggcttcgggcctcaccagactccgaatgcaacaaccccacaaacatcaactactctagcatcgagggagcaccgctacgtgacgagggcaagcagtgggccgaccatgactactataatattataatattatgtacgctgccggcccgctcgcttttcggccggcaatctgccctcctaagcactaggcaccctataaatgtgtctgcatttgtgacacttacacttgcacgcttgcgcgtttcatcaattcgggaggcaaggaattataattggacggtggatacgtggttcttttgtgtttctgttttaattgttgttgctggtgtgataattttttaaattttttatgattttattagtttgctgcaaatcaaatttgatgtaattttcgattaaataaacttgttgtggttttcaatcaatcatttgtaccctctttccaaaaaaaaaatacaaggtgtgcatacatattaattcaatcctagtaatatctgacgaaccataaatctaatataaattaaattttgttagaaaagatgccagtgcgttgctacgagtaaactaaaattatagcaaatataaaatattagatgattaattaggttttagtttttcatattacgagcccataaaaaatatattgcttacaaataaaaaggttctaaaaaaggaaaaaaaaaacccattggaccctatcggcctgctattgcgcgtccggcccatgaagagcgcgtggcccaacagtgttgtggcccgagatggaggccggcccgacacaggatcgatctaagccactcgttttgatggatgactcggatcgattctaaatccatcaaaaccgttgctgcctataaccctaaccctaatcacactttcccctcccaccccccaccacgagctccacctccccctccctcccggcggcgcctctccccctcccctccactctcatgactggcgatgccgctcctcctctgttgccttctctccgctgctccccctcccccaccatcgtcgcatgcccctctctccatggtctgagctcaacgggggcgttggatctggtgccctcggtcctccgctcaccacggagatcccatccgccggtggctcattctcgtacctccatgttgagctcagcgacatcgcggtgttcctcgccaccgggaacataccactagaggccgttgtcggggcggtgcgcgctgtggcatggctgctgctcgcggcgtacctgcagttcacgtttgggtggcgccgtgaggagtggttccccgcgccgctgcagctctggtggtcgcgccgccgcttgcgggttgaatgcctcgccggagaagagagaagagagaaaggagggagagagaggggaagagaggagaggaagaggaagatgaagaggggcaattcggtcatgatgtttaacaaagtgggccccctctagcctcgtcagcacaaaaatactaatttaatggatacggtgtctcgtggtaaataaccatatttacatagtgtcttctcccaaaagtcactttacgtggtgtcctatagctaaaaccacaaagtcgcaatgtcctgtagcaaaatttgcatatattttacatactccctccatcccataaaaaaccaatctagtaccggatatgacactttctagtactatgaatcttatatatatatatatatatatatatatatatatatatatatatatatatatatgtccagattcatcataatagaatatgtaacatcccgtcctaaattcgttttttatgggacggtaggagtaggaaatgacatgccctactccttttcagagtactgacataaatattgtagctctatcggcaaaaatcatctgccagggtggagaacctggtatttcagtgccgttaagggctgcacgttccgacaaacctgcgtatcttcctcctgaatactacgaactcttaactaatcaccaggcagatcatgagcatgcgatttcttctattcaaattgccttacagatcaatgattacatgctagcatttctttcgcgggctaatcattatatattgtcagaatcgaataacaaaaaataaaatgtgatcttcatccaaaatcaagacagttaatttccatctacatgtccgcacgttagtacatggcatgcagtatataacccacacgcctcttcgtttcgacatagccaaagcttcaaaacaaaacatctcatcagtcgagcacggagcacagcaagctagctcagagcaatggctgccctgcatcctctcgcgatcctcgtgttcgtgtccctcctggccgccggcgccaccgcaaattatggttacaccacaccatcaccatcgccgccaccgccgccgcagcagtacacccctccggcccacagcgacaagctgttggtgaggttggagggtatggtgtactgccagagctgcgtgcaaagaaacacacagcctcgaagacgcgaagccgctgtctaaggcggaggtgtctgtcatatgccacgacgccaagaatcgcgcaatggtgaggtgccatcaggccgtcgccgacgataatggctacttccgcgcggagctcgatgagactaaagtctccgacttctacatgggtgatccgcgtaaggcgtgctatgtgcgtcttcatgcctcgccggatttcgaatgcaacaaccccacaaacatcaactactctagcattgagggtgcgccactccgtgacgagggcaagcggtggtccgaccatgactactataatgtcatgtatgccactggcccgctcgctttccggccggtgatgtgccctcctaagcactaggcacccgataaatgtgcgtgcatttgtgacacttacacttgcgagcttgcgcgtttcatcaattcgggaggcatggaattctacttggacagtgtatacgtggttcttttgtgtttctgttttaattgctgttgctcgtgtgatagtttttcatatttcttatgattttattagtttgccgcaaatgaaacttgatgtaattttcgattaagaaaacttgttgtggtttctcagtcaatcatttgtaccatctttcccaaaaaaaaaatacaatgtgtgcacacatattaattcaaccctagtaatatctgacaaaccataaatctaatataatttaaattttgtttgataaaagtaataccgttgaactgatcatttgaatgtaattttctataattatggatttgttgttacaagcatcgtaatatatacgagaaattaaaaaccactaactagtttagaacaccatgataaatttaaccatgcattaaattttaaattttgaatacgtacgtaacaatttgcttgttcagataatagaggttactccctacgattgataatacttgtcgttttgaataaggacacggtataaaaaaacaactttgatcattattttctattataatatgtaaaaaggtgttaacaaatatatgatcttattaaaatactttttaagacgaatctataatgtagtcatcatatttaagagacaaatattttaaaaatgatacataattaaagattctaaagtttaaccttaccattgcccaaacgacaggtattattggtccgacggagtacgtatttcagaaattagcgaatgagtcggacccttgttgggccagatgtctgaggcccatacaaaatctgtaatttcgatgtaccccatatgtccatatcggcgcaggcgcccgcacgccgtcgtggaggggttgcgccgccgccgccgccacttgcgagcccctcctcacgtcgtcctctcctccgcgtgcatcccactcggaggactcggcgaactcccaatcccatccccaccgcaggctgtacaccggaatccccaaccaccgccaccggaatgggggcacgggcaccgggttgaggcgttgagcacaaggtggccgtcatgggatttgggagcccaagtggggtgggtgaccagctgacaaccaatgcggtcacaatggggatgtccatgtcccactcccaggaggtttgcatcggcgggctcttgtcgtccgccaggtgtttgatggaatggtccttccgtgttcatcggctgaattgcacaggtttgtgtgtgaaatccagtatttctcgaatattatgaaccgattttggaattactacgattctacggaattacgtatgcagcttattgctgctgctgctgctgctgctgtggtattagcctattaggaatctagcagttcaatgtgcgacctgatatatgacaccgttttaattttaggtatagatgtagaggtgatacttaataaacagtcgggtaaatttaacattgctttcttgtttccatttattttaagccttgcttgtgcattgttcttggatgacctcatttagttagttcatatatatatttcttactacctaatttggtgcatatacaagattcaggttagtattagtgtgactactactagtaacattatcagtataacgctgattacaattgtattgcaagtgatcttttcacagaaagttttattccaacacataattaagtgatcttcagttcttcacacagaaattttgtgttccagtatggttgtttggtacttaagtaagttctgtgtaagtatacatttcaaacacaaaatcacggcatatagctcactgatctatgctacaagttaaactgaccctaataatgccacatttgtggtcatgcatttctattcctttcttggttcagacataacaattttctgttggcttgtataaaattttcaatactaatcttataggatgcatgatgatggaaaaaaatgttgtacgtgcacatagtactataaatcatacaggctaactataatgacagctaaatttacaaggggaagcagactggcaaactcctgaacatataaatataaaaatgggtggatttgatgaagattatttgccaatgcaaggtttcctcactacaattgcaatagcaaacccaacaccaaaacccaatccaacaaagagaaatagtataatgtctgcagatttctcttcggaaaggtgtggcatcacatttgatgttgatttgttgctgcattctttcgacaatggaggcccacacaaaccagcatttcgtataaatgaactattggggagtgtcaagaaatgaggtgactccggtattcttccctccagcatattatcggataggttcaatgttgataggaagtccaaggatgctaatttttgagggatctccccagaaagcttatttgatgagaggtccaaagactcaagttgatgcagactagcaagctggttgggaattggtcctgtaagagcattatgtgacatgttgagaccattgagcatgcttagtgtggcaatagtttcaggaatgctgccatggaatctattatttgagacatcaattagtacaaaggtctttaagatcttaggaaacatcatgtccagtcctttatatgtaaatctagcagtaaaaagatatgttatatggttaaatgtgctgtacatatctccatctttcatgaccaatgtttcgttaatggagactgacatcatggattttagtttcctaaaccattcataaggcaatactcccgagaagttgtttgaagctagatcaagaattcggagatactgtagttcacattcatcatctttagcaagagtaggccccaacggcccgtagaacttattggacttcaggacaaggacttggagtttaggaagaagatgcatccaacatggaaaagagcctccaatttgattgttcgcaacattaagtaccaccaagtttttgcaagttactaatgatttaggtagtgtcccttcaatccaattatagctgacatccaatgcctcaaatgcacagtcttccttcatattatgtggcaactctccgcgaagttcatttcccctcaaatttaatatttttagtgttgatgaattctccatcagacaggaaggaattgagccatttaagatattgtaggaaaggtcaaggatttggagactcttaacagtacaaaatgttgatgggacttctccagagacattgttcatagagacctttagagatagtgtaccagcaagatatggaattagatcaaacggcatagaagaaaaccgattattcgagtaatccaactgagagtctgtactctctttaggtataggtatgggtccttcaaacatattataactgagattgatatatcttgtgtacagggggagcaacgtgtcatgtccaagactggtaaatttgttatttgataggtccaagaagaacgattctttccaagtttcccatgcccatggag

SEQ ID NO: 64171 - DNA, 9194 bp, Oryza sativa
actggagactgacatcatagcttttaatttcctaaaccattcatcaggcaatatgcccgagaaattgtttgaagctagatcaagaattcggagatgctgtaattcacagtcatcatctttggtaagagtaggccccaactgtccgtagaacttattggacttcaggacaaggacttgaagtttaggaagaagatgcatccaacatgggaaagagcctccaatttgattgttcccaacatcaagtaccaccaagtttttgcaagcaactaatgatgtgggcagttgcccttcaaatcgattgtagctgaaatccaatgcctcaaatgcacaatcttccttgatattgtgcggcaactctccgttaagttggttcgccttcaagtttagtacttttattgttgaagaattctccattaagcaagaaggaattgaaccatttaagatattgtaggagaggtcaaggatttgaagactcttaacagtgcagaatgttgatgggatttctccagagatattgttcctagaggcctttagagatagtataccggcaagataaggaattaaatcaaatggcatatacgaaaaccgattatttgagtaatctaactccaagtctgaattctctttaggtataggtatgggcccttcaaacatgttataactgagattgatgtatcttgtgtacaagcaggggagcaaagagtcgtgtcctatactggtaaacttattatttgacaggtccaagaagaacaattccttccaagtttcccatgcccatcgaggtattggcccatgcatttggttatttgaaaggtcaattacgtgtagctcatcttgatgctttactgcattgggaaactttgatatgttgcaggatgctaggctcaattctgctactttgggagaacgcactactgagtcattgactaaaccgtccaccacagataatttattatttgaagagcaaggtctgataaatatggtagtctccagaatgaggtaagttccactgtccccacaaagttgttgattggaagatgcaagctatgcagttgtgtcaagttaaatatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacaccaagggatgacaaatcggcgaagaactcaggtcatacaagtcattttcttgcaagtcaacaacagagatatggcaagctgaagagagactgacagatgggacctgagatcttgcaaaatggtaggctcagaacctgatcttttggagtggaattaaccagagcgttgcaccatccttcccctccattggacatatacacaaagccaagatagagctccctcagattgtcaagatttgcaaccaacctcagaaaatctaccttccagaagccccagttgggaaacgaaggtgccatgattcggcacgatcgtcttcttgattgatcacatagaaaagagttgataaatcgagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagataccccagcgacgtgaggctgaagacggcggcgtcaaggccgccgctctgcaggcgtcggccgcctagatcgaggaaagtgacgcggccgccgtcgcagcggacgcccgcccagcggcagcagtcggtgccggcgcgccatgaccggaacgcggtggcggacgcggtggtcgccgagaacgatcgcttcagctggagcagcgccgccgcctggtccggcaagcatggaagcgagctcgcgatcaaggtttgtagtaggaggaggagtacaagtaacaacggctcgtactctcgttgggctacccgaggtgacatcttggcgggtggcagctgaatgaatgactatattgtatgatgcttgaaactgatttttttttatacatgtagagctagagagagcctgttcagtactccaagcctgacttgtatgactgaattgtgatagtgtgatggtgacatactatatcaagtcaatgcaaatgcaaataatcaaagatgccgttggcatcgtagtcgtatcgtacgtgggacgtacttaacagattttgatcgtgtcattatgtgaacaggtgtacatgcgtgtagacctttgtcatgatcagacaaatcacaaactgtagcacttatggacgaaaacagattaatccgagagcatatccgctccttgcagatggctgtagtgccgcacacgtgacacgtcgcgtatccgtagattcgtcaattcacctcggacactaatcgtgctacgtttggaaatactgttatttgagaaggaatagtctacttttatctcccttaatcgcaaaatggatgtgccctcacaatcttttaaaaagaactttttttagaaataatacaaatttaatgaaaattgtaagtggttgtctgaaatcacaaatttagcaccttatagaacaccaggttgttcgaccaagcttaaaaaattgggaatttgggatgtgtgtgcatacatgtgagtgggttgtgagattgttaacgaccaaatttgataatatcagcatcggaaagggagattagatcgaagcggaatctaagatgaggattgtcgcgggaacagagcaagaattggctggagtccggatcggctacgattggatcggctaagttcgagtcagacttggttaggtaatgcagccgatttcgataatacgacttggtgtacaacatcaggttgggttgatatgcttcaagatgattgccacgcatggatagagtcctgagaaggcaattgtatctattaattaggatattttatgtaatttccttagagatatatttgggcaaaagtctgccgcaaagacttatgatatcttagagtttgttagagataagagtcgtgtccggtatggacatattttgtaattctcgggtataaatagacccgaaccccatgtaatcaaacaacatacgttcaatacaatctcggcacatcgccactctttttgctttcgttttatttcgacgagttcttgctttcgggttgagctgtatcggtttcgatcttcaacaggaggtaaaacttgttatgacggcttgcgttctcgggattagtgcttccatctttatgacactctaatcttgtttatgtaatttatcgagttatcatatatcttacataatcttcggtaatatcgtcatctaacctacaatcggctaacatctgttaatagaaggcggccgattaggttaaatagcgacgttagcttggattatataagatatccaccactctatgaaacatccaacgacttgattgtctagatattgttctttttttcatacttaatgttgcaacagttgagtttgatctattaaatcgtgcttagaatttcaatctctagcctgtcttccggttgccgattaggatagcatcggggtttcagccgatcttacctgatttaactatagttattctatatgcttgatcgacatgttaaatctgccctttatgttaagatcttgttgcttttaagtatattaggcttctgcttggtatgttctacttgctttaatatcttaatattgagcggtattggagtattagccgatgcatgctagatctatctgatcggctatgctatgaacatatataattttgttgttaatatatatttcgatttaagtgatttatactgtatcggcatggcgaccgatctatcccaatcacttgatttaagtatatatcgacataaggattatatattgttaatatctacagccgatcgggtagatttagttcttttttacttatcaatgactgccgatcaatgcttatatgacatcggctcaaagataaatgatatgtcatcggcacttagccgatcggctatcatttatgggtttaaccacggcttctttgtttctatttcttgttgattgcaggatcaaatcaactggcacgctagcatacccgaaggcgagttttagacctgcactggagttaagcagatctcctaggcctcgtgttttccatcaatatagacctgcagcatagtacttgcttgctctctttttttataatcaagccacctaacctgtcgaatggctgttgttcgtcaggtataaatttatgtctgtcaaacaatggttgtttgatataatgctaaatttgtgatttttatcaaccaatatctgtatagctgagatctatataaataaactttacatatagcaatcctcataatgtataaatacaagatatcattaagagaagagagagaagtcgagatagataatattatttattccatatgggtagtccatatgcatacaagtatcttttgttattttttttatatggaccagttgcacaatggttgtaggtggctaaatgtaatgttttattgcttataaactacttttgcactgcattgtaaatgctccttggttctttgcttaaagacgacggttgctgatgttctggatgactggatccttttggttttaggcttttgttgcaagttagggggtgtttagattaagaggtgtaaagttttggcatgtcacatcaggtgttatatagggtgtcgcatggggtattcgggcaataaaaaaaaactaattacaaaatccgttagtaaaccgcgagacgaatttattaagcctaattaatccgttattagcaaatgtttactgtagcactatattgtcaaatcacagagcaattaggcttaaaagattcatcttgcaaattagtcataatctgtgcaattagttattttttagcctatatttaatacttcatgcaggtgtttaaacgttcgatgtgacagggtgaaaaattttagggtgggatgtagaggctgcgttcggtgggacatgttcccaacttctcctcctcgttttccgcgtgcacgtttttcaaactactaaatggtgtgttttttgcaaaaagtttccatacgaaagttgcttaaaaatcatattaattcagttttgaaaaaaaattagctaaaacttaattaatcatgctaaatgctgcttcgttttgcatgacggggaatgagggttcccgaacacagccttagttccgatggcaacatagttttgtcgaaagtctgcagattttttgtgttgccttaggccatcaccaatgcggtgcttcagcccgtgcccctagcgacggacatcccctttttcatcggtgtcgtcccctgcgatggaacgcgtccctctgctgggggatgcggctctctctgtgcctcactagcttttcgtgggaagacgcagccaggcgccgcgttgtgcgcgtgtggagctcgtgggcacggcgtcgtccccccaaatttccccttacacccttgtctctctcgctctccccttggtctcgtcgcgccgcgcccgacaccgctggcgccgcgcctaccaccgccgggaccgccaccgtcggccttagagagagagagaagagagaggcgacggtgatgacgatggatcggcgacgaccggatccggccaccgcgcgccgcggtagccatcgaccaccagctagcgacgggcggagatggcttgaggcgcctgtgctcgccgcctcgcgcgccttgcccggcctcctccgccggtgccttgcccgccaccgccggcgccacggggggcctagatccacccactacggcgccggatctggcgctcccgactgaccacgacgcgaggcggaggatgccggggaggacgccgacgggagagagaggaagagagaggggcggtggtggacgccggcaacaggagaggcggccctcctcgtcgtcctcgccgtcgctcccgctgctcctgtgacgcaccatgacgccgctcccggtccgacgaggccgccgcggccaaggaccgcgccatcgccgagcacgcctcgagtctccggcgagcggcggcaacgagagggagaaggagagagaggtgagcggcggaggggaggaggcgcgccggtaaatgagaagagagagggggggggggagaacagaggggtagtatagtaaaatacctacgtgggctttttgggctaggggcactcgttaggctactagggtatctttcattgtgagggggggtttcccagagagtactctcagttagtgagggtagtcttagagtgttctgattgtagatgcccttagaccgagttctcctttattcttgaggttgcccttagaccgagttccccttttttcttgaggttgctgcgttgaaattctggatcttttgttttctttagagcctgtttagattgtagccaaagtaaaccttaccaaaggcaagatggtaatattgccaaaattttgacatgatttcttatgtatttaccaaatatggtaacaattaaacgtagatatttttttgacaacttaattaaaaaaaattagtatggttgaaaatggtgaacaggcgcttagtccttttgtttcctttaagaatcttgtactccctccgtcttaaaaaaagacaaatcttagatttttgtgtccaacgtttgactgtccgtctcatatgaattttttttataactagtattttcattattgttagatgataaaacatgattaatactttatgcttgacttatctttttaatttttttcataattttttaaaatgaaacggacggtcaaacgttgcacacagaaacccaggatttttctttttttttttttttttacgaagggagtactagctttactatgatactatctcatctctgtcaatggaaattggggcctcaaaagcccttgaaaaaaaaaactacttcgacggggaggcgtagggcaggatgttgcccggcgacgacgaggatggccggcgccgccgtttacaacaccagatgaccagacgcgaggcggccatgtacgcctccggttgctttgcctctctgcgacgcctccgaattgagagaaagtgaagatgtgcagcggcggttggaggcggtattggctgcaggcgggcggggtctctcccggccatcctcgtggcgagctcggggcgatctccctctcctgtacgccgtggctgaagcgcatgccgcgccctggagtacttccactcctcgtcatccttctactccacctcatcccactcgaagtactcggcggaatgggggcgtgtggtggtagaggggtgagattgaggaggcgacgagggagagagatggtatccaaggttccagatcgtcgcagtcggcaattaacggggtctccatggccatggacatgtccaaggaaatgcgcgcagttcatcctattgccatcggtctcgtcgtcctctcctaccaccacgtgttcgaggaaatgcgcctctcagcggctgcaatgtacaggtgagagcacctgaagcgtttcattttccaaatttggtgtatgcggtgcagtatttgggtttaggattcctagaatactcttccattgttgattgtgcttagcatctatcgaaaacgagctcttactggatgtttgatgccgtggtattaggaatggcagtttacttgcatatgtgattgttcagcacctacaatgacgaactcttgggtcactttctgttggtatcatcgcctacatgctaacacgcacatgtctatttcaattctcactgcatttggcctataagaaaatagtttatctctaatactgaaaatgttgtcttctattaggtcattgtcaatctttctgagaaatcataaggaacttcacggacaaatatgacatatagctcttttattgatcatacaataaaatcaatatttttagagttataccattcctccaaaatatcaggcatactttccaatgaccatgcacaaagatataggatgtatttcatattccaattattcccctagtaaccatccagctttaccttttccattcatgaatgcaatagatatagtcactagagataataattgtagctattctagtcattttcaatgtctcaattgtcatgtacaaggcaagatacaccttttctttggacaaagggagtacttggtgcttggtagatccttttgtttttcagcctattttcggccttgattttgcattgttcttagacgagcccagcttggacttttggcttctgtttttattaaatggaattcataacactggatcatatttagaatgcctgttaatttcttctatgaagccataaaaagggaaaataagaaactggaaactaatagcttctgtggatgtgagataaaactataaaagtttagctgactagtttgctctgtagaaaaacagtatgcaaggtgtatgagagctcacttggagattgtgctatttcttaaaaaaattgttgtagtttggacattacaaaatttaactggctgctctgattggtacccagtaacagtttactgttttcataagttctaattctttgttggactcatttaccaattaagaaaaccataacattcttttaataagtaacatctacaagaaacccagaccttaatttcaacaagcattttatatagcactcataagtgatacctgggaaataaggtcatttctaagttcacgctattattttaggtaaggacacacagtgacggggcaaactgcttttaagtaataactacactattttccaaagccaaagcaaagtagattcagtgatatttctaaca

SEQ ID NO: 64172 - DNA, 10554 bp, Oryza sativa
caaatgagttatttgagaaatcaattgctttaaaggtagttagcattctattgaatgtcatatcaaaccctttgtatgtgatagtgatgatgtctcgatagataaatccttgtgaaaagtttgtttggtgctccaaaacttgtccatcatcgacatttgccatcattgatttcagtttctcaaaccattttgggggcaactgaccagatagagtgttattggctaaatcaagtatttgcaagcttgagaagtgatcccttgttagatcactattatggagacccttaattgtgccatataattggtttgatctcagtacaagaactcgaagcttgggaagattccccagccacaaagggaacagatcgaggatgtgattgttactaacatcgaggagttccagacttttgcagtttgatagtgttctgggcagcctcccttcaatttggttgctgttcaaatctatagtctcaagcttacatccttctttaatgcccttaggcaacatcccgttgaatttattccccctcaaattcagtacccttaagcttctgccttctaccagacaagatggaacgaaaccactaaagttgttatcagataagtacaggaattggagtttcttcatactacaaatggaaatgggtacatagccttttagtttgtttttggacaagttaatataggctactttgttaagatacctaccaaatgtacgtagtatggaagagaacccattgtttgagtaatccaatacaactacaccataaggcaatgatatggctggtatgggtatttctccttgaagtctattgaaactgagatttagatggcttagatgtgtaaatgtaacaagagagggagagttctccaggctagtaaatgcattgttcgagaggtccaatgatccaagggtgtccttccaaatctcccatatccatcctggtataactccaccaatcttattacttgaaaggtctagctcaagaatgtcatatagatgtctcagaattcttggaagttttgtgaggttgcaacatgctagtcctaggtgctgaatcttagggagatattgagatggagaatcttctccatcaatcaccgacagcttattgttagagaaacccagaaaataaaggcttcttagtcttcagaaaggcctaagttccactatgccggtcaagtgatttgactcaagattgagatactcaagattggaagacagaaaaatgatttgggaatggggccatgaagccaattgttgcttaaatcaatgtcatacacagatgaagataatggaacagggatgtcttctaaatgaccagaaagttgattagaatctagatatagtgattgcaacgcaggaagtgcgaagatggactttggaattgttcctgcatacacatctagttatagtcaacaagctataatttgtaggctctcttataaatataaataaaagtagcagtgcaaatggactggactcactggagtagaagctaatttttaagttacttgtgatctagggcatttcctagtcaatgcggcaaaatactaaaacatcaataaccttttaaagtaaggagtaggttctattcagtattaccacctgtactgtactactgtaccattagaaactgttgagctatgattgagatttcaaattcttgtagggatctcaccattgaggttgttgtttctgaagttcaaattattgagttggatcaagttcccaatccaagaaggtatgggcccagacatgctgcaattgtagagcgttaaacttgtcagatttgtaagattgataatcgaagagggcatcaatccagagaagttgtaattgccaagctccaggtatgtcaaatgtttaaggctgcctatccaagagaacgacaccagcttcccttgtcctgatcctccatagagccggagaacttccagccagtggagttctctgatcaaaaggatatcagaattcattgaagcctctactgttgtaaggcccaaatgctttagatacttgagattgaccactgatgctggtatggcgttagaacggttggtcaatatgagatccaacacttccagacgactaccaggtaggaattctggcaactgcacacaaagcttattgttccagtataaatcaataaactgcagcctttttagttggaagatctttgtggggaactgaccctcaaaagcattgccagatagctccagaattgttaagaaagagaagttggcaaagaactcaggaaccatgccactgatgacattgagtctgacgttgatcattgtcagtgaacggagtcgtgagaaggagggatcaatgaaaccagacaagccacatgacatgaagctaagtatctgaatctgtggagcagaagctgctacatcgcttgaccaagttgccccgctgctagagaggtccatctcatcaaggtagagctctctcagattgctcaggtttgctatgaaggtctgaaaacttggctccgtgaggtacaaattggggttatgagacaagtcaagagcaagcatgttgctcagatttccaatgccaatggggatctggccagcaaagttggtcgcagagaggtcaaggctgacaagtttcgaaagccgctcaaacccagaatctgggagttgtgctcccatgaagtcattgccactgagggcgaggtttgtgagcaaggtgaggttgaacagtgcagggtgcagcccattgctctgaagataaccatcactgaggtccagcacaacgacatgcccagaagccatgcggcaggtgacgccctcccatcggcagcagtcggtgtccggttgccaggacgagaggcggctcgcgtcgtggaaggagctcttcagctggaggagggcggatgactgagatgtcaggcatctgatggtggtgttgctgctgttggcagcagcatggatggagtatggctgtatgagtatgacgacgatggcaatgaggaggatgagaagagggagtttgtggctgtggaggcatctatgcgtgtagttcatcttgcgagttcacttggtgcttgcttactgaatcatgtgaaaacttgacatcctggctcctgaccatgcatatatatcgcgaatttcattcctctccgtgtgaaaacttgacatcccgtgtcatccaggcctgtttctgtacaatctatggcctatggcctgatttagttcccaattttttcttcaaacttttaacttttctatcatattaaaactttcctacacatacaaacttttaactttttcgtcacatcatttcaattttaatcaaacttctaattttaacgtgaactaaacgcaccctatgttggctagtgagattacataacatcttgcttcctacgatctggtaaagcaacccatcaatggacgtggagttcactccgtctccgtgggaatggcgggcgaagtcaaggtaagctcattcatttaaagtcaagaagaaaaaccaatgacactgttcatgcagtgttggaaccccttcatttttctccaataaaagttagatgaagattaagatttttatggcacgttttttaaactactaaacggtgtgttttgtgcgaaaactttcagtatgaaagttgatcttttaagtttataataattaaaacttaaattaattatacgttaatatcatcttattttacataaaaaaacttaatttttatcatattcttttcttctgaagatggtgttgaaccgttgatccttacatgtgaatttttctgttgtgaaatgacgcctctgttttagtcctgtcgttgtcgatgactgcatggctagtctttagaaaatgaaatatgagcccgtgtcgcggtgtggtagcgtaagcttaacgttcaacccatgtactgtcgcggccgttgaatggctttttgcgtacagactgtttgaatatctggaacgaaacggacctactacctccatcgtaaaataagtatagccatgagttatcttcatcgtaaaataagtgtagccatgagttttctatacttagattatttagacttgagatgtactccctctgccctaaaataacttaacttagatgagatatgattcatcctatatcaacgaatctggatatgtctctgttgaaattcattggtcgatcattttagggcagagagagtgcaatggcatagaaagtttaaaccgcattatcaatttatccgagcaggtacaattgcaggatcaaagttagctttaaacatattttaagaagataaataagaagagagaagagtagcacgctacagatttatagccagctgtagcacggacttcaaaacgcggtgtttgcataacaggtgggaccaattattaatagtgtaatatataaatattgtataaataagctattagattgactataggtgaattggagctagtagttagctatactattaaacttgctctccgggtcaaggaaaaaggagcatcttctctgtggctcttgtttgttggcctgacgaagatgcagaaaagattcgaggacgtgtcctgccatgtacgctaagctttagggtgtatttagctcacgctaaaattagaagtttgattaaaattgaaacgatatgacagaaaagttgaaagtttatgtgtgtatgaaagttttgatatgatgaaaaagttgaaagtttgaagaaaaagttaggaagtagaccagatctaaaatgagatgaagacggtgcaagatggtcaggtaggcctggtccggcaagcatggaagcgagctcgcgatcaaggtttgtatgaggaggacgagtacaagtaacaatggctcgttctctcgttgggctacccgaggggacatcttggcgggtggcggctgagtgagaatgagtgaatgactattgtatacatgtagagctagagagagcctgttcaatactccaagcctgacttgtgtgactgtgaattgtgatagtgtgatggtgatatatactaatatcaaatcaatcaaagatgccgttggcatcgtagtcgtatcgtacatgggacgtacttaacatgttttgatcgtgtcattatgtgaacaggtgtacatgcgtgtagacctttgtcatgatcagacaaatcacaaactgtagcacttacggacgaaaacagattaatccgagagcatatccgctccttgcagatggctgtagtgccgcacacgtgacacgtcgcgtagccgtagatccgccaattcacctcggacactaatcgtgctacgtttggaaatagtacacaactacactgagaccgagagtgctagctggatagtactaaacagagacacccttcttttcaaaaaaagctactaatacactcaatatctatatattttttcttcttaaagaagtttctcttaaattactcaaacgatttataatccgattacatcgttgtgttcgtaacaattaaatctttacaacaagatctcacatgattatattttgatgaaaaatcataaattacttttatgatatgtctaaattacttttagatttcactaagttacttcttagacatataaaagtaaatttagtaaagcttaaaagtaatttacatatattatagaagtaatttataacaaaaaagaaagtaactttaatttagaactatgtctagattcattaacatctatatgaatatgggcaatgctaaaatgacttacattatgaaacggaggaagtaactctctatagtagaaataattatattgtgagtgaactgaaataagaaactatgtagagtaaattcacgagtaaagtagagaagatttataaagtccacaaaatatagaattaactaaaaacaataataaaaataatcaacttagagtattatgaatgtatagaagtaatttagtcaaatataaaagtaacttatatatatatgataaaagtaacttacgtatataataaaagtaatttataaatataaatatttttcatcgtaatataatcatgtaagatcttgttgtaaatatttaattgcaacgaaagtaatggtgtaatcagattgtagattggataattagtttaagagaaaattctataagaagaaaacaagatatgcactattggatatactaatagcaaccaaaactcctaaagtactagcacgtgggtgtctctggttaagactaattggagaggcctctccaattagatttaccgttggaaatactgttatttgagaaggaataagtctgttttatctcccttaatcgcaaaattggatgtgccctcacaatcttttaaaagaacttttttagaaataatacaaatttaacgaaaattgtaaaattagatattggttgtctaaaattacaaatttagcacactgtcgaagaacagattgttcgattgggcttaaaatattgggaatttgggatgtgtatgcatgcacatgcatcgagtgggttgtggagttcggtaggctgcacatgcacatgtactattttcttttttaaaaagtaaaaagtacgaattacctccctgaactatcgcggttgtatgatttacccccctaaactcgaaaaccagacattgctcaccctgaactttcaataccggacaaattacccccttcgaccgaatctagagcggttttgtcctacgtggcgtacacgtggcaatccagtcagcattttattttttaaaaaatagtgggacccgcctatcataccttatcttcccctcttcctcatccttttcccctctctcgggctcagagcgtgcagcacggtgagtggaggcgcgtggaggcggacgggtagtcggtgcgcgggggccggtgatgagcggcgggcggcggcgtgctggggcggacgggtggtcggcgcgcgcgggctggcggcagaacgcagggaggacgtggcaggcaacgggcgatgccgaggaggccaggagggtgttggaggcggcggagagaggtgcggagcctcttctcggttccgacggggagtcagcgggatgcacggcctccctccctccctcccactctctctctctctctctctctctctgctcaggcaggcggccggcgatgaatcatcctcggggtggcgcggcgagtggcgcgcgtagcgtggagggcatggtgggaggcgccgaggagggcatcggaggcggtgcgctacggcgacgagttcgccgtccatccatgtcatccccatcaaccgtcgtcgccgtcaaccggagccacacagccgcgccaacgatttcctctccccggccgtcgcgcccgccgctgctgtaggatcgagatgtcgactagaggggggggtgaataggcgatttaaaaacctaaatgacacttaatcaaaactaacctaagtttctaggctcggtgagggttaagtctaactaagcaactaggttatgttttgcaaacctatggtgatagtggctcaattaattctctaggaaagtaaattacactcctatgtcaatgttttgcaatcctagggtgatatgatctcaagtatgtctctaggaatgtaattgcacaaatgtaaatacgacaatcaaatgacacaaggagacaagagatttttcaccgaggttcggaaactcgccagtttcctactccccgttgaggcgagcccaactccaccgctcaaccacaaagccaccgcacgcccccttcgtcaaggggtgggtaaggcgggagccggcccacggagaggactacccaagcctcgatcactcggggtagttcttccttcactccgaaggtggtgaactccaaaccactcacaaaccggcgccgggcctcctccacaatcttctcggagaggtcaccgggcaactccttcacaagccgtctaggaggcggcaacctccaagagtaacaagcaatgacgcggctcggagatgatcaagtgccacactagctctacaatggaagcaaatgcacttgactcttggctagaacaaccctcaaacacttagatggaagaacacaaagctcaagtgggtgtatgagagatgcaaggggtgtatgcaattgaattgggtgccaagaaagcccccttgatgctggaaggggagtatttatactcccaccaaccaaaactaaccgttgggggcgaaatcccccaactctgtgtgccgccggtctgaccggacgtatgggccggtcagaccgtgctactctgcaacggctagaaaactagctgttgtagccctatcagagggccccatcggcctggccggttagaccgacgttgagtggccggtcagaccggcctcggctcggtcagaccgccgttagctcggtctgaccgaataccactccgtcggctttgtatcggccaccccgagcaacaccatcccggcctccagggggccggtctgaccgcacaagtgcctccggtcagactggccttatgcaccggtcagaccgcgcacttggggccggtcagacccgccagggcactctggtcagaccgccactatgtggccggtctgaccgcccctggtcaggccgagacacagtgaatacatatgtgtgtgtgtgtgtgataaaatgtgagcacaagtctacatgcaaatgacctaatgtggcaattaaaatcatctctttgctaggtcattacccctcttaatagtacggcgaagctaaagataaactagcaaatttgatcgccttacacctcgatcaatttaaaactaaagcactagttttaccgtcttcttttccttcgctttgcgccgtcaattttaatccttcggtgatcatccatgcgtacataataagtgaacctaactcacaatgaatatctcaaagataacggttagtccacaattagcgcttgtcattaattaccaaaattcacaacgggggcctagatgcttcagctgctcgccgccggccggagcgacctagccatgcgcaccgccactcgcctcccagctccgccctccgcctccgcgttcggcggaggagcgggaggctagcggtggagatggcgaggcggccggagagcgtggggttattgacgagcacgaggtcctggactgaagcgtgggagggagctgccacttgagcggcgggagcggtcgcgtgttatcgtcgccaacgaagcagtcgtagacgaagaggctgcataggcgcgggaaggaggcggcgaggaggccggacgtgaggagtgtggcggtgacggaggcggagggcgcccgcgcagctcgggttggcagagaagtcagagacgtagccgagcgagatgctgacaacatgggacgcgttgccatcatcgtcgtcgtcgtcacaaaacacgccatgcgggccggcgaggcagaggtcgtcggggaagccggcaatttttccccttcccttctctgcttctcttgttcacgaggtggaggcggcgaacggtccgtcgtcctggtcgttggcatcgtggccgtccaaccacatccgccggcgaacacagagcaagctcgggcaaccggcgatggaggcggcgagttcgggcggtcggtggtggaggcggaggcagagcgcgtcacgttcgccgtagccgtgtgctctcttctctgcgaatcgagagagagaggcagagaagggaagggaaaaaaacgctgacaagtgggtcccacttgttttttatttatctttgctgactgtatcgccacgtgtgtgccacgtaggctgaaaaccgcttcgaaccatgttagggtggtaatttgtccggtcttaagagtttagggtgtcaaatgtccgattttcgagtttaggggggtaaatcaagctaactaacctgtcgaacggcccaagctgttgtttgacaggtatgcttattgaacaatgcttgtttgacaagatgctaaatttgtaattttatcaaccagcatttacttttataattttccgagataatttcactttgggccatattttattgccaaagtttcactttgtaccaccctttatctaatcttttcactttggactagtgcacaatggaccaccccaaaacacattttcatttcttcgataacttcgagcaaattgttaacggcatgccagcaaactttcatacctatatgcatgacatacttttgtctaaagagacgctagacatcacaagcgaaaagagttagggtagttcactgtgcaacaaaggcaaagttacctagtccaaagcgaaaagattacgtacagggtggtccaaagtgaaactttggtaataaaacatggcccaaagtgcaattcactctaattttccattaaagttgtactatttctaaaaaaaactccttttaaaactagtggaaaccgactccttccataatttaagtttattttatctcacttaattgcaaaatcagatataccctcacaatcttttagattattctactttagttaattataacggaattgctaaccttctgtcgacaaaaaatatatccccaaatcttacagattttggaccatcggatgagctgcgcgattcgtgctccaggccttctcctctgactctggtgaccttctcctcttctccagcgctgg

SEQ ID NO: 64173 - DNA, 1062 bp, Oryza sativa
ggagaggggaaggggagagggctcaccaggggtcctcgccggcgccgttgactctttccggccagtcggcgaggcgggcaaaggtgcggtggggtggtggcggggaatcgcgcgagggacgggatgaggagtggtggcggcgcgatctgaacgggggaggaggagaggagttatggttaagggttctgcacgaatctgaaagcatatccaatggtccaaaattcgaaagatagaagatgggattttctgtcaacagatatatgatagtcccttattataatccagcttattatctgacttaataatctagattataataattttaacccgaaacaaaaaggactgaaaatcgactccttccattatttcgggagcagtttcgttctacatgcacacttcatagtacccacatatgcacaggatgtagccggtcgccgtgtacggctgtacgcctacgatgtactccctccttctaaaagccaaagtcctatttcattatttggtttttccaaaagtctaagtcctatttgtagtcactgtgctatattaaatttttgatcgaaacccaagaagtcattttatttgtagtcactatgtgctatattaattttttttatcggaacccaagaaatcattttagtacttattggttgcatgttcattggttttgtcatatgatgaactagttggcaccccacgtcttgccgcgggatttgctagttttatcgtcaaataaaatcaatattttaaatgattagatgtaactctgtatatatacaaaataaatgataatgtggcttaatatatagcctatgctattacaataccattcatcttttatttttttaaacgttagtgtgatttcttatgatgcacgaaagttattttcatgcacaatctggatgtcgtctattagagtatcctgcacctctttgctttatatcaagcttgtttcaaaaataggtttatgttaatgatgtctaattaccttatgttatccaattgtttataacaaaacaaaaatcgcatcttatacaataatttaagttatattagaaaaag

SEQ ID NO: 64174 - DNA, 9300 bp, Oryza sativa
  unsure (1)..(9300): unsure at all n locations
cccactaataaaaacacatttcaatggcaaaaccacagtaagcaacatgttgagtgaaacctaccttccagttcttttgtaatgttccttggctccagaagtgcacttgctctcttaattgagcctttacttactgaaatggacctccctaacccagtttgaaataatggcaagtgaccatcagcctccaaaaaatttcctgttggatgacagtgattagtatggcaaatatctaaaacgcatcaacagtaaatatttttattgttccaaatttgactagatagtaacacaggtttaaatgaaatgaaaaaaaagccttttacaggaaacttcagaaaaccatgtaccttgcattgaaacacccccctcaggtgtaacagatctatcattcatagtcaggccaccactcatcagaacagacgttggtgtttcagtttgaaaagtagtggtggagacattagtatctccatgtcctgaacccaatagaaaaataagcaaagctgatgaccttgtgcattatgcagtaaaaaaatacaagcctgcacacaaagtttcttaccacttcttttggcacattcttgatctaatactgtccttgccttttgaattgaggtctggctcaccacaacaggcctccctaaccccgtttggaacactaggaattcacggtcagaattcaatttccttcacacagagaagaaatcactaataacaacagctacatttacataactccaatcttaccaatattttcagcacctccatccttcaccacagagctagatctttcactgatcaagactggtcttcgcgaaccagtttggaaaatcagagattggtcaggcctaccaaaatcttccgtgttttctactatgggaggaaagttcattacaaccagaaggcgcacatttctcaataattaggtagaagtatttaactcaaaattaacaagcaggacaatctaatcttatcctcacctgtattattttgctccaggacagccttagctttctggatagatgctacactgaccgatacagctttacctgaaccagtttggaacaatggaaaattttccttgtcatacacatctgccacatctcctgaaagatcagccgttcaaaaagtaaaggcatgattagaattttgtgtaaaattttgctagatgaaattatagaatattctgtcaacagaataaccttgttttggatttgtttgtccctccaaaacagtcattgcattatcagtggagctcctgctgactgggtctggcctaaccaatccagtatggaacatagactgtacagcaatgacagaagaattctcggcatttcctgaataatagattacgaagattcattatcatgatagattgtcgagtgctacacagctcaaactatcctaaattaattagagccaaatatatgtcaccatgcccaaagaaatgaaacattctgcgtaattacacagaaagtaagcagatgacaaacttcctaccttctaaaacagctctagccttctgaattgagcccttgctcagtgaaaccattttacccgatccggtttggaacatcggagacaaactatctttatgtacaccacctgaatttcataagatgcaaaggcgaattataccattgaacctcgagaatgtgtaactaatcagaactttgtacttctacctacagttgaatcatccaacctgatctccaagaagagagattgaaacaaaacttacctttaaatgaaacattactttctcccaatccgcactccaaattagaaccatcaccaaatggttgccctgcaatacatacaagtatcagcctggtatgcaagtcttggagaaagagaacagaaagacattgaattccatgctatcaacaaagcaagaaatgcaaaacttcagaaaagataggcagcaacttttaagaaaaagaaaagtgtgtgggtatcttcatctagtagtagcccgaggaaatcatcacagcaactaaagaggaaagggcatgaccagaagattggaaataattcaaatttattgctccatttttctcttgtttgtttgtaattcagtggactgcaatgacttgttgtcttcgtttcttctaatatatctaagatgtgcggatattatgtgtccccaaaagacaaaaggagggccacaagaccaataaaattgttgtgagaatgtaacactttgaaaaaagcaaaccgcaaaacctcttacttctctcattacttatctcctccgcgacctccccaaccaatgccttggccctctctacagccctctcgctgacggcaactgatccccccaacccagtgcagaacaccgcacctttccctgaatcctcgatcgcttcggccattccatcagcagcaaccagcttatccaaagctgcgatttccacatccacagcaaacaaacatgacacttagtacaatgcagtggcataacaagttcgtaaatgggaggcaagcacgcgcgtgcccgcacacggacgagtggagatgagatgggtggacgaggcggcagtgcggcaccttggttgaagaggtcagccatcgacgggacgctgcatccatcggcggcgccggggcctagggtttcgaggcgaaaggggatcagtaataatgcgggggctcattccacgaacgaatagtacctcgaagagagagagagagagggagagaccgaaccttcgggaatcgcatcgccggatcgcgcctctcccagctccgtcgcagccggctgcggatcgggacgaggaagcggcgcctcactggccgccgccgccggtggcggcggcccgtcggaggcgggtacccagacgaggctcccgtcgggcttcccccacacctgccacctcctctgcatcccggcggcacagccagaaatcgctcgcggcggcggcggcggtgagaggatgaggaagagacgagcaaaaaaaagaaaaaaaatggagaggaaaaaattcaaaacgggaggaggcgaggagggaaaggaaagcgcggagcggaaatggcgaagcggctgtcggtgggtgggctgggcccgggtagattcgagacgggccggcccattagcgggggtgggtgacagcccatcaacatccatttggctggacgccgccgccgccgaggaggattgctagggcggcacggcacggcacgacgcgtcgcgtctgttgcgtcagcgtgaacagatcagccaacccgccgactcgtctcctatcaccacctgtaccgaactgccgccacgtagatcagcggccatggtatacacatcaacgctcaacgcaacaaccaggtcaaacgctatatcaacagtccaatttgcaccctccgtattattaggcataactaaaatttaaaattttaaaacctatttttgtgtttatttgattatttatttatcgtagtttattttttatcatttgatttttaagtcatcagtacacacaatatataaatgttgtacacataagttcttttcttgataatgtgttcgctaccagggatgggaactttgcatagtgcgtacggaaaacggggcggcctattagcacgtaattaattaagtatttgctattttttttaaaaaaatagattaatttgattttttaagcaactttcgtatataaactttttgcaaaaaaacacaccatttagcagtttgaaaaacgtgcatataaaaacgagagagatgagatgagaaaaatggcatccgaacacaccctatagtcttataatcaactgtagacgaacgaaacgtaatgattttccctgttacacggaaaatatacaacaccacagatacctattatacgcgcacacagtcacaaaagtatacccttttacacacactcatttttcttttttaaaaaaagaacatactcccttcgttctaaatataagagcttatctagattcataatactgtaaaatgttcaattttagatttaactgcgatgcattcgaagttggaatttttcaaggatgaatcgacagaccatccatccaagttgtaagttgtatatagttcatgaaaaaaattaaaaatttatgtgtagaaaagttttgaatgtgatatgatgtgatgaaaagttaaaagtttgggtaattgaggtgtactaaacacgagcagccgtaagtttcaaaaatttccggcaggagaattcgtaatgaaattcgattatcgaaacggggacgtgttgtcaccgacacgaggacgcgaacgcgagagggagatgccgtgacaggacgcggttgcgggtgcccgtggcacaactcgtgtgttgacccgcctcgcgctcgcctgccaccaccgccaccgccagcgagctggatgagccagcagccgcccccgcccgcggttgcttcccctccccaccacgtcaaaacccaaccccaaccatgatgctcctgcgccaccaccaccacccccacagcggcgccgccaccaccagcagcagctgcagcggcggcggcggctgttagagaggagggcacacaccaccaccgacaccgacacgctcgccatgccaccaagcgaggcggcggcgtgaggcgacgcagatctgaacggaggaggaataggaagaagggaggaggaggggagggagaggagttggaagagttggaggaggaggagatctctttcttgttcccgctcgatggagcggggggaggggaggaggggagattgctccgtgcaagtgaggtgagctgggattttcttgacttgttttttttattctttttttctctcgtgatgaatctctgagcattgctgagagcggcgctgcttgtggttgttgtggagtagttgcggcatggaatcgatgcatgcttgtgtgcttactttttatcggtagtaattcttgttatgaacatgttgaaagtagagtaaggctatctgtttgtccgtctaattcgtttgaagaatgtttttgtttccctttcgtcaagtttattattagttgggaattatagctggatgagatttcaggacggcgtctagtagctttcatgtgttaaatcgggtggaatagtgacacccttgaaattgaaattgagtgggaaatcttctgtgttcttggcggtgcacgtgctgttgcttgtggaatgccatcgtggcgcaacatgaaaaagaaaagaagtattttattcttagggccgcttaccgttgattgctgatagcctccttgatttttggacaaatgaaaaggattccgcttttggtttgttgtttttcataatttcaattgcatgctgtttcgatttgtgtcttgcaatgttcagctttgtggaattattgagttacctcattgggtcaggaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagaatatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctattagagtagtagtcatgctgcgggtcaataggaatatttcattctagctgctaggggatacttcaaatatctgcaacctgaagctttgtagtcatttacggttttcgtcttactgggtaatagctttatatatactataagccaactggtacaagaagttgtactgtgtgttgagtgcactgtggtaaaaatgaatctatatttaatgagcttactctgtcaatatttttgcttattttagtgtggttaaactcaggttagatattcaaaacgagtggcagatacttcaaagactttaggatcgaattaaattctcaaacaggtatattaggaagtttatttctgcatgcataaaagtatgacaaactatgatagtacaaatttgcatgcatatggaattttaaatacttaaacatactactatcgcattatagcgctctatggtcattcaaagtaccaaaagatacatcatggagatttcataaggggaagttgcagacattctctgaattcaagcctccttgtttcactgtgaaaggtcttctgtttgttaggccagtaggtcagccaaatccagcctctaatctcccagtccatggtcttccctaatgctgcaccacagatcttccaccagacgctgtctccatattcatcacgtgcgaaaatgacaccacccttcttcgtgaatgggcgatacacggtcgagtacctgtcacgaaaccaggcccgtggctgaagcagggagagcttggaaggctttgaagaataaacctcccttccgtttacaccatcatggagaaaccagttcaaggttgtagtgtttccatgcacagactgttcaaatttccagggtttcatggtcagtgtgaggctttcgctgaccgatgcctttagtccaaatgtgtttggggggtcgaatgaaccttcaatgcccttctcaaggccaaactcatgcgtggggttgtcggaggacttgctgactgaaaccgacaggacatctgattgttgcataggtgtgatttgcagcataacacgtgatggaaagtgcttctcctcagagccatgtccacgttcagtcatgaggatctcggagaccaaagagtccacatcacacctgagatgaatccactgtaagtgccgctcttggttttagatgatacacgtatggttgttttttttccttgtgcagttaattgtaactttgaaacaattcagtttgtagatagactgcttttcaaggtctagaaaactctgatttaactacctaaattgagttcttctgcagctggtatacagggagaagcatgttaccgaactatgcataattgcttgctcaatgttaccttactgtaggcaccaaccaaattatttgctagttaaacctttagctttttttaccaaacatatgcagctacgctttgcatgccgcaaacttaattggttcccccgagtgatactactgtcacctcaggatgagtaggttttttattttcacctaaattagtaagtgtgtatacagttcatatgagatagaatcaaatccttgaataaattactgaccttatgttgtccacctttatctcgacatcaatccagttgtcccttctgattgttttgtaggcgagctgaatcacaccttcaagttgctgataagtaagcgagaagagaaggcgctcatcctgtgttggcactgcaggatcttccatgctcatggcaatgagtgggcagtatagctggaccttccagagcccacttgctgaaagagcatatgagaacagtggcgatggcaccccaaatgaatggtgtgaggatcgttgctcaacaatccagttagtcactgcaagattcattgtctgcatccattgctcctcaaggtttgctcccaacattctgacaaaggtctttgcagcatctttgcactttggcccagtcagctgagtcctcagggattcgaggcatcgacagcgaagagcatggggagcctcatagatgcaaactaggaaggccagggacaagaaaactatgttaaacacgtcctttagattgccatgaatctgtgccctgggaaactgaaaggacagctttttgtttggtccggatctcagcacccagtccacaatgtcaacaaacaactctaacatctcttgttcgtctagagactgctgggtgtatgatttcaggtggactggttttgacgtccacagagaaattggcacacggtaatttgcaaagatggagaaggtgacaaaggagggctgggtgggaggggttttgacaactgataggttcaccgatggctgtgatgattctgatgctgatggtgtggggcagatgcaaagggacatggcgttggagcgccattgggagaacggaggcaggttggtgatccaaccccatacatcaagaggtaagctgtgagccattacgttgttgaaaacttgagcttgttttgcaatgtgggagtatcccagtattggtgtggttttatagatggaagagatgatggttcctcagataaaattttggctcatccatgactgagtctaatgaagcacggcataatttttggtaaagcggattcttggttgttagaagaggaaatcaagtcattgagctgaggaatctttgttgttaattggagtttgaagaatcttcatttgtgctttgcacaggtgctaaagccaaaagttaactgctatacggtaatatgatatatcaaacccaagttggttggctaatgttgtagtgaagagaatataacgtggctctaaacaggaaagctggaaagaacgatatggttgggtggaatggattagtttggatggattctggataactcggttcaataagggcctaacgacaccaaatttgtgacttgaaggttagcttgtgtgtcgactgggaattggaacctgatgcatctcactctttgcttccgttccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64175 - DNA, 11010 bp, Oryza sativa
  unsure (1)..(11010): unsure at all n locations
taggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattagatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagattttctcttaataaaatataattggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcagattcgctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattccagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgagtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaannncacctccgccttgggcagcggcaccgcgccgtcgaggctatgcgtgttccggtacgcgcagctctggcagtacaccatgccctccaccctcaccagcagcttgtcgctgtgggccggcggggtgtactgctgctgtggcggcggcgggggcggcgatggcgatggtgtggtgtagccatagtttgcggttgcaccggcggccaggagggacacgaacacgatgatcgcgagaggatggaaggcagccattgctctgagcctctgagctagcttgctgtgctccgtggtcgactgagatattctgttttgaagctttggctgtgccgaaacgtagagaggcatgtgggttatatactgcataccatggactaaatgtgcggacatgtagatggaaattaattgtgctgattttggattaacagatcaaactttatttattgttagtcgattttgacaatatatataatgattagcctggcgaaataaatgatctgtaacgattgatctgtaaggcacttttaagagaagaaatcacatgctcatgatctgcttggtgattagttaagaatttgtagactaccgaaaatattcaggatgaagatatatattgagatttgtcagaacgtgctgcccgtgtctgtccttaacggcactgcaataccaggttgtctacacaagcagatgatatatatggagattatttagtagctacattattctccataaagacaggtttgctattttacttgcgatagatttttgggcttctatctttttatactttgtccataagattttgcgtcaagatttgattttgcgtcaagatttgtgtttatgtagttctaacttgcagttagactcatttatatagtatgtttcatgtagtattcaagtaccatggcgtcttttttctttgggtctgaaactgacagaaagaaaacaggtgcatttttctcactgtttgtagaaacaagagctttacagccaaattactggatccaaagcaagtctgctttttacatgcagcggatcgatctagccaacaccacatgatgcacggcgctatcacccttgtcaccgtgaggctgatgcatctactagcaaggagcccaaggccaccggatctagtgacctcggcctctgcgcgcaacagatccgagtagctggaggtgaagatacaagccactcctgctaccgtcctctttgatcatcttcgtcttgttgagttgtttcgcggaggcccatcgtcgggaggcttgggccggagcgtggcggagactgaagctgacccattgggccgtgcacctggggacgcctggaggtgcgggggcggagcccccgcgaaacggatcgtcatccattttagggttccaccatatatatacctcatgtaagccgccgtgcggcgttgtaacctctccccagatatagtgaagatattttgctggctagcgtccgtggttttttctctcctactttggaagggttttccacgttaaaatctcgtgtcttctgtgattgatctattgttctttatcgtttgtttgcctatcgtttcctaatacgtctcactctacaccgccctatcgatgtttggttaagggtgggcaaaatcgaactaaccaagatagaaataaaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtcccgctgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaaga

SEQ ID NO: 64176 - DNA, 7384 bp, Oryza sativa
gttcttttctaaaactttggctgtgtcgaaacgtagagaggtgtgtggcttatatacttgcaatgcatggaccaaacgtgcggacatgtagatggaaattaactgtcttgattgattttggagtaagatcacattttattatgtgttattcgattctgacaatatatgtaatgatcgattcatctgtgatatgcagttttaagataagaaatcgcatgttcatgatctgcttggtgattagtcaagagtctgtagaccataaagaatgttcagtatcaagatattcagatttgttagaacgtgctgcccgtatctgtcgttaactggactgcagtttcaggttctccagacagaccgaaatagactgaaaccgagagaccgaaccaaactactggagtagtaaccaatactggccgaaaaaaaaaacatttctgtatctgacgaaccaaaatttaactctgtcagtaggcgcggttatctgcaatttcaaaaatgaccaacaacaacctgccaacccaacaagagcaaatcccactcccttccccagtacccccaccacctctctcatcacccgttagtccgtcacacttgcatcggcggcatcgatcccattcctcgcgttgtcctactgcgctgtgccatcctgcttctctgcggtggcacctccgcgtctcctccactagagattgagaatttggtggagcggtctctcctatgttttttttaaaaattttgagattgtttattgttttggtatgaccgaaactaaatcagtatcgactatttttatatacatgtcggtcccaaaatttctctaaagatcgaaggttgagatcgaattgtttgtttttacataatggccacccctacatccggtaaccaatgtggggaacccgatgtacggtagcaagtttttacagttaaaatcactctaatcttaggggcggacacccattagataagatgggtcaaccagctccgctatggtacactccacccctcacccccagacctccctcctagtcgtggatctaacacattagccactattccaccatcaacccatcaaataaatcaagtatttcaaaaagggatgaaaatgatatggaaattcccgaccaactaagtattgttttctataagtggttctattttttatcatatccgattggccatatataaatcatttcctaaatagttaaattggtaaaataaaaatttgcaacagaccataaatcatttctgaataaatgatcgttttcagtcatttttatccctagctaactctaggcattaggcatccattgtcgtgtcattttcatgactatgctcaccgtctcaattctaatatctatctgaccatgttcatcttcgttgttaactgttcatcttcgttgttaacttgtgtaatgtttgtgtggtgtgtcgccataccggtgcgttgagccggtgactataatttatgtgcacagtaccacacgcccctagccagcagctagctaggactagctccttgttagaggccgctctatcctaccactgatctcactaattcacataagggtttacggtttaccatccttaagaaattattgggagtttttcttgtgtaaattaagcttggtatctccatgtatcttgactcttgaggtaccaaaatatatttttatttaggtacttgaggtactttttcatggatcataaaatttcacttcacgtagagagttactcagctcgtgtgggccgtcaaaatcacgacctagtgccccgcagcattatccacaaggcccattagcctgatatctgaagcaaattatcggcatcattttttcgcttatgcttatacttatcagtcaaattttaaattttaaaccttaaatttataattgattttaggatattttttttcgtcgaagtttattttccagcctttgcttttagatcgctaagaacacatatgtaaaaattttattcatattcttttttgttgtaaatatgacctttcgcttataagcgaaacgatggagccgaaaattatatactcgcggggttatctttttttcccaacaaaaatgacatcaagtttgattaatttgccgtaaaactggtagaaccacaacaatatcaacttacaaaagaatcacataataacaccaccaattcaattagaacagaatcacaaaataaaccaggatatattctccgtccaaattaaatttcgcacacccaacgacgacctctcccaattcaaaagcacgagagtgcgcgcgcgccacacgcatgggggcggccgcggcgggcgcatctagtagtgcttgggcgggcagttcgccggccggaaggcgagcgggccggcggcgtagacgacgttgtcgtagccctgccccggccaccgcttgccctcgtcgcggagcggcgcgcccaccatgccggcgttgatgttggtgaggccgtcgcacttgcggtccggcgacgacagcagccgcgcgtagcacgccccccgcgggtcggcgccgaggaagtcggacgccctggtgacgccgaactccgcgaggaagtagccgctctcgtcggcgacggccagcctccaccacgccgcccggttcttggcgtcgcggcaggtgaccgacacctccgccccgcgcagcggcctcgcgccgtcgaggctccacgagttgcggtgctcgcagctctggcagtacaccttcccctccaccctcactagcaccttgtcgctgctttggtgcgccgctggcgccggtggcggtggcgatggcggcggcgtgtgctgcggtggtggcggtggcgatggtgtggtgtagccgttgttggcggtggcgccggcggccaggagggagacgaggatggcgaggtggaggaaggcagccattgatgcggagcttggtgtaagctcgactgagatggtttgtgtgaagcttttttttggctgtgtcgagatggagagaggcttggggttttatatactgccatggatcaaacgtgcggacatgtagatggccgaagcccgaagtggtggccatgtttgtcctggaaaatgtcttggttttgattaagattacgttttattatacattattgtaaaattgtgacaatattatacgtacaatgattgacctgtcgaaatgaaaagaaagacaatatgtaatgattggtcaccatgggcatttttaagagaagaaatcgcatgcttgtaatctgtttggcgattggtcagtctgacatagataacgaatgttcagaaggatgatatgcagatttgtcagagaacgtgctgcccgcgtgtgtcctcaagacttcaactgcaatatctggttctccgtgtaggcagagagatgttccccaacgcaatgccgcgcaaaataatcaattttgccggcagagcgacaacttgttttataatctgaaaacgaactgacatcttattttatctgtaaaatgtgcagttcatgtaggagcatgatgtgcgtccatgttttgtctgaaaccgactgaaagataaacagagagcactggagtaagagaattttctgattgtttctacataggagtaggagagtttaaggcgaaagttactggatggaaaggaagtctgactaatcgagcttacccaaaaattcacaaaacgtagcatctccatcccatcaagagcaatatgtgctctagttcttgtttttcatcttgagggagaaattatccgattaagtttacatgtctgaagagcctaatcatttttgtatatcacttatatgtgctgtcctaaagatttgatttatggaagagtagaagacaattctcacttcacattccaaacaggtcataaatcgacaatatcgcttgttattgtgcggtttccgcggtaaccggacttacctttggatacactaatagtaacttatcccgtcaaattcaaataaatttacataataatatgaacttctaatagcatcgtctagtttttcatggtttaccgtgtgattaccgtgcttacgattgggtgcggtaactcaacccctgatggtaaggttagccctgctctaactaggaaaaaacaataacaaacagatatataagacacaggtttaacatcagtactcttaactattccctccgctcaaaaatatactacctccattctagaatattcgtcgttttgagttttttatttgtaatgtttgaccattcgtcttatttaaaagattatgttattattatttattttgtttgtgacttgttttattatcaaaataccttaagtatgacttatcctttttaggtttgcattattttttaaataagacgaatggtcgaatattgcaagcaaaaagtcaaaacgatatctaatttgggatggaggtagtaataaattttgacactttcatttgtccacaaaaggctagtgaatattattaatgggctgggccaaacacccaccaaagaaaattcccaatgggccttgagtgatccccaatatacagcccattacatgtacaccccagcaatccaggcccacacgcagcgagagaattcgactcccgtttaattccggcccaaatccatctctttcgactgcttacttctgccctaatccacacacgtatcagaaattcggaatactctgttcgcacttgcccttccggaacgctcccaaaccctaggcgcgtgaccatgtcggggtcgtacggatccgacgactaccgcggcggctacggcggccgaggtcgcgtcgggatcctgcgggttgtgtgcgtgcttgcttctggatctgctcctgactggcttgtggttttttttgtaggtggcggcggaggcggccgtgggaggggaggtggcggaggaggagggggaggatatggtggtggtggtgtgggaggtggatatggtggtggtggcggaggatatggcggcggtggcggagggtacggcggcggtggtagaggtggcggtggatgatgaggatacggcggcggtggcggcggcggcagaggtggtggtgggggtggcggtggccgaggtggcggcgggaggggtggaggacgtgacggtgactgggtttgcccagacccgaggtttgtttcgtttactcatttgacgttgtctcgtttgattcgactgtgactgatgaaatcgtggttgtcccgattgtcttgtaaattatgctacttggccatgaaatctagggtttttaggttgttaaattataaattattgggttatttgataatttggtttaggattttgcatggggcatgtgtgaagtgtcctactaaatttttgtttcatcgtagtattgtgagcatcagaactgccaacaaatagttaactgcataattcattctctatgagagctccctataatcttaggtcacaagtgctaaatttatgttgaacctctagatacataaatattatgttatacttgtctcccatgatttcttcccctcccctatgttctattttccttggtatagcagagtggcagagaagaaatttcatatatgtttttgaaatgagttcatggtgttattggaagcattacaaaatacagtaaataagcactacaaaatacagtaaatactttcttttatgaatatgtttctttcaatatggcattagttgtcttgctgagttggttatattttgcagaatattcggttgcaatttcattggttctcttccaatattcctaatatatttgtttatcattcttgttccagttgtggcaatgtgaactttgcaaggaggactgaatgcaacaagtgtggagcaccttctcctgctggaggtggaggtggaggtggaggtggagggtataataaatctggtggagggggtggaggctacaatcgtggtggtggcgattttagttctggaggtggcggtggctacaacataggtggaggagattacaactctggtggccgtggtggtggcactggaggggaagaaagaggaggaggttacaatagaggtggtggcgatgatcgtggatttgatgaccaccgtggtggcaggggtggttatggggaaagagaccaagggagcaaccaaaggggagacgaaagtggttatgacgctggtagctatggacaagttcctcctcaaggtcctccttcctatggtgggcctggtggtgactatgcagcacctccaagctcctatggaggcaataatgcatacaattcagattctgcagtgccacctcctagtagctatggtggtggtccaggttcatatccaccaagttatggtgcaccacctccgaacccgccatatagcggtggtgctccaggtggccaaggtagcctacctccttcatatgatggtgggtatggtggtcggcctatgcctgggggtggaggccctggtgcacctccaccctatcatggtggtggtggtggtggtggtggcggcggcggtggcggcggatacactggcagtgctgctccagagccagctgcaaaggttaagcagtgtgatgcaaactgtgatgagacttgtataatgcaagaatttacatctccaacttacctcctgatgtgactgttgaggaactgcaagaactatttggaggaatcggccaggtatactttgacctcctcttgagctcccacatatttagtgtttatgaactgtgcatttcacgattcgctcactgaaatattttgtgcattttatgtcttttttctaacctcatgtttttcattttatgtgtttcgccataatatctttttccagtgttactgatattacttgttggaatttaagtaaatttacaaatcagtattcagatgatgtttataatctgtagttgggcttgttaacatttttttccccttttgctttcactactgctagcacattgcaagtcatagttttgcacaaaatctgctccatctgttgtatacagcgcagttagagcgagcttattacatattgtttttttccttgctagtggagaagtacacccttgtgtttcaatgtgcataattaaatttggatatttgttttgatgtaacataatcatcttgcagtaatgatgctctttttttttgtagaagtagtagtactgtaattttagttataaccaagccattcaatgattttgtagtaattttgctttactcccatattggtattttatgccaaataattcgtggcatatcaccccatgatgttaatgtaaaatctttgataataaagtaaagttggttttacagattacttagtgttcctagctaaatttattgcaagaaattaatttctttagttttgggggtggtaactgcttgtgtttcatggctgtgttttgagttttgcaactgcttttttcttaaggttggaaggatcaagcagaaacgtggct

SEQ ID NO: 64177 - DNA, 3536 bp, Oryza sativa
tgtgcctatgtccaagcaagacagcttctattatgggcaaagcatgccccttttagttgcaatttgatagcctagatgtttgaatctattcttcaaagtgctcgtaggttgcccccttaagaaactgtgatattaggagtatatgacacgtaccatctgtttatgttattttggtgtagcttttttttcttcaactacaaaaactgtgtaaaaccaagcacttaagctagaaatgtgatgtaagccacaattacattgattggattctggtggaacataatctggggacttttcttatcatatttttttgtatagcgtgtaaggtagttttacctgatacttcaattatgtgttcttaatttgcatatgcattctgtcacaaagggcttataataacacattcatggtgtagaaataagttgaatgtgggagcagtagaatgccaagtatgtatcagtcaatgtacacttgtactacttccgggttaagatcttaaacattgttcactgaacctctttgtgtaatttttagcctagctagaaaagaatgtcactaacatgccacgattcgaagttgtttggtattattttagaaactggataattgtaaatatctatttattctcacttgacaaggtgggtcctaaccacttgtcttaagtcaatgtgtagtgtatgactgtgtaagggacaatgtgttggttgaaatctttagcatacctcgatttaacacaatatttgtgaacactacttgttattttatgtatgtgcttgggcatatacatcatggtgtaaaacaagtaatatatggcaactgaatgatttttgtttaatttttatcagttgtgccttttaggtatttaatatctgtccacaccacttttagctcatatataacttaagttattactcatgtcgagttgtatatgtataatcaactgcattacatggcatgcagaggtggacgtggtggctatggtggaggtcgcagggataacttcagagatggaggaggccatgggcctaacaggcatcaaggtggtggttcgcgttcaaggccatactgaaagcaactaatatagttactaagattgtcatctgtgagaaaccatttctattcctgttcatcggacttgtactcaaaacaagagcgtaaggtaggttgcctgcttttctcggaattatattccattgtcatactccaatgttggtcggatgtttgtttgtctcatccaaaaagtgattgatccatgttatgtgaatttttccatagaggcagatggataagctccaaatgctggtagttttgagatgttatttcaggtgagtgccgatctgttatgattctgcaatgctttgctatcccgtgattgcttacctttttatttctgcgattgcaaattttgctataacgcttacattccacatggtaactcagccggtggatcactagcttggattttggcgaggagaaacaggtagggcatttttgttcttcgataggtttactagatctagaatccattagttacggatatctctgtggatattagatgtatatgaaccaccttttctggtacacattcattgacttattcatgtggtttgcgtcaaataaagcatggatatgttactatttagatactatttccagacgaaaacatctgcgcatttgttggcttattcatgtggtttgtgactcaaatgtagcatgcttagaaactacaatttccaaaaggaaaaatattctaacatagtagaaaaaatcttgtgggagactcctaaaatcaccccccttagcattagtagtagcactcttgtatgaggtttcctactgttgaggttacgcttgcaggcttgctgctgtacaatgtgtgcagccaacaccgtctgctgcacatcgatgctgcctgctcttctatcactgcagcgtattgtgaaacctcgaagccatccttgtatctgccctccggatccagttccttgtgctgattggcaaattgacctgttggctggatacctccagttcatctggtttctttgtatggtttgtcacagttgcggtggatacctccagttcatctggtttctttgtatggtttctatcacagttgcggaagatagacgtcaggcttctttccgttgattgctttttccgactctttcatttctttctgaagtttctcctcgctgttccatatgggtttggtatttggatctgttttaggaggcttgatctggagccctggacttgcagatgggcgaagctccaagccgttcacgtcgtttttgtttgacatttacgtgccgtatgtatcttgcaatagtttggttgtatgacatttgctgaatacttaaatttttcacttcatttgggattgtaataatgcactgagaaacgtacctgtggcttcgcattaaggataaaaaaatgatcggtgttgcttcactacttgcggggtgtgctgagcggaaacgagcgaacgtgttataagtgaattgtgcaacgtttagataaacgatgtattacttcaaagttcaaacgatgtccggcatctttgccacgtagtagaacataaaccgtaggttgtgtagtcgcatttagctagaccctagaggtagctctatactaccagcattcttggttaaaaggtgaactagggcattgttacagtgattcagctggctttaactgacgaaaaatagagatggcactatcttctatgaatgatgctcatgctcattcaccgtccttgtcacaaatcacaaaatcgaacatacaatagccagggcaaaacttgcaacctacactggttaaagaaaaaaaaaagcaaaattgctaagaacaagatatacttttcatcttctcctagtcttctgtttgctcctcccttcaaatctcctagacccttttgccttccctttctgcttgattttcttgagcaccttgttgcccctctcctttctctcgtccaggtcagaatcgccgccatccgaggaatcgtcatcgtcagattccccgaatccggtgagcttctcgtactcgtcctcgtcgatcaccccccgcttcagcttcttcaggagccggtactcattcgcgagctcatccatgtcctccttggtttggactgcttgacgctgtttacctgtcttcttccgctttggcttttcaggcttctccggggctttcctcctcttctctatctctggccttagagctagttcttctgctttccttttcaatgtcttctgccgttgtttttctcgagctttatccctgcagttaaccatgatggagtgttgatccctttctcatagttgcatttgaagcaaaaaatacggatagctctcaagtgaaaaattgctgaataattgttcgattagtttagacatagctctttagccctacaagggtcttacacaacaagattatggtttgtgtcatctacgttttgaatatgggctttccttttaatataaaatataccaatataaatttgtcaaattagtagtgcgttgatgcaatagtacaattgg

SEQ ID NO: 64178 - DNA, 6260 bp, Oryza sativa
ttcggtcttgcaatgcagcacttctgatctgtgacagacaagtgggtaattggttattttaaacactaaatttttctctcaagaaaaaaaatcatttctggattcagatgccttcacaggcagacaacctaagatgatctataacaataagaaactcacctgtggtacaatatctacagcatttgtggaacactccctttcagtgaggggtacacctctcctcttcaagaactcaacataagtatcttcctacagaacaattatagcgctaagcattttactaacaaggcaatccattgtatcaaatcactactgcatgtgcatggtatgcatagccaaatatgtctttgaaattcaactactgacttccacttagataatgtcaaagcagagcaagtaccttcggtaagaggaatacaatagcatctccttcttgatcataacgtgcagtacggccagctctatgtatgaacacattgggatcttgaggtggatcatactggggaagaaacaaatgttttatatcaactaatgacaagcacaaggaaacaatttagggagttatgttcaaagcattacctgcacaatcagatcaacatgtggtatgtcaagaccccttgctgcaacatcagtgcaaactagaataccacttgagagagctgaaaatgatgccaaagctttctcacgagggccctacataccaggaaaatagcgcggtagcaatcagtatgaaggaaagcttttggaagcgccatgtacaacaaatcatgcatgtattagctctgtaacctgcttcatcttcccatgataaggaattattggagaacctttaagtgagtccaacagcgggagaacaatagcccagtaatctacacaagcacatgttgcgaagtacctgcattcaagtaagatcagaaagcccacaagctaacacaatgctacacaactaggcacttaaggtaagtgtgtgaaaacaaattttagttcgctgtctacttacaccattattttctttccattgttctgcacaaggaaatcaacaagttgcgatgacttatttgatgcttcacatatcatatactgcaaagaacaaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatggggtggagccgtgagcactgagcagacctcgtggggcttgggaggcgaggggcggcggcggaggatctcgacgacggggacgacgaaggcgagcgtcttgccggagccggtggcggcgtcgacggccacgtccttgtgcgaaagcagcagcgggatggccgccgcctgcaccggcgtgcaccgccggaacccgccgcccttcagggccttcaccacctccggggacagcgcgggcgacagctccgagaacctctgctccgtcagcgcgcgcttccgcgccgccgccgccgccaacgaggaggaggaagacgacatggcgtcgcgccgccgcgtctgctactcgcgtcgcgccgcttgagcaggagagacttcctcttgctgttggtttagggattccggggggttcatcgattgggccgtgatggtgggccgcgtagtcttctccagggttgcatttaccgcggtaaaccgcgcggttaccgcggttatcgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtcttctcccgaaggccactgcccaacagcctgttcaattaattttttttttaccgattccatccaattcacttctactctgcacaagttctctcaagtagggatggcaatttaaaccgtttgcccgtttacccgtgggtaaaaaccctaataaagttgggtttgttctccatttagtaccagtgggttttttattgggtcaaaacctatacccaatgggcatacgggcactggcccgcttcgcccatttacccgcaaaaaccaactgatatgtggtccctcggtcaaattagtataaatgccaccatctagtattgatgaacttgtaatgcttgtattgttgaacttgatacaactgtaccctttctttaaattgcgataatgtctctctgcttgtggagatttgtggttgaaatgttgaactgtgagtttgtgacgggtaaacgggcatacccgcgggcacatagcacccgcgggtaacgggcatgagtagtgttccttgctcatcatgtagtaacgggtatgcccgcgagcataaattacctcgtgggcatgggtatgggtagtcactactcgtgcccgtcgtgcccgactgccattctcaacaataatacagacaatttctcaaaaaataaaagacaaaggagggaaaaaaagagatagaatgcatatgtaaatgggtgacttgtataaaaggaaagtcacaattttcagcaataaatgaaagagaggtgtattcgtagcgactcaattctgcagggaattcggctgtacatgagtattttgattgagttgtattccctccagtagaaacttacaaatgtacatccttagagaaaagataaggaggaagacataaaatagaaaatggcggcgcacgaagaacgtcgctttgaagaatcagtagttacattgtgattgcggtatcattgattttactgtttatgtggtaattgagtcttccttctgttcagaggatgcaacggcaacagcactgccttgctcatccccttgacccttttcttcatcaacaccctgtaaatttcactcaacagtaagaatcccaaggtgaaactgccttatctgcatatcaagattggaagattttgtaggttcacctcatcatctgggatcatcactgccttcacctgtgcaacaataaccgtaatgtcatccatcttaccacctgcatagatgaaatttaggcatcatgagattactttgcgttctgcatagagtagagcatgatagtatgtgtatgagttcatgcgtacctattagtttccctccaatgaactttttccacgaggggacatcaaaaccctgcattcaagtgatcagaatgaagaaatttctgtcatccctttttggctgtaacaatctgaacagaaaagattgttgaggggtatatgtttcgcacccgactccgagcctccattgagtagggtgaatcaaaggtgacatccactgaatgcttccttgcaagctctgctagtgcttttgctgtggaaaaaacatcaaactttcagaaggattggaatttgggaggactggaacatgtgtttggtggcccccaattcaaaactgagatatttaccacttaccagcttcatctacccctggagactcggaaatgacagaaacgatctcttgatcgaatatattgtcaaaaaatccatctgagccactgacaatcatatcaccctccataagatttactgtgcaaacctggtagacaactggatcaaaatcagaaggttctacaaataatgcttaaatcttgtacgactatcttgattactgtagtgaagcacttggtattatgtttccactgcattagtggtatcttttatggatagatttgcgcatgcatgcgtgtcccttgtaagatcttccccataattttgatttgtccacacatgcaaaatatctgcatgacttgagatcatatagagttttcaaattaagaaataattaatgtgcatgtcttggactcgttgtaacatatgggcaaccacctagaactgagtatgctaataaaacaatcgtcacacacacagctctattattctgacctacaataaggcacataccagtgcatccagatacgtttgaccaattgcttcagagcttaactggtatgggcagtcaaagtaatgttcttgaggacatgtagagaacattacttggcctaggaagaagagaacagataagtatgctaataaactttaagaaatctataaatttgttcatgctaaccttttctaattactttcaaaccacaatctcccacacttgcaatttttagaatccctgtcttctcaagcattgcaatgattctgttagcgttccaaagaagtcattaggttttgacctgtaaagttgtactaacataacaatgtagatatatgcttacacagttgcagatccaacagaagttgttgcagcatgagccttcattagaagaagctgaggatcatgattgacctgtgatggatagaaactcctatttgatatgcaaattgacgtatagtgtacgtgactttatatcagtactgatgtcaattaagaaatacctcctcatccttgagaaaagtagaagtgtgtgccatgagctctcgagaaaacagagccggattgacatccttttctgcccatctgtcagtagacaagagaatgactagcaggataaaaaccttgtgttaatgcgaattgctgaaaacaccatgtatttttttgagaagtgctgaaatcaacccaaaattaaaaggaaggaaacaaaagcacaatctacaatttattgaagcagttcttttcagggacaaaagtacaaaacaattcattgcagcgaagatggtgtaccctgaaactccatctgcgacggcaaacactccaccatcatcgccgttcacaaagaaagcatcttctccgccagtctcagccttcagaatttgaagaacattcaaatatcaaacaatggttgcttctgttgtataattgagtatgaaggggaaaaaaacactaccagaagagtaatatattaatatgtttatctaaaaaatgactaacctttcttgggtgtggtattagatgagttccaatagttaacacagcttccaacctacaattacaggctcacattaccaaacactgacagatgaagcacactagaaataactaaagactgaaattatcagtgagactgaaatatatattagcagctgtgtttgtttgtagtctaaatcgctgagacgattttctgtagcctaagccattcctggcttagggtgttcttgttgtaaaactctctctccttcttaatacaaaacttggccggttcttttgccggcccggtgaaaaaataaactatcagtgagaacattgctccattacaacttaagatttgcaccttgacccaagtactactgataatcaaacgcatgtcttaggaacccgagaattcgataaaaccgaacatttcgtggactgaaacttatcgtaagggcaaagataagaggatcgaacaggtgtaagcagggaggcatacttggcggcgcgaagaggggagaagcgcgagcggcgaagcgggagatggggagaaggggtagtgggtgcgtggaggcga

SEQ ID NO: 64179 - DNA, 2748 bp, Oryza sativa
tctctcattgtatctatcataaatttcttactatacttgtcattcctggcccggattgaatccagacgtaaccgaacaaggcctagctgtgggtatacctggtttggatcctctttgaagtgttcccagtcccagcatggttcctcatacccatctttgacaacattgagtatatttccctttggattgatgtttgtaaccgtgaggtgtttgttttcagacaatcgaaaagcttgagaatatggtggctgaaggaaattattatgaagcccaacaaatgtacaagtcaaccggtgcaaggtactctgtgaataatttaactgaagccacaatgattgattcccctttaacttgcatttgaccatcttgcttatggttgtctatttcagaactgcttagcatatgatagaaatcaaccattcactttttataacttaaattggatctgctaaataatatgagttgattgaatttagaatctttgttatacaatcttccgtctattatcatagttatttggctaatgcagcatcttaaaaatagttaatgtcaggattgttaggacattaaacaaattcaaagtaaaacaatgaccagaatgtttacatttgcatagaagcagtattactggatcctacaagtatgtttcatatgatcacaatgaaaaatgttattcatgcacaaaatggctattttctttgactagatttattgatttcttaataaaggaaaggggcatgagctttgtctgaaagatattgtagacaaaaagtgccattcaggaatacattttgattaattgtgtctcatatcttgcaggtatattgctgctcagaagtatttggaagccttggacatccttcagtcaggagctttagttcaactgaagcatgggcaggttctatcaaagctaaatttcatagatctaagtaaaaaaaaaatattcgctacatttgatggcaaagtaacacccctcccaaaagaaaagagaagagagagccaaccaaaagctcattgctcccttcgtaacgatttgttgcaaccagccaatggaccttgacgtgttcatttgaagttgtttttttaatgtgtgtattgtcgatgtggtggtagtgattcacatcttattatgggatgtttttattgggtgctatgctgtagttacatacatgtgttatcctagattggtgttttatatcattttaaaccttcacatttttgccttattggttaaaaattcctgatttcaggtaacttgtggtggtgaacttgctataatgtttgtggacacccttgtcaaggcagcgcttccttataatgaagaaacctttggcagtcttctctcatagtgaaaagctactatttctttatatcattaacatgctaataaattgcatatttatcctgtaagtaaatacacatctagatttcatttttggaacatatttacaatattttatttgtagcatactcctaatgtccatcacttgtaaagttttgtagaatcaaagttgtttaaaatgttagtggaagcagtgtttactagtcctaattgtggctctagctttactttgtcttctctttgtttgtttaccttcagaagatcacttttcccttagattttaattgaattgaataagatacttactttattatgaatgagaacatgtttctagtttgatttgttagtatcacattttgtgattgaaactatatgtaaaccttagatcgtatcagaaagatgtacgacgccttccccaggatatctgttccacacttccttggagatgattatgatgacgacgggcagaaattatccgaagctatttctgcagcaaaagtgcgttctgagagttgttcatcattcctgagagctgctatcaggtaaggttgtactaattttcattaatccaagtaaattgagtagaaaaactaaatatccttcatgcaagcatcaaacatcttcatctaaacatggcagtttgtttaagtggatcttaaggcaaatacatcaaactgttgaatagcatctatactatgaccaggacttgttaactgtagtgcttgaccagtagttcattactgacaaaagtagaacagacaattgagcttatcatgatggtaaaaccaaatgatctgttctcgttgctcacttgcatataaaaatccagatgttgattgtgtaagtttgtttattacaataatgctctcagaaaaaaatgaaaaaggagatggtcacgaatttgtgattttaagatgaactcaaggtgtgcaacatataagaatcatttccatgggatctttgaatctttatgtttaactctgttaatggacaatgtggtcatctagttgactcttctcaattttctgcctgctatatttatatgccactaatagcatatcaatcctttattaaggtggtctgctgaggttggggcatcaagaagtggatctcctgagctgcatgttatgttggcggaatacatatattctgaatctccagaaacggtactgtttataaattatagaactatttttctgacatgaatatattgtgtttgttttagagctgaaattttatgtcttttcaactgttactctttaatgcctttgtggtttgctaaggttggtgttgactgccgttggatgcaggacatgactaaagtgtcaagtcattttgtgaggggaaatgatcctaaaaagtttgcctctatgctggcgaactttatgggaaaggtaatggttttt

SEQ ID NO: 64180 - DNA, 5899 bp, Oryza sativa
tggggttcatcatcagtctagttcactgaaatgtgatgtgacacttttgactttatttgctcaaatttttgaaactttgtcaatagctctcaaaatatttagtttgaaaatatgtcatatgggtagattttttaatttataagtacttttacaatattataatagaaaaaaacagtggtcaaaattgcacatcaaagaccgaataaagttaatagcgtcatatatttaaatgtggacgtagtaatattcatgagtagcacaaactgtgtatttgcaccaatacttccctttttatgccattataaattataattataataataataattaccttatgcagagtgtctaagattgcagaagacattcagtcagaacatggagaacactgcgacaacactgatgataacgatgaaggggcaaaaatatgcaaaatgctagagagggcagctgagcctgaaattcttatgtccagcatgagttcagagcagctgctgtctttctcatattatcaagaaaagcaaaaggtctggacgcataactatagcatctcatctgtctgctaatattttatgttttttaaactacaccattatgttgcagattgtcaggcaaaatgaagtagctaagaaggttgaaaatgctcttaaagttgctgggcttaattcaagagatgttacaccatttttgaaagtgagggtgacgggccttatcagcaaacactccgccacaaaatctggctgcagggaagggttaataacaatttggaaccctaccgagaagcaagtacggtacaataattctacagcatataagtgtcagaaatcatctttattctttcttatgaacagaaaaaaagaacaaaagatttggtgttatgtcatcaagaaaacaagccagtgattgtcatatatttttgtgtgtagcgttacctgctatatgtctttaggacaacaagatgcacatgcctattttctttgcaatattcccatagttatgtgctaatgagcaaatatacctaaaacaattttcatttctgtattgccactggcagaaatccgacctggtggagggacaaatttattctgtcacaggactgttggcttcaagctactttacagaagtatcctacttgagtggtagaggatcatctacagcatggacgcctttagcaaccgcacagactacaaattttgagtaagagacctcattggacatgatggttgcactgcatttagaaaacttaaccatgtccctttttcatgatgcagaccatttttcacccctcgtaaagcagttgaattgtcacattttggtgaagtgccacttacaaggtcagccctgtctcaagctgacttgctgaatctcctgttgtattatgaaccttttataatgagccgttcctttttgtttcagcgaatttgacattgcaggtgttattttgtatgttgggaatgtttatttattgaacaaccagaataggcagtggctctttttgacagatggatctaaatttatctctggagaaaagtatgaagagcaagatgactgtcttctggcagttagcttttcttccaaaaccactggcgaggattctgcattcttcaattatgccctttctggacatatagtatgtgatcttccattgcactgactatatctcaagttgactaatctttgaagtccgaaattcatgagtcccatatgaaatgcgagtagttatgaattaaacagtgcctcgtgtaattttctgtgtagacgagctatatcccagtttcttttctgcaggcccttcacataattcttcagatttacccctttgtagtgcaagtgcaattttaactcactgttacgtttgtttctcaggttggttttagtaatctggtcaagcgagataaagaccagatgaggcacgtgtgggtagctgaggcgacagagagctccacctatagtctctcccacgagatacctaaaaaatcacatctcaaagaggctgccacttctgctgaaaaatgggcttcaaattctcatcctgtaagtttcttcacaccacagagatcctgttctgataagatggacagtcttattgtcactttctgttgatctcttgcagatgattcagcatctgaaggaaagagttctgcaaatagttggtgacagtggtggctgaagtactctgaatggtgctgctcgtagaacagtgtaaggaatctctcggagttctatcaagcacaactatattattttttcggacatgtttttctttgtcgttccagtgcttcacttgagataacgttgattggaagtagtttgtttcaggactcgaccagaatgaagcctatggcagtggatgctcgttgtcgactagacaactgacagtcttgataaatgctgcatggcatacgaatgatggatggatacgacggtatgaaactcactttgtcatatggttttctagtcataactaaatatcttgattttttattgtaaataactgggctataactataagcctacaatcatctttcttaaacaaaacttggactgtaataaatagcatgtgtgttcattagggcgaggcacgttaagaaacacgggtacacttcatgatgaattagcttcacaaccatcttattgaacattatctgcatatttaacatgtaacatcagaagattatgtataatgaaacatgttgcgcactgcataataccactactccctccgtcccaaatgatagggcgtccctttttaagaaaaaacatattcggtagcttttgaccaataatcatactaactatatctatactatgtattatgcatgttatatcactagatttatattttgaagtacatttatgtgatgctaatttcatatttgttgggattatagaatgaaataaaataatgatcaaagtatgttattgaagaccgtgtaaaaaaatataggccatatagtttgggacagagggagtatattgtacttctatgctcaaattcgtgaattgctgactgctccttacatttcaggttataagatgttttgactttggttaaagtcaactgtttcaagtttgactaagtttataagtttatagacaaatgtagtataatagctataatactaaattaatttcatcaaatcaataattgaatatattttcataataaatttgtcttgtgtttaaaatattactactttttttacaaacttaatcaaattttaagcagtttgattttgactaaagtcaaaatgttttataacctgaaatagaggaagcataatagtcacctgtgccagtgtttaccagtagatagcatagaccataggtggcaattcgcacgctgcatcatatgtttattaataaagcaatgcatggtttatgtgattttgtgcgagcaggacgtgattggcacgtggagggacagatcagcggatttggacacgagatatcctgctggcgaggaaatggttagactcccaccacgacatcatcctgctggcgtttgagcgtcccaagtttcaacatggagcgtcatgctgccctcccaatcccattgaacacgcacatctgctcgtcgttcgctatgagcctatgaattatagattacgagcatctggtgtctgctgcctatcctgacttgtaattatccggtgtataaagttgtgtatggaggcttagtttgatcattttgatatttctacagccattttacatgcgtttagggaaaaaaaatagtaatacgtgctatagctaagttattgatactcaattctcaaattggagaacagccctgacgcaattatatggttgtatttctcactccaatatccaattggggaaaatgtctgttgtttaaatttctatgatattttagacttcccagatatgtttaatgtgcaattggagtatattacagcttttttagcctactgtctgcaactcttccatcctcatttggccagtggcatgggccaaatctctcggtcattacccagtaatggcctgaattcacggcccgtttcaagctgttatatatggaccttaacgttaggccattgccctaactttcagcccacatattttgacgggccgcactgtctaaccaaacaatcgtgtacgcgaagatgaagggaacatgagaccagtcaggataaatgccgttttaaaactgcaaaactggaactacaaaaaatgttaaagaatagtaatatcattagaacacgaccatgatacgagcaaaacagttgaatggttttacaagagatcagtgtaactggagcatatatcatcatatgcagtttggagctaaatgtatggcctcaggataatcaaggctgaggaaggcagcaacagaactttttcttatgctcttttcgggccgggccgggtgttcatcttccagcagcaatttgtattagcgaacgaaatgcgcgtcgggagctttgtgctggaatatttatgacgaaatccttttctcatcattatacctgcagaatacaaagaacaagatcaataatggcttgtatcggaactaggttgccgacttctagtcattgtaataatattggctacactaatggtttagtattgattatctgtttgcttcattgtacttgggaaactatacgtgaaattacatgaacgtacagaaaaggtgaattgaacaaaacaaaatgaagatggcaatatttataactgaaagaaagaactcaaattttttttcttgtttgtttaccacgtaacaggtggacatccgtgacttcataagctacataaaatttgcacttcaattcctgaatgcttagatcaactgcaatttcaaattatagaaatatatattctttcctctaaacatgatatgcacttcatgaaacgtaatttcggcatgactgatatggaactaaaggcatacgacggtagttattgtgaaaagcaactggtgtgtactcaacttcaaaagtaatcaatgcaatgtactagcaatcggcatgaatgaatgatagatgaaagatgtaaatcttaccctgaacatatcaccaaaaagtccttccaaagcgctctggctccgtattccataaaattttgcggctatttcatctaataactgaaacccaaccataatatcacgtgagctctgtttcagcttgtttttcatatatgatagaaagcattaactaccttcttcaagttactctgctagttaatgtaatggaagttctatccacatattactctgctagtagagttaaatattaagcacattataagtgcagatggtcctttatcaacactgtttacatttccctatggacagcacatgataacaaggttgttggtggattaaattgtagagtttcctacatgatctaatataactcttgtgaacacattgttttatgacaactatgcagggaacatgaaaaatataatttttcccagttcttgttaagttaatctttgaaagaataagatgttttggtgcatgttttacagctgtttagcaagctaacactatatttgatgaaatagctacctcctcaaatacagggtcgtgatctgtacttgtcttgtacttctgccgcagtgtcctgaaaagagggtaagcatctctttcgagcctgtaaacatagcatgcagtcagtaatataaccacgaccagaggaaacaatgagaaaaaaaaacttgttgcttgtataaaataacgtctgggcttggtatacacgtacaagtaacaaaatgcaaaactatctcatcaattattcgaaagatgcatggaaacttggataattgaaactgtaggatcagtttgtttacagtgaacagaaagctacctaggcaacctagatcaacatattgcgcagtgatacacaacaagcacacaatagatcctagatttaca

SEQ ID NO: 64181 - DNA, 998 bp, Oryza sativa
ggccgccgctttgcaggccgcggccgccgagatcgagggaagtggcgcggcggccggtgctcccgctcgcggcggcgtcgttgtcgtcgtcgtcgcagcggacgcccgcccagtggcagcagtcggtgccagcgcgccatgaccggaaggcggtggccgacgcggtgttcacggtgaacgaccgcttcagctggagcagcgccgtggcctggtccggcgagcatggaggaagcgattgcgcgagcctagcttgtaggaggaggaggagcatcagtacgagtaacgatgtctcgtagtaccgtcgtcgagcttgcctggtacacattttggcgcctttgattgttgtatgcttgaaacaactaattttatgactgtctgactcagacagagatcctttgtttgagcacaagaagatttacaatcttcgattggactttatgcttagggaaaatgcccttttgtaagctcgatttttaaaaacttcctacatatctggctatctgcctatggccagaaaggtagattattcaagtcaaggcaaatgtttttttgttgaaacgaagccattgacaacttggcatcgtaatcgtgcgagacgtcaatcgcacttagagattgaactggctgtgaacaagtgtacatgcgtcgttgtcgcggccgtgccctggtcagacgatgaacacagaagtaccacgaaacatacaaatccgatagcaccagctggccagctagctgccgtgcatactttgccagcgtcacgtcaccaacatgtagtttagtcgcaaaaccatttttcatttttaaaaaacacagcacaaacacaagcgctcacaacgcgcacatactcatcctatccctataaacacctccggaagcctggatcggtatatcttaagattaataaaattattacatgcgccttgccgtcaacgtgtacatctaccattaaaagaaatacaattagcagtgtgaaatctaggatttaacacttcgatcac

SEQ ID NO: 64182 - DNA, 7456 bp, Oryza sativa
  unsure (1)..(7456): unsure at all n locations
gagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatgaatttaaattctcactaattacgagtacacacatacacatatatcatgtccgtaggtggataaacaccatacatatagtgtatactaacaatcatcgttttttgcgattccatcgttctatgtggcacaatgattcgaaccagactgccaatatgaagcccactgtgaaccccaggccagaaaagatgaacaaaaggatcacgccaagtctgtcctgccagaaactgttggtacctgaaggagctgatgcacttggagatgttgagcctggagtatcacattgtttagagagtggctttccacagaggttgacattaccttcaaaggagctgttgctaaatgacccgaactggttaccctgcggtattcttctggtcaagttgttgtacgaaagattcaaccaagcaagagaagttagagaagctaactcaggagggatttcccctgagagtttgttccaagagagatccaatgactccagctgagtcagagaattaagctgcgatggaatgtgtcctgtgaaggcattgtgtgacaggttaagtccacgtagtgaaacaagcttccccaatgactttggaataggaccaccaaatgagttatctgagagatcaattactttgaaggtggttaggattttagtgaacataagagtgccccctttgtaattgacaaccgtaatatcctgatagagcaatggtatttttgtgtttgtggtatgctctaatatgtgtccctcatcgttgtcattttccatcattgattgaaaatgctcaaaccattctggatgtatgttgccagagaaatggttggaggccaaatcaattatttgcaaccttttgaagtgattacaattttggtgacaacctttaagaccccttattgtgccattgagtttgttggatcttaagacaaggactcggagatttggaagtttacccaaccaaaatggaaaagaatcaacaatctgattatttccagcatccaggagctccaaatattggcagtatgatagtgatctaggtagtttaccttcaatttggtttccattcacatctattgactgaagattgcacccctctctactattgttaggtaacaccccatggaattggttgtctctcaatttcaatacgcttaagtttacacttcctgtaagacatgctggtactgatccactgtagttgttgccagataagtccgtgataatggctttgcttgcattacaaatcgaagatggtacattgccacttagtttattattggagaaattaatatagctggcgttttcaagatatatgccaaagttcggtactattgaaaagaagtggttgtttgagtagtccaatgcgatctcactggatgtggttagctggtattggtatgcttccttgaagtctattgaaactgagatcaagataagctaaattggacatattaacaagagaaggagattgttccaaagtagttaacatgttgcacgagaggttcaaaatattaaggtggcccttccaattctcccatatccaatttggtatagcccccgttatttgattactcgaaaggtcaagaagggaaaccgcatcaagatattttaatgtgcctggaatttttgtaaggttgcaagatgacaggtataagtacttgatgttaggaagataaggaggcactgtttaaccttcatcatctatgagtgatatcaaattgtttgacaggcttaggataaatagattcttctgcttccagacagagctaagttcaactgtgcctgtgaatttatttgattcaagaatgagataattaagatttgtaagatgaaaaagtgagttgggtatcgggcctgatagttgattgttggctaagtcaatacataacagagatgaagttaaagggtaaggaatgtcttctagtgaaccagaaagctggttttcttgaaggtaaacattttccagcctcggaagagcgaacaacgattgtggaattttccctgcatgcaagtgcagtatactagtcaaaaagttcaaagatgaatgttcactgaactgacagtctggtaccttaggacgcacttgaaccaagacaactcattcgtccgagttaaccaaactaagctgattttccgtaatattgcacatggttacattaacatttatttaaaatattgtatttgataaaaagaagcattgcttttggttctatatatataattgtttgctagagatactaaaacattttttataaaattctactaacaaagtttgatttagttacttggaaggcactaataaagatttaaccatgatcactactacaaaatcattttttgcatgtgatcaaaatcaattttcgcaggcagctagacggcccgcctgaacctaggtatatgcgaaaatcaacattttcccatgcatgttgagtaaccgcatgcaaaaacatgatgttcacgtggtcacctatgccaaccgctgcgaaaatgattttggagaaaacaaataaaagttcccaaaacaatttcggccaaaactctagcttcccatcctctttgagctcgtcgttgcccctcgaggacggcgctgtcggatccaccgcccgccattgtcgtcgcccctcccggggcatagggcggcgccaccggatcagctgccctcgaggtcgttgctgtatttgctgtcgccggcactgtcgtcacgcgcgtcaacatcgcacctgagtgagcctactgtcgcctccatctcagtcgctgaagaagagaagggagggaatgggaaagagatgaggagagggagtaggagaggagtgatgggaggtggagccaaggagagaagagaaaataagtagtgtgcgtgagtggagaggagaaaaaaatatgaaaaaatgtagtgcggtgacgcgtgtggcccacttgctctccatgttgctcacttgcgaaaatctattttcgtaagagaccccttaaggtgcaacattgcaggcaggcctcttaagggtcatctgcaaaatatatttttgcatgcgacccttgaaccgtactcaaaggagcaatttttacaggcgaaagtagttatggtccacctacaacttggagggggtctcgtccaaaaatcaattttgcagtagtggatgtgtcacatcaacgtttgtaaaaaagttggtaacaaattgttcatacgtttagcttttcccttttatataataaaaccatggaccaataagcatcttccctttaacttattaaataaataaaaaagaaggctccatattcgctcttatggcctagaaattctcatattaatcgaagaaataggaaaaaaagagtccatacaggaataaaatttaaaaataaaagtagagaagataaaatttaaaaatagctgaaattcagaattaaaaagaaggaatgtagtaagagaagactagagtccataccattatacaatagaactaatggaagttcggaattaaaaaaataagaaaaaaaataaaagtagaggttagagttcatatagaaatacaatttagaaataacgaaaatttgaaataaaaaaaattcactctcatggtctaaaaattcttatattaataggatagaaagaaatagacagagttcatatagaaatacaatttaaaaatagctgaaattcagaattagaaataaggaatataggacgagaagactagggtctgtaccagtatacaacgcagtatacaatagaattaatggaaattcggaattaaaaaataagaaaaataaaaatagaggttagagttcatatagaaaataaaatttagaaataacgaaaaatcgaaatttaaaaaaaggaatattgaaagaagaatatagagtccatatagaaatataatttaaaaataattaaaattcagaattaaaaaaaagaaatattgaaagataagtttagagtctatatagaaataaaatttagaaataataaaaattaggaattaaaataaggaatattggaagaagagtataaagtctatataggaatttagaattaattaaaattcagaataaaaataataaaattaaaagtagagtttagagtaattatggaaatacaatttacaaataactaaaattagaaattagaaaataaaatttggaacaatagtctagagtccatataggaatacaattccgaagtaactgaaatttgaaattaaaaaataaataatatcgaaagatgagtttagagtctatatagaaattaaattagaaataatgaaaagttcattttttttaaaaaagcaatattataattatagtctacagtccatatagaaacacaatttataaataacggaaattcggaattgaaaaatatgaaatattggaagaggagtctagagttcatataggagtataatttagaaataactaaaaatttgaatttaaaataaaaatataggaacacaatttataaattatagaaattcataattaaaaaaaattaaagaatgttggaagaggagtctagagtccatctagcaatataatttagaaataactaaaattcggtattaaaaaaataattaatacctatcacatatatacaacataatatgaatattgcacattgatagtttattcaagttagtacaattttaaattatcttgttatttatgatattttaataaaaaataagaaaaaaaatatatgctactataatataagaatgctagccgcgcaatttgtgcggggcaccatgctagttgttataatataatatggacccgttccgattaatccgtgtgcattattctctttttttcaccaattaacatggtaacttctagggctctcaaaacaaacatgttactccttttagcattctattataatattttagtagcaatagatttctaagctcctagattagttgtagataggaaaatgttgtaagtttttgaaaatagacgccattgatttactgtaggtggatgttaatatctagatgcgagccacaattatcaaacagaacgtggaacttgctccaccactaccagtctatcatgttatctactatgtgtgttttcacgttccaaatcaaaatacagaaatatatatattactacttaagcttttgagtgttcgacagcactcgcttggtggcattttgaataaatttattttatgatgatattttaaattgcatatgtatgaaggaagaagtagccgtcgtataaagacttaccgttgagttggggattagatgtgatccgcagactttccagttgggtcagattccctattgttgagggtatcgacccagagaagccacaactatccatctctaaatttgccaacttcgtaaaattaccgatccacggtggtatttgctgtccaaagaactcgcaccctctaaagtccaaggtctccaattttgcaagattgccaatctgatatggtattattgacccagagaaattgcagtcccagatccacaaaaacttcaaattcgtcaaattgcctatccaggagggtgccgattcagagaaatcgtacgatacaagctccaaagcagtcagctgcttaaggttgcctacccaagataataccgccttctccaagcctgattccgatccttgcaattccagttctgtcaatgaaggaagcttatctaataaagagggcagctccttggaagttcgtgccgtgctcatacccaaacgcttcaaggacttgagattggcaaatgaggacggtatgtgataagataaattggttgctgctagacctagtgtttctagattatttccatcagggaattctggtaggttaatagaaagattggggttatgagacaaatcaagcgttctcaaactttttaggtggaagatttttgttgggaactgcccttcaaaagaattgcctgcaatttcaagaatgctcaaagaagataattcagcacagaactcaggaactttgctggggagtccaaaattgtatccaaggttgatcacctttaaggaacgaagccttgagaaggaagagtgaataggaccagatatacggcacgcaaacaagctaagaatctcgagttgaggaatgttgtctgctaaaacaactgaccaagttgatccgaaaatttctatctcatcaagatggagctccctcaggttgctcatgtttgccatgacggtttggaaacttggttcatcgaaatacaacccatcattactagaaaagtcaagagtgacaagtttcatgaggcaagcaagtccaatggggatctgaccataaaagttgctgtgtgagaagttgaggtggatcatatctgtgagcctctcaaacccagatactgggagttcggctctccaaaagtaattggaagcaaggttaaggtttgtaagagaggtgaggttaaagagtgcagcatcgagacgattgctcatcaagttcaactcactgaggtcaagggaaatgaccctgccggaggccataccacatgtgatgccctcccagtggcagcagtccgatccagctcgccatgacgataagtttgcattattgatgaaggatttttgagctgtaggagggaagnnnnnnnnnnnnnnnnnnnnnnnnnnnnnnnnnnnnnnnnnnnnnnnnnn

SEQ ID NO: 64183 - DNA, 793 bp, Oryza sativa
atatgtatggcacatataaccatataacatatctttttactactacggttacatataaaggacttgacttgacatttactaagatcttaaagacctttgtactaattgatgtctcaaacaataggttccatggcagcattcctgaaactattgccacactaagcgtgctcagtggtctcaacatgtcacataatgctcttacaggaccaattcccaaccagcttgctagtctgcatcaacttgagtctttggacctctcttcaaataagctttctggggagatccctcaaaaattagcatccttggacttcctatcaacattgaacctatcaaataatatgctggagggaagaataccagagtcacctcatttcttgacactccacaatagttcatttataagaaatgctggtttgtgtgggcctccactgtcaaacgaatgcagcaacaaatcaacatcttctgaagagaaatctgtagacgttatgctatttctcttcgttggattgggttttggtgttgggttcgctattgcagttgtagtttcatggaaaccttgcattggcaaataatctttgaaggaatccaccctttttttatatttatctgttcaggagtctgccagtctgcttccccttgtaattttagctgtaattgtagctagcatgtatataatactatgtgcatggacaacacttttccatcatgcatgcatcctataagattagttgtttattaccttgaaaattttatacaagccaacaaacaattgttatgtctgaaacaagaaagg

SEQ ID NO: 64184 - DNA, 1131 bp, Oryza sativa
caccactctgtgataactatttattgctggaatggaaattttcctatgttttggaggcaaaatcaaattggtggaacaatcctgactgaaatacaggcaaattaccaaatcattggatcagtatttctccttatgtgttgagaagtagtttaattgtattatgtcaaggtccttgaggttaactcctgcatgctaagatatgacacatcgactctgctagtctgcatcctaccttcaatggatgaaaaaaaatgcaatgatatctcaattattgtccagttgcatcaatgtattgcgtaaagcatcagtatttgattccgctagtaaaattgtgagtcctcttcattagtaatgattttcaagccatgggacagaaatcctttttgtcttcttttggtagacataactggttattcccttctgtttgttaatccagaacattatattcttgaacaatctgtgtttgttagctccgtaatcttatattcttatgtcctttattttcttgagtctgacttctgctcctttttcctatgctaacttatgaagacttctgtcctatgctaacttatgacttgtctgggtgcagagtgtagcttatgatcgatctagtgctccgaaggatttccaggtcagtggatggtatgaaggaccagaggatgattcagacaaggaatcacgtgtggtgacaaatctaggagagttttcttatgaccttgagaagaacaatgcacagaccttccaactggagagaaccgcagattcacgagtcatcaacatggttcggcttgacttctgctcaaaccatggaaattcagaactgacatgcatctatcgcttcagggtgcatggtagagaacctggctctccttaagctgctgcagtgaaagcctgatctgagagctgcatgcctgagtttgacaacatcctcaggcttcaatatacccagtaagacaatgattctagtccactggattgactgttagaagatagaagtgtggtgcggctccatctgactcaggttgattttactctgtatcataatgccatgaaaatatgctgactcgcagttctgctagctagatgtcacactgtttgtatctgctcactctgatagtctgattgctcttt

SEQ ID NO: 64185 - DNA, 1045 bp, Oryza sativa
agtaacatataaatattagctggttctctctatgatcttcccacggtattaaacaaatacgatacccttggaatactctcgggtgaaatgatataatggtatatccgtatgcttgagaatggaatctgtaaccatatgtttctgcgctattgctgagaattatattctagtaatatcgttaagaaataccaacaatggccttaatttttctcagggttggcttcgattcctcgtccggagactagaaaaccgagtagctttcctgagggtactccaaatgtgcaattctccggctttagcttcagctgatgtcgtcggagattgttgaacatttcctctaggtcatccatcagtgtgtctcccgtctttgtcttgacgacaacatcgtcgatgtatgcctcaacgttttgtccgatctgatcaccaagagctccctggatctcgcgctaatatgtattgcccgcgctgatcaatctgaacgacatcttggaatagcagaatacaccggagggcgtgattaatgttgtcttttctcgtcctctttagccatactgatctggtggtagccggagtaagcatcgaggaaactcaacaactcgcaaccgtctgttgagtccaccagttggtctattcaggctagaggaaagtgatccttagggaacaccttgttgagatcggtgaagtccacacacattctccacttttccattggctttgcacaccatgactgggttagcgagccactctggatggagaacttctttgatgaagccagctttgagaagtttgtcgagctcttctcgtatggcctgtttccgatcgggtgcgaatctccgcagtttttgcttaattggcttggcatcgggtcgcaccatgagtttgtgctcaatcacctccctggggactcccggtatgtctgaccgttgccaagcgaacacgtctgcattgtcttagaggaatgtgatgagcttgattcctatttgctgcctagcattgccccgatcttgacggtcttgtcaaggtagaagctggttagagggacgat

SEQ ID NO: 64186 - DNA, 1629 bp, Oryza sativa
ttgttccaccaatttgattttgcctccaaaacataggaaaatttccattccagcaataaatagttatcacagagtggtgatctttttggttttaaacattttacagaaataattgtgttcctttgacaagttgtggcataactctaagatcacccagcaaaagatattacatatttgggttctgcttcagtgccatatataagatatactatcttagcaggggtatgttacaaataacctgttttgaggtggtatttctacaaatgtaatgttatttgatgcacaaattaaaaaaaaaattctggaagttttcaattgatgcaccagcattataagcagaatgagagtagagagcgcacaaaataagatgaattatgcaatgcaaggtaggacagagtgatgttaaattgaattaagacaatatgacgcaataaccttaccttgtccacatgctctagacttactgcttcaggaattattcctgtcctcagcttgatctccacataaccactacttccttgtagtgcaaagcactctccaggctggccaaaacttggctccagcattttcttagcttgttcaagcaaactattacgactaggcataaagctcttagctttcctgaaagcttccgaatgcttaaccactttacccccaccagatgctaatgcataatccaccattccaaggccatctgctgcatgcctctctatctccatctcaactatctccttggcaaataacctaatatcatccaagcttatgtcgccaacagtaccatccaaacccttctttttcttcaactgttccacaatctcatcaaattcttttttagaaacaaaacccatgtccctaagctcagcaagtgatttatctaatttgtcagtcttgccttctagtgccttcatcttaatctccagcttattacccttgtcttcgaattgcttcgtgatgtccctccttgttttgtcaatctcatttcctagcttcttgtctaaaatatccagctgtacctgaagcatcttggttgtcttcttgaacccttccactttggacagcctgctctccatatccagtgttgtaaatgataaatcaccattttgccatctccagaacagctgccccatccaagcgacagccgaaatgagaaggcaaagtttcatcaacacacttagagcgatttcccacttggccttttcttgcttagcaccactcttcttttgacggtcagcagcagctgcagaggcaattgcatcttttcttgcctccaatggatactttgatttgccaagaactgactctccacggatagtatgactaagatccttcttgtcagtgatcttatcaactgatgaggtaccattgaatccaccatcagcaaggagctcaggtgaggctttcttccttgcaacaactaccgtccgccgcctaacatcttggctggaatgtgagtccatactcaacgcgtggttcccatttgtatttgcggttggaaccgcagcagttgagactgacattgttgtcccctcaaggtacaaacgggagaactatgatgatataagctggaagcaatgatgcacctgaaattgaaaccatagcgaatactacacattcttcccgcaaaaaaaa

SEQ ID NO: 64187 - DNA, 3348 bp, Oryza sativa
ggtgaaggcaaataaagagaaacgcttccagatctagaagagaagattagggttaaggcagagatggatgggaaaggggatgtgcgtaggtacctcaccgccaccggcggcggaagcagtgggaccgctgctcgcgggttgtagatcggcgcaggcgacgggcggccgccggccgggcgaggagacgggagtcgaggcggcgaggcccaagggccaagggaacgggatttacgctgttactatactggagtagtactcttttttcttctcctctctttttacacgattcacgcgagggagaggaaacgggaaggaaggggagagacggcctgacaaggtgggttggccccacatgtaagataccaggggacatagggggtgtttagatacccaaaattttacgccatgtcacattgaacgcttgagcacttattaaatataggcgaaaaaaaactaattacacatattgcgactaatttatgagacaaatcttttaagcctaattgctctatgatttaacaatgtggtgcaacattaaacatttgccatggcggattaatgaggcttaataaattcgtctcgcggtttactgtcggattttttaattagttttttttattattctatgtttaatacatcaaatttgtgtccgtatatccaatgtaacatgccaaaatttttcacccctggatataaacacagccataggcttgtttagttgggaaaaaaaatttggccttgcagattccgtctagaaactacgagacgaatttattaaacctaattaatccgtcattagtaaatgtttactgtagcatcacattatcaagtagcatcatattatcaaatcatggcacaattaggcttaaaagatttgtctcgtaatttacacgcaatctgtgtaattggtttttttgtctatatttaatactccatacatgtgtacaaacattcgatgtgatagcgtgaaaagtttttgtgtggtaactaaacatgcccatattcagagtccacgaaatcgattggattttgaaaaaaaaaacgatgtttcgacgttgctcgacagtagctctcctctaaaattttgatggttctatgaaaatttaaatttgaatagataaaaacgaaaaaataaaagaaatcctataaatagtatggtattattagaacctgttggtatgtaacttttttaaaaaaaatgaatttcgctgatgtaaacattctccaaaaaatgttaaaaaaactatggaggtgttcgtatgctagaagctagaataaaaccccagtattaactttagaccttgtgtattggactataaacttgtaatattagactataatttatatggtaggcattccatttggccaatggttaatgagtgatgccaagatatatattgaattgtgcatgatatgtcatatgtgatctaaattattgtcttttatgaatatgtgtatatgtcaatgtgaagttatcaaatttataagaaagggaatgccaaaatttttagatttttttcaaaattttagcatttttgttctagtattttctacgtttttaggaaacaaaataaaattgaaatttctcgttgatttctcgacaaaatcgacctgttttccttacaaaccaattggtgtttttactttgcttgcacttccaattgccgatcggaatttcaaagtttccatttgaaatttttgataaagttgatcagttttcaacacaagactaaccgaaatgggaatttgaattcaatttttcccaacaaaatttgtttagaatctatcgattttctatcagattccacgaaaatcgatgtgcctccagtgtcaggcatggaaggtagtatcagaattgcaaacaccggatatattcagttaaagccaatgaataaataaaaacctttgaaaacaagacctgaaagttttgtaaagaaagaaaaataattagaagaaagaagaaaaatagcatcataatagccgtttgcaaatatttaaataattcaaatttaaatatctaaaatctagttacgtactcattttaatttcaaatcgagtgaaacttgaattaaaattcatccatgagctaagcgtagcataattggttaggtttttttttaatagaaagtcctatactttaacgtatttatggctaatatagtataggctgtatagctatacaagtcatcccactaagtgaaatggaaaaaatatactttgactccctcaactatggtccgagtatgattcatgacctccaaccataaaaccgggtatattgactcctccaactattaaaaccgatgcaaggtggttttgaaagcggttttggctgacgtagcgctcacgtggcattgttgacctagtcttcgtcccgtgtgtcatcgacgtgtcgcttatctggcacttgtaataaaaaaaaattgtgggaccgacatgtcattcacacaaaaaagaaaatagtgggacccacggacatgtgggcccacatgtcatcctcacctctcccccctctctctttcatcttttccactcctctcaccttccaacagtaaagcggggcgacacgacagcgacgacgcacgggggaggagctcgccggctgtccacgctcgggggaggagcccgccggccgtcccgcgagctcgccggccatccgtgcgcagggggaggagctcgccggccatccgagcgcgggggaggagcccgccggccgtccgcttgccgggtgaggagctcgcgggcgtccgtgcgcgggggaggagctcgccggccgtcctcctgccgggtgaagagctcgccggccgtccacgcacgggggaggagcccgctggccgtcccgcgagctcgccggcgtccgcgcgcgggggaggagctcgcctgtcgtccgcgcgccggggaggagctcgccagcgtcggcgcgcgggtgtggagctcgcttgccgtccgcgcgccgggggaggagctcgccggccgtctgcgcgcctggggtggagctcgccggccgtccgcgcgcgtggggtggagctcgctggccattcgcctgccgggggaggagctagccgtgctttaatttaggcatacgtatatctcgatcgatcgatgcatatgcatgcttgcatatgctttcactgttctggatatggtttcagtctttcagataagctaagtagctcgccgaccgtccacgcgccaccgccttcttcctcctccctcccctgactacggcttcggggaggagctcatgcttcgtgcttccgccggctgatggaaggtgagagaggaaaaaatgtgagagagagaagggggaggtaaggatgaaatgtggggtccacatgtgggtgggtt

SEQ ID NO: 64188 - DNA, 11656 bp, Oryza sativa
aagtatcttttttccaagtggaattaaactattttcatgttttgacagtaagccacatcacctcgattcgttcaagccatcggattgtacataataaacatttgggtagctatcaatcaacacgtagcaatcaacattaaacgttttaccatctcagctaaggcaacgactaatcaaagaggcccaccttgccatctctgagttttgaaacataaagttggaataccaacagcaacgcatgtagcaattaagctcttaatcttccactaaagctattttatctcctgtaacatgcgaatcagatgaacagtcagccttggttcctttatgcgctgttccattcactgggaaagtgggaatgctgttcctcattcatcaatatacccatttatagaccgaatgtaacatttgttgttcaccatcagcgctcggcagttctgctgtgcatatatcgggtgaagatcttctaccataatgtcactatcattacagtcactggtatgtaggtctcacctttctattgatacacatgtcagtgtctataatgatagtatcattatgacagaggatgttaacttattgcattcagttgatgcatctcagtatataccccctccacttcttaggttgatgcttcgacggagcaacgtgcacaatccactttggtcatctctcttgcttgcttgcgcatggctttctttttccttttctttttcttactaatcttactaatttcatttgttgtttagttgtagaatctgagaaaaaggaaggaaggataaagtagcagtttcaatttcttaactttctattgtttgtgaaggttgcaggtatcttataaagagaattaaagggttggtgcattactattttcacggaccggttaaaataaataaggatactttttttttgtcagtaggttatagacatcttcacctgaactttaggaagtttctacttcacaaagactatagtttggaataagcaactacatatatagcatcgttgagtgatcaccatgccgtatattgtctaccaattttatttcttgctacatgctaccattctatttgttgtctctgtgttcaactgagcttggttccacgtaaataggaaatgatctttcacttaaacaaccaagtagaatacaagattaaactgtattccattatgattcaaatttcagttgcttattattataacattgtcaaagtgttcaatgcataacagtacaacgggtgcacatcgtctgccgttcgttgtttcaacggcattgtgccgttggccagtcccaaccgttggtttgaaatggacggataagatcaaaataacccacaaatctatcatcttcataaagcattacgcatatttctctccagggaatacggattactccattcaagaagtgaagaacactcctaatttacgttgaatttgttgttctgtaacttccaccttgacatcaattgatgacaaattaacctatcaaaaatttagctttgttgcatgaggcgacaagctaacagaaaaaaatctttttttttcattttttttgaaaccgatatttttttcacttttacctgtgtcacctggccattttgtttccgtttactcaatgatggaaacattttagcggtgatgccgctctttccttttattcaatcgggacaggtcagaagaagaaaagaggaaagcatcgatcctttagcccgtcggttcgcacatcctgatcatccattcaaagtaacggttgggattgatcaacggcacagtgccgtagaaacagagaatggcagacgatgcgcacccagcaacgtgcggggtatcctctagttattattgtaatggtgtgtatcgatagtgagttacttgatgtaaccatgtgtcacacctagaaatttagcccaaattttcatactattttgtgtaataaatctctatctaggactagccaggtaaacaaaatgataaatataatatacagatccaaacgtaaataaagtaaatacttacagaagaggcatttagtcctcgcaccgaaaagaaagcagcaacagcggaaaagacgatcctagcggcgcttcagctccactccacaagcaaaaactcaactggggtatgagctttattcttttaacatcgtcttcagcttagaagcgctacactctaaaaagtgggaacaataacaaggctaagtacaaccaccatacttagcaagtcacactaatgatgcagacgtgtaaggggatataaggatggcttgtagctatttgcataaaggcagttgtaaagcattttattgagcaaaacagtaaaatagttgagtaattaaggtaatattaaatctccactgatcaatgctacaccacattgaacaagcccaaccatcctacctgaactacaccagttcattaactaattattaaggatgtgactaatcacggtgaatctggccgatcgcccataaccgcgggcacagctatttgaatagttttactctagccagaggtgcacaactgtacccacaagacacaatccaccggcaagtcaccgtgcctgcacagacacgtcaccatgtcgagtgattatgacaagacccttcatataattccctatgaccaatcgatgccgcaccacaggtttcgttcccgcccccagcaggcagcgggcagcctcccctcgtgccacggtgaatccgcaagccgatcaaccaaacaccctagtcgacccaactccatcacgcccaccctagcctgggtacatcagccagaggaaaagctatactacaagtcaagcagttacccattcccgcttgtggcaagcgctgtatgtcttacagggtttcccgtgaaccggtccttaactgccatgggcgcgactagcaaaaccatgcacccacagcccacctttcactcgcattttagttggataattacgaccaatggatcatggccggatgtctcgagcacgcagctcgtcaagatactagatgtctaataatgtaactatcccattatgtgagctagtggtaattaagcatggctaagcatatataattctagctagatcaacataagtatcacgagatagataaagtatcatccaaggttgacaaaggacagatatcaagtaaacatggcacaaatgagcagataggtaaaccctattcccaatgtaattagcaaaagatgcaatttatttgcaaatagtaaatatttataaagtgggctaaatatgctcaaggggaatgtgtgacttgccttgcttcttcactttgatcttttgaactcttttcgtcgcgatcgcggacttccgaaacgatggattctcacgctggcacgcaaaacaaggaaaaacactaataaaaaccaaggaaacagtacatgaaaagtaaacaaacatgtatatctcaattttaaatgaattttgcaagttgaatggctcaattagtagttcgtatgaattagatataaattttagaagttttgagccatttaaatgaatttctagaattaaactgaattattgcgcaaataataattaattttgcaaaggaaaagggactgctgacgtcagcaagggagaggggcgccgcaggcaagcgggccccactggtcagcagcacaagggcgccggtccaaggtaggggatggagctgacaggtggggccgccgggtccacctgtcggcgaaggagggataaaggaggccggttgggggaggaaaagaagacttggggtgaaaggggagccgaggccagctgggccgggagagaaaagggaaggccagccgaagagagagaaaaggggcgcgcgggccgctggatgggagaaggctagggccgaaaacagccaaggaacaagagggaggttttactttgttattcaatttatttaattgatgatatgaacttttgtcacgcccggaaattcactaataatttccgaactaatttgtgcataaaatcctcgtccaggaatcagccgaggtacacaaactgacaatttaatatataaattcatcataataataacgttacatacttataaaagaaaagaaaaacagcagcggaattaacggtctagcgatggcttcagctccactcccacaggcagctcaactggggtataagccaaacgtcttctccttctggatcctttttcttcaactgaggttgattgattattacaagaatgagcatatgacatactgaacaagccacacagcaaatatgcaagtgcacaaggataccaaatgatggcataatataggctcatttgcaaaagcagcatttagcaaaacatttaagagaagtaaaacagtggagtaattaatcagaaattttaatcaatactgaacaacacacccatgctgcacaggcccaaccatcctgaacaaccgtacacggctgtacagatctaactccaaaccaggagctaagcaaattattaccaggtataacatccataattattgtgagaggtgtgagactagtcacgaaaaacattgctcaacccgcccataaccgtgggcacggctattcgaatagttttactctggccagagctgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgtaatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcctaatagtgtgctaatgtttctaagcatggctaagcaatcataactaatatctaactgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgcaataatcggtcttcaattaatcttctgaacactcctgacgcactcacgaaccttcgcaacgacggaaacgacaagctaacacacaaaacgaagaaaaagactaataaaaccaaataaacagtaaaaaacaagcataaacagtacatgtggatatttttaacatatagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcacgctcgaaccaaacgacgaacgacgacggccggcgacgaggtctagcggcggcgcggcttcggtcgacggcggcgacggggctccggtgaccggcgacagcggggtcaggcggccgggcttctccaccctcccgcgcacctaacggtggtgacggcgaccggcggcgacgacggaggcggcggcgcgacgcggatggagctcggccggcgacgatggcggggtggagcacgtggcggcggcgctacgaggcacgggagatcacgggagagggggcaaacgaaagaggaggactagggggtcctatttatagccatggaaggccgggatcgagcccacaacgacgggaaaaactcgggaaagtttagatcttcgccggaaaaaggaaaggttgaaccgcgaaattggaaaggatttccatataaacttttggggatttcttggggaaaaggaagaggagattgagaggattccattcccacaactaatttggagaaaggagcaacgatgtggccggattggtgggaggaggcggcggcactgtgcacgggctggagagcttgggctctgtctggaggtagaagaaggagcactgtagcgacagggacaaaaaacagacttctatgcgggctgagaggaagggagagagaaggggaggcaatgggctggattcggcccaagctgaggaggaggatttttattacttttccaaataaattaaccaatgagatgatctttcaattgttaaaaatactttcaatgctcaaacaattccaagaaaaatcttgaacatacttagacactcaaagtatttaatataataatatccagatcatttgctgattaatttattatttaaataattgctaaattgttctttgtattattaacattaggaattgagctccgaaaattccgagaaaatttcagagagtataattaatcatggagaatttaatacaaattaaatccatccatgctttaaattaaggaaattttatttcccacatttaacttcacttgtaaattaatgaacagttaatataaattcgattaataatttattaaataatttataaatcctgaaacggaaattcaggctgtgacaactttgcatcattaaaattagatattgagctctaaacattcactagaaatttcagagagttcattagggcacagagaatattacaaaatatttccggccatgatttttaaaggaaaattttattttcctccagaatttcacttgattaaattgctttaacttttatttaatttctagaaaatgaattattaaatgatttttaatcccgaacgaaaatcggggcgttacaccatggttgctattgatacaaccgttgctcacatcaaagataaaattgtctaagttctggaatccaattcagtcgcttgcaacaatgatttcaaacgactgccaaatgtgcatacgacctccgttctagattcatgagtacttgatagaaagcttttgaagtcctctttccaatgaatccaaccttgtccccaaattccatctcagtcgacgacaaccaaagaaacaaggtgttgtgtcaccagtaatgggcctatggacctttaacgttgtctggggagctcagcccaagtggggtgcgccccaatctggtggagcacgaccctaggaccctcttggtcgtccaaccacctctttaaatagcttggtacccctttagggtttcttgggttttgtttagattaaagtttagccatttctacttgcttgcagcgcgtgtcggctagaccgcacgtctgtttgtcttcgaaaccctaatttatcatttgtattcaatttctatttgcaatatcagattgattttatctcgttctcttgtttgtttgattttcttgcaagaataaggttgatctacatcagctagattaacaaccaacgaagaggtgtatcgatcgctaaggcgcaacacaacaacgtcttggacagttgtagtcggatcattaacgtttcttccaaatcataattatcattaactcactgaaagatcgggctaatcatagccgtgagtgcctcaagtagaactcagggtttatcattacttgttatgatttcatcaatcgccacatataacgtcctagtgtctcggactagtgctcataaggggaggatttgattgtatgttgcaggaagatgcttaatgtgacttcgtcaagatatgtcaatccagattccagactcaaagatgctagtagaagtagcacatataagcatcctcatttgtgctatgttcaagaaaaactatctaacaacaatggctttttttaaataaaacatgaatggattttttttctagcataaatggtaaccctgtactgccttttttttcccctagagctcggtactctgagcacttaaatgtcaatatatttctcaattcgaaaatgacttgagtgattggtttgaatgtcttggatcttattaggaaactggacatctgtaacaagaaatttagatatgtgtatgaggtgttgctcgtcaactagaacaaaatgcgcaatggctatgaaatagaccctccgccagcctttggctttactcctccaaatgcatgaagcaacatataaattatttttctccaataaaggctgcagtgatattgctttctgatccataatgattgatgaactaattttcttgtcataaactcaataatattattgttttacgggtagtataaggtttgctcatctcctcaccataaactcagtattattgttttacggggtagtataaggtttgctcagtattatcgaatttgtacgctgatgacccctctcgctaaaccgtggtgcctgttcgcctgggagtcctcctcgtccgccaacctcgccatctacaaaaggtacaaatcccctcatcctccctccccaccaccatttgcccctttgccacctgatgcgctcaccagttagaggcatagttatattgctcttatttttcttatagaaatcgatgtcttttgcatcacggattcttctttacgtcacgtattgcatgcccctcttattagtgtgcccaatcttggaggtacttgccaatttttgttattgtgggatatagacaaggaaaacactacattaggattgttgctcatgatctgcttggcaaaatgcctctaaggttattacttattacttctgaaattttgagtaccttactttgtatatttttttgacagtatgttaatttgtatctcctagtaacataagattttaatttgattatgttaatttgaagatggtgacattttaactttattagatttccttgtataaagaaataatttttgtttaacactatcattggttcattaatttaatttgtactccctctgcccccaaaatataagcatttttaaaacatttttactttgactattaattaaaaaaataaaaaatatctatcatgtaaaattgatgttactatatttgtcattaaacatagtagatctccatcccatattacttgtctttttaagtttttgtttgtcaatgtttgatcattcgttttattcaaaaaaatttaaaattattatttattttgtttatcatttgctttattatcaaaagtactttacatatgacttatcttttttttatatttgcactaatttttcaaataaaatgaatggtcaaacattgtaaataaaaaatcaaaaatgtcacctattatgggacgaagggagtaatatgcatttctttttatttaaaatagatattgttagttaaagtagtatctcgaatactatgttaaagtaaaaaaatgggtatattttgggatggagggagtacttgtatgtgtagcgttagcaagaggggattatagttgggtttaatttgatgagatatcctcatcgtaacaccaccgctgattaaaaagggcgaaaaaggctaaaagaaagagggcaagaaacgcaagagggatccaagaaacgggaggaggcgtcgaccaagattcgccgcccatggcaacgcgcgcgccggcgaccggatccacgaccgtgacggtggacccctccccgtcctcctcctcctccgcgccggcctcgtcggctcccccgccggcggcggagtcggtggtgctgcggctgaagcggcggccgaagaagaaggtgacctggaaggaggggacggtggacaacgagtccctcggccgcaagagctccaagaagtgctgcatcttccacaaggaggtccccttcgacgaggattgcagcgacgacgagcccgacggcggcggcggccgccggagccctcccggggacgccggcgaggggacaagcggcggcggcggatgctgctcctcgtcctcccatggtcacggccacggccacgaccattgatctttttgattgaattggtacgaattggtgagtcttgatgcttatctttactgattaatttggtgaggtagatttggggaaaacatatttctaggttgtgttgcaatttgcggttaaacatgtttcaatcggcaaatcaaatttgtcgacacatttcagctgccatacatttgatttgttctctggtattaatagctgtaattattctaatatgaaggtataaggactgatttgatgttcagtattctagaaattttgaagcctcaatgatcaaactcttctaacctgcatgtgcaactactccatatatatgtaaacatattttcactagtgaatttgttatgcttgtgttattccgttactgatctttatatgcttggttgcagtcaacttatcgtggaactacgcatcaatgtgtgaagttataacttgaaggggaaaattgcttctctgtgccgaaacagtaggtgaaatgatactgctttgttttgtgttgcgattgtggatgctgtactagctttatttttgtgtggcatttgcaagagagaaacgttgtaccgtatagctgactttattgttggtcatgtgcaattctcttgagatgtatgaagtattgctcctgttgttattgttaccattccatcgcatcaaatatcctcttgttctttattttaatatggtgagttggtagttgtattgtattcacattaatagcagtgtattatgtgatgatgatgaaataccttgccccaaattactaaattagcacccttttatcaacaggttgaggtttattagttaacaaaatcattttgtcgaattcaattattactcactatcaatctcatcttttggcttatgcttatgcttataagccaaattttaaattttcaaccttaaatttgtagttgatgttgggggttttttttcatcgtagtttattttccggcctttgcttttggattgctaagaacacgtatatgaaagttttatttacaaattattttccgtttgcaaatatgccgtttcgcttactctgtcaataagcgaaacgatggagtcctatgccagaaatcaaaattcagacatttgtggaatcaattattaagtgcaaatgcagccatacaaatcatttttgttcattgacaacatcataatactaaacaattcacagatagctctgaagttagttgtcacttatcagtttagtcgacaacagtatggaatttgaaggttgcctgtattcagtcttagcagagagtggattctggttgtgttagcggaagcagataaggccgtgaagctattttgtctatttactaaaggatgattagctgtttatctttgtcagtataaaacaatacatggtatcagtttgataagtattgtcagtataaaagaatacatggtatcaggatgtttagtatgacttggaacttgtctgcgccggtgctcccggtaagccgaaacatttttgattgtcaagcttcgatctggtggtattgtggtgacaatggctgctatattttaagggggaatgtctatctttcta

SEQ ID NO: 64189 - DNA, 2138 bp, Oryza sativa
gaccagtggatccccctgtttaactggatgtacacagaaggtgtaaagagaaaaaaaatgaccagttagcaagccacgcagggcttgtggtcgagaatgacaactgcacatgaatgttagagtttacccttatttacttgcagcctgtgccgttttgttggtaatgacaattgcaccttgagctgtgacttttgattacaggtttttactttgtctcttgcttgatctgaggatgcaacctgcgttgtcttaaatctgatgctcgatgttgtattgcaatcaggagttctatatttctgtttcatataatgaacgaaactggcactccagcagcttgtggttttgtttgccaagtactgaaaccgaaggattcgagatgaagaaaatctctttgaatgacgatgagtaacaagctctttgaatcaatatgcatcatttgagaaaaacaagctcaatgacgatgagtaacagatcagacgaaacaaaatttagtctacctgattccctacagttttatccctgggtctgaatcttctatactgacaggaaatgatgaatacatatatgatacatgagaatccattagctctctaatccttttaatctttgttaaaacagctctccatggtctccacgaacttgggcgtgatacgatcaccagcagccagcttgtaatactcaaactttgcttcttcacactccaacgcagccttcttgcaagccctgatacttcctgaatgaagcaaatgatattgatgattagctatgctcccaggtccccatgggctatggctttgcaaacatttagcttggagaatgcaacaaacaagaataatggcggaaaagtagagcctcgatcatgctagagttaaaatgctggaaaacacaagtagttttgacaaactgtagtgttcatgccatcgtaaattaagagaatgcatttagcaatgctggtagcatatgaacttcaccttacactgaaaatcaggaatggcctgaattcagaaaatcaggactagattcatgtctcacatgttgccacaatccattctccacccactactaatcaaaatttgtactaagatgtgcagacaaagtttttgttgaaatatctaaaagcccactaattcactaattcaaggcacacactaggaataagtggtttatggtgcgaaaacacatgtgaacgaatttggcaatgatattctctaattccacttcaaaaaaactctatactgacacagtgagatgagaatatgaaattgttgctgaaatattgaatttctttttgttacaatggtcattggtagcaattgaacaacagaaccatgtggaagaaccaaatggcatgaaacaatcagctgtagacactacaaacaatacaaatgtggttcagtcacccataatccactcgctgttcaaatccattttgatacagagatgcgcatatgaagttgttgctatagtagtacaatacaatgtgcaattcaaaatcttctttaagttggtagaatcaaagaaaggaaccaggatcacatcatatttaagttgcatgaattcaggtctgacagacaatagggtggagtaaataaagcaacacagaatggtcagatagacagttttatagctgggaattgatttcgcaaactcaggtagcagatcagacggtgaaataaacttattccagaaataaaactaagactaagactactttcttcgaccatgtatataggaagtgatctactcaccactcacatcccgcagattgaatgaaactgggattttcccaatgctcctcaccatggtgatagcagcccacactttctggtgatcttcacgggaaactcggatcacgcaaagcttcgttatcggatttacatacttcactatagatgaatagagctcataaatacctctaaataaagaaaaaaaatgcaagcatctatgacgttgtcggaaaactgtaaggaggttttcgatgtaacaagcaccaaccttgcaacgacccaagacaagctgctaggccacactccccaaagttgatctggatgctgtctctgatagctttggtactattgagctgggtgagaatgagagggtcggactggtccttgcctgccgtatcgatgaatgcctcc

SEQ ID NO: 64190 - DNA, 2736 bp, Oryza sativa
cgccctatcaaagattatagtcatgcagactaataaatacagatgataaatccaactcgaaaccagaaaaaaactgacaaaatgaccataccaaaattattgcacaagtatttgttcatatggcatcaaatcaatcaagccagtgatgatcaagtattgccttgacgactaaaacagagccaaatgaccagtggcatgggacatgggggttcagttgaacccccccaaacctttttgggaaccatcaaactgttactagtattaaggtttaaggtaaatttctagaacagaagctagggttaacgcaaattcgagaaaaagtgcgtgggtagagagagagagagaggtaggtgaaagaggatgtgcgagacggatgcggcggaagcagcaggacgagcgacggcgacccagctcgctcgctcgcgcgatggatggggatcagcacaagcggtggtggtggaggatgtgctcaccaggatggatgcggcggaagcagcaggacgaacgacgaagccctactcgctcgcgggatggatagggatcggcggaggccgagggcaaactcaggaatcaggatgactcgcacatcccacccggattgcttgcacatcccacctcaccctatacaaacggtggtatatgaaaatacaactaataatgcaaaatttgctacaggacaccgaaagattatgatctttactatgagacacccgaagatcgtgtatttgctcgtgcacactgtaaaaaagtggtaatgagctgctgaacactcctctcattattttattattttctatcaaaatggagagagaaactttggttaaagacaaatttgcccatgggctcacttgtcaatctctctttctctgatgttcttcttcctctctttctctctgttcatctcttcctctctctgtcgcaggctcgcggcacaccgggcagagctccacggcgaaggtgtgccagcaaggacgacgaggcggcaacgtgcttggacgcgacgacctgcagtgggtgacggactgcacgatggcgcgggcgcggcgcgcggggtcgccgctcttgaagatgcccgaggcgacgaagacgccgtcgcagccgagctgcatcatgagggcggcatcggcgggtgtggcgacgccgccggccgcgaactgcacgacggggaggcggcccagctgcttggtctgcatgacgaggttgtagggcgcggcgatgcgcttggcgtaggcgaagacctcgtcgtcgtccatgttgcggagcgcgtggatttcgcccatgacggagcgcacgtggccgacggcctcgacgacgttgccagtgcctcacagacgcggtgcgcgacttcctcgatgacgccgatgacgtgctgttcgggcagctcgcggcggagcacgcgacgaggcggcggcgtgcttggacgcgatgacatgggcgggccacggcgaggtgacgaggtcaacgaggcgggtggcgtgggaggctgggagcgcgacgcgaagaagtcgagcccgccgccgccgccgcgcaccgcgccgacgcggagagcgtcgccggcggcaccgtgggcgatgcaccgccgccgccgccccgccgtggctgagccgtcccggctcgggccggctgccgtcgccttctgctcagtgtgaagaagaagaagaaggggaaaataaaagaagtgagaggaagaacactgtacaggggcattttagtacttacataactctttctctcttcatttcaaccagaaataataaaataatgggaggagtgtccagcaactaattaccacttttttacaatgtccacgagcaaatacacgatcttcgggtgtctcatagcaaagactgcaatctttcggtgtcctgtagcaaattttaccttataatatctagcactgctattctaatcctgtcctattcatatcctatatagttatatagtttatccttactttaatgctatttatctcttatctcattaagccacatcactctaattatttctaacctttggatgatagatctatggttcaatttgtctcttctttcttctctcataatatcatgcaatctcaattattttaggctcaaaattcataagtatcaaattattttagttttaataatcatgttgcatattatttgtacatatttaatttcccgcagcaatacgacgaggtatttatctagttttccaaataaagccccctaggttggacctttgagatggtggatttttatttctctttttcgtataaggttaagatgatagataaataataggtatgtttgggcataggccgtgccgtgtcggcctacgtgctgaggttggaacccatgcacgacccagtgagatatcgggtcatgtcatgttggcctggcaagatttggctacgtgggctgtgcagaggccagttagcccaaatttgttatataccaagaaaaaaaatgcgaatagtatgttgcatcctgctgcacaaactttagtgaagctttagtgaggtcctccgctcactgatagcacattccacatcctcctcatcaagcagcgtcgtagcccttcacttcctacttccttcgtcttgagccggtgagtccacaatgaccaaaatgcttagtggttgtcctcatgaatagggtgagcggttggctacactacaacgctaccgtgcatacctacatcgacgagcgtcctccatcgcttcttctgcccttgagcccctggcttacttga

SEQ ID NO: 64191 - DNA, 6090 bp, Oryza sativa
atgccgcaatggagcaaattgtgtgctattcctggaccatgtcgtgctggctcgctacatgcacttgtcatgttagcatgttgggtggtagcaacccaaacatggcgtggctagacgggccatgccagcacgatccacagccaaatagatcatgtttttcctgagctgtgagctgcacatgcgtactcggacagacacggaaggacccaacctatttgacaacctataggagaatttggtaaattcataggcattattatgtttgtacagatgggatcaattaagacacctcagttgcaactaattaatttgtttagtgtcaaattaaagctgtaatagtgattacactccagccaaccagaaaaataacacaccattttcccaaaataacatgtaagcatgatataatctagaaaacatatccattttattcttgtttttattagctcaatttcaagttgtgttgtctaagacaaaatttatttcaatatgcagaatgaggataaaccgatctcatggggatatacacattttcgttgcttatctcattggtgaaaaggaatatattttctcactaaatcaacacttgttaagagttgatacgtcataaaaaaattaagggccatccgatttctgctcttgaagttttaggccattggattctctgaatggtgaaatatctttttcgcccctaaggaaactgctatcaatttctaatgtaagaaatgaaatgagttcactataacaattataataaaatcggtatatgattcctgtaacttgctatagattctcctatatagtacattagattcctgtatacctcgttctttcataagaaacacatgcatgctagtagaaaaacagatataatccatccattccaaaaaaaaaaaaggcaatgtgacccattcagaggattcaccagtggcatttttaccctttttctgcatccaaccatatatacggctatcaaaatagggaacttagccccacaaacaatcaaatctaaattttgttcctatggagatttgaactcaagaccttgagatattacttaggtcattgtaacaactaggctacgttccctttcctggcagccctctatgcacacctcagaaggccattgaaatgcttcgctcacaagaacacctgcagaggcaacttctgctattcaaacactcttttaagatcatcaagaatgtgatagagcacccacatgatatcaagtacaggagactgcgtaaggtatgcttggctgttcttatgctcttttattaggttcctttggtccactaaaataaattcttactgatcctaatttttcaaatatgcagtccaatccacagttccaaaggagtgtggcgagctacaaaggtctctatctcttattcctagatactccctccatccacaacaaaagttacacctatttcacatttgagtttttccaaataaattattcctatttgtagtctttatacatttaagacttaaatgaaaagataaattaaatgttttattagaatccaagaaattatctaaatactcatccttgattgattttgtaacatccaaggtgatttaatttctccttagtcttggtgtcaaaagtaatatgtgtaacttttatggatagagggagtggttgatacccacttcagagcattaacactaaagctgtaaaatcgtgaggccacgtcatctgaaatggtgagccgtccgatctgaacgttccacgccattcgatctgaacgttccaaattccaagctccatgttcagttgccgatcaagcctggcccaaattacccggctagaacagcccatccagtccccattagctgccatcctctcaccgagcattgcacggccgagtaaccgtgcatggtggtggcaagagcaattgattctaatggatgccatcattttcttttttaaaaccgatgttatcatgatggggcagataaggggttactcctaatggattattaatttcccctattctcttcgtatcccctctttcgatactgccaataaatttacataatccttagagcaagtttaatagtttaatagtatagccaactactaactctaatcatctatagccaatctaatagctcatttgtataatagttacatactacactattaatacttgatctcacctgtcatacacacattgtgtcttggagtccgtgctatagctggctacaaatctgtagcccgctgctcttctctctccttatttattttcttaaaatatatttgcagctgacttatagcttgctattgtactgctcttatgcgtcaatataatagggccaatggtgttccatttctgttgctggagtttgctcgctggaatcataagcatccctacgccatcatcttctttaatcactccagcaagctagcataggctatattagccatcaacttcctctttccttttggtaaattgatctgattttttttctgaccacatttcagttcttacatgtatttcaatgtgtaagcatgctccatacataattgtaattgcattagttttccagtttggctatctcgcattttgttacaccagttttaccatatcaattccttctttttactctgcatccccattcgttttcacatgattttagatactaggttactgacttggttaatttcttttggttgtcccgaatcacacatcatttttcattactgcagttgaagcatgtaggaaacaatatcatctagacctacatattcagatctaatatgtatttcaattatgacctttacctggtgaagttatcttaattagtatatatacggtaattaatatgatttcctgaaactccatatcaagaataagggccagcatagatacgctggattggctcctgtcgcagtatatatgttggttcatttcactgtccgagcatcaactacctcttatcatcagtaaaattaaataaacaaggcaccacacatcaaagtcactttcacgaaaaatagtaccagcaacaaatattaaaattaatatccactcctactctactattgatttacctccttttgatttacatcttgctacctccttttgattaacattacttcatgtggtcatatgtatttaatatagttaatatacaagtatattatatatagcaaatagtactaagcatgccttccaatttatcctaaattaagaatttcctcagtaacaagaaaaattgatctccagtcatcattcttaatcattgttctacaattttacgcacgtaacataattttatttatgattttatacagtcccgcagcaacgcgtgggatatcacctagtttgctttataaactcccctcttcttttttccttcaggtcttcgaaaatctactgtaactaacttcctcattttttttgcctccctgaaaacagctgcaatggagttccttgaattgattggtttctgtgaggatgttgtctcggatgagattggtcgtgcagagacttacttggtattgaaaaggaacgatcctagcttgccgtggcttgcaaagtcctctcttgaagtttccacaattgtttcaccaagtaatctcctattgcttccgtatacctgtaaatcattttcattactgttgtgtggatgctcataggcaactgatgtagtatggtcttcctacacgaagattgtttgtacatggaaacaccaaatggtctgtactatctgtccaagcttcatgattttacatcaaatatacacactgcagataaatttcctgacaaaaatacaaaatggacacattttcccttttgtgtggactccgatagaaattgattccagatgctcacaaatgccaaccgtatccacgaataaagtctagactagacggtgcaatccattatcatcgcgaagatgtcaattggaactgaagtatatagagccagatttaatcacaaggtctcatgtttgggaactgaaattaaaaaaaaggggactatagaaaaccgtcacaagttttataagggaaaaactttctaatctaaagtattgaaagaactaatctttcttgtcaccggaatgtgccatgtcatcgagattacaagggccgtcagatgaagtataagttcaatatccaccgttaaatcttggacgagcctctcagtaaagaactaatgaaagcctccagagtctttaataggaagcctcacgaatctggcgtatccacgtgtcatagtagaacgaaaaaaaaaaacaaacgaggaaaggaaaagagagagaagcgtacccatcctttcctcctcacgagtcacgaccgccgcatccttccctccctcctccttcccatccccatctccggcgctgccggatcttctcagcacggcgctagatcaaacttgagacgatggattgaagtaggcaacgaagaaacaaagcggggcttcgaggagaggaattcgagcaggacaatgccgccacctcgtcttccctccagccaccacctccgtacgtccactgcatcagcacccaaggaattcttctcctagtccaccccaactccccaagcgtcgaatcagcggtaagttacatacttatattctcaactcaatgaccatcccctcctgacctctcctctattgtatccgccgccatgccacacctacattgtggggacacaatcacataatagtaggaggtagtgagatcatcccaaacaaggatttagtcatagctgatgataatttggctgcttgcagaatgataagctgaaactgattagtggcatactaattgatatcatctgcattgtcaaattttgtgagcatggtgtaactgcctactcttgtgcactgaaatcttcagactacttacattgcacctgttcagcctcactgcatgactgcatgtgcatgactttagggcactcccaacccataacactagacatggtttccataaactccacatcatcaagaaactagtactagacactactcttccaatgcaaacaccactattccatacttcaatttaatgctacttatctcatatgatatcttggatgttgtgtagaaatcatgtctcatgcaagacatggtttccttctctttcctcatttattcacttgccatattattttttgtcctaagtggcaacttatttaatgctatggacaccatcctagtcattgggttgggaatgcctttaatacactgtgcctagctgaaatcttgtgatcgtattctagaggggtatggctgtttaatttcatgagtaatacaattttatttgtatcgatgtcatagttaatagttagatgcaggtacttcaagcagactgttaaaaaaagaaaaaaaatatattgctcaatctaacgactgaatgattagctgatgagcctgtggcaagcatggaacaagatggagcctgaaacaaaattctcaaaacacctgttgaagtcaatttcagggccatctttttatgcgaacttggagcaggcttctaaagatgcgagacatgaaaatacaggagaaattggatatcctgattgagggaaaggacaatttcatgatatttctatctatatgtctaatactccctctgtttcaaaatgtttgacaccgttgactttttagcacatgtttgactgtttgtcttattaaaaaaatttgtgaaatatgtaaaactatatgtgtacatgaaagtatatttaacattgaatcaaataatatgaaaagaataaataattacttaaattttttgaataagacgaatggtcaaacacgtactaaaaagtaaaaagtcaatgttgtcaaatattttaaaacggagggagtaaaacatagttcatcatacgatatattatgacccataaatatagagcttttctacatgtatctaaccaaatggctagtttaactatagtattgttgtgtattgggcctttccaacctcgaacataattccgggctgtaaatttggtgggcttggtgtctaacaacagcagaaggcccacatgcgtcccatcgcaatatcccctcggccgcttgcttcgatgcgtagcggcagtaacacactctcccacttcgcgct

SEQ ID NO: 64192 - DNA, 1204 bp, Oryza sativa
ggtgggcttcgtctcccagccgcgacctcgcgctgtccgctgcaggcggccgccccatccggatgctcacgcctatgcggcggtgggggcgggggcgaagggggggtgaggctaggggtgtcggggtggagaggaagaggctcgtggtgttcgtgtccggtgggggatccaacttccgggcgatccacgatgccgctctgggtggggacgtgaatggcgttgtggttgcgttggttaccgataaaccaggtgatgacgatgacaacgacgatgctttgcttccttgagctctttgggtggcaatttgggtggaattgttgggatttattgggtattttgatgtggcttgcaggctgtggaggagcagagcatgcgaggggtaatggcataccggtcgttgtgttccctaagttgaagtctgctccagagggggtatctactgatgagctgttgaatggtctgaggttggttgcgttgatctcaggcttgggcattcgattttctagctttatagttcatctgttaggtgttaaataagtccatttgcagaaaaaaatgatcgacacaaggcaacatatgagattcttcacacttgcttttagtcttgtttgcaaaatgcatacattgttgtgtgctgacaaaaaaaaatctaatacatttgtcttgtgtgctgacaaaaaaattctaatcaatttgtctgtttttaagtatggagtaccatggttcgaagctgtcaaatgaagatgaattgatcagtacttcaaagattttagtgtttacttactgaatgtgtgtcactaccctgttggagcgtgttcttcatttgtatggcgtgtccactcagttggtcagattagcttctactgttggagtgttttgttatttcctggctgatatgctttaatgtcccactgttgattttttttaccaatagccactccatctttacttctttactgcgtgtttgtagttcccaattcacttaaatcctcttctataagactggcttgtctacttccgatattttttgttgtcacatgcaacaggtctcaagattctcagcccatccttatttcttctgtgaaacagggaactcagggtagacttcattctacttgctggctacctgaagcttataccggttgagctagttcaggcatatccaaaatccattttgaatattcacccttcactactcccggca

SEQ ID NO: 64193 - DNA, 8569 bp, Oryza sativa
  unsure (1)..(8569): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccactgctccccagcgacagagctcacagctgctgcccctccccacctctcaagctcaagctgccaactttttgtttcaataacccaatcaccgagcttgcgcccagtacattgctctgctttgctcagaatgggaaaggggaagaaagaagaggaatgtaaggatgacagggctgggttctgtgatgcttgttgcctcaaaagtcaaaacatgaggtttagtgaagcaaacatcataatctggggggtttgaatcttaaaaatatggcatgatattgcacctgttacaatgaaatctagaaaaactccctatggtaacatataaatctttctcacaaatgaaactccaaaccaagtagcatggattaactaaaagccgcttgctaccttacccacatcaaaatttcaccaatgcttccactaaaggaagtcacagttcaacatttagctggcattccatcttaacagcacaatgtgaacagtgataatgcaaatcaaaccaagcactagttttcctccctcagtgttatggcctggtggaagacacatgggctgtatgcagagccctgggccagagtgtggtaggccaatgaagaaaggtgcaccgatactggtgcagaggtttacaggagggatttagctgttcctcctggaatcattcttaggaataatccttattcaaatagtgaatctttttgtaacgaacatatggtagccaaataactatttgttatggacttatgggcgcaaggtctaggctcacaccatgtattgctcatgtggttactgtaacaccacggtgaattttaaattttagagatgacattacattagtatatcatctatttccatagtattggagagaggtttcttaggggtcaatttatcatatctgtggaaggatatgttggcatctcttttcattaaaaaatgaaacatcaataattagtctaacaatcagggagaagcctactagtggctacatgagagaaacacccctggtcttcagaccctaccccaagccctcaccactcatcaaggaaactccccccaagtcccttttcatttctcctttttaacatgtgctactcctggaaacccacactcaagccatctccttcagctcatgctgccacacagcagccccacatcgcaaacaataattcctcatcgtgatggaagaactatcatatgcaatcaaactatagctacatagtttcaccagcttcttaaatagataaatataaaataccactaaatacaagtgaaagagagtaacaagcaactccacagagtaaaaatacagtatgccatggtttctgatttaataatctcaaaggaattcatgaaaaagaaaacaaagcaaattttctgttttgaacacaaaaaaaactagatttgctccaggacactaaatttatggcatttgctctacgacactctagttttgtggatttactataggacactctagttttgtggctttgccaaaagactttcaagccattattttaatatatcatcttccaattaagagatagaactttgcaaaagatgattttagccttggaacaccttgcaaaattaaaatttgaacacatttggctgaactttaaaatattttgcaaaaatcaaaacttgttacaaataacagaaataaaaaaaaactaaacaactttttgtaaaaaaaaaaattagttttggataacttttaaattgtgcaaaatgtttatagttagccaaaatttgttcaaatttaaactttgcaaggtgtcccaagggtaaaatttgcagagttttatctcttcactggaagaggatatattaaaacaaaggcaaattttgcttaaggacatagtaacttcgtggttttagctccaggagacggtaaaagtcgatctttggtggaagatactctcaaacgttgttatttgctgttggacaccgtagtcattaaaatattaatttccggttgaataggagataaacaaaacgaaagatcaaaaatgcccctgagcccacttgtcatattatttctcttcctatctctcttcatcaagcagtggcacaaatgtcagggaccacctctcccatctctcttcggcaagcagcggcatagacgcacggtagtgcaagggggtagctgtggcgagcagaggagctggtggacgcatggcgagtggcagcacataagaggagttgtggcgtcgtcgccgcgggcagccgcacgatgagtggtgaactggtggtgcaggtggcagcgcaagggattttgtttgttcttctcagctttgccatggattggcacattactcatctctgcttgctttaattggattcgcctatacatgcttgcctctgagagaattaaatatgttttgctttagcatagtgagcagtgtgggggtgaagccgtgggggagatgcactcgacctatgggcggtgaccccagatccgtcacagtgacgtgttgtgctcatggacaatgttgtcgacgccactgcgagcaggatggtgccatcaccgaagcttcacctgccactggcattggaccccaatccctaccagaccctaccctgactcgactcgaagagggcagcggggtattgcaaatgggccaaacaaagaggaagaagaagaatataacaagtgggtccaggggcatttttgacctgtcacgttgtttatcactcctattcaatcaggaaataatattttagtgcgtgtagtatccagaagcaaataactacgttttgagagcgtcttcctccaaagatcaacttttatcgtgtcctggagctaaaaccacaaagtcaaggtgtcctacagcaaaatttgccctaaaataatggccagagtgtcttttggcaaaaaacaaaaaaactagtatctcctatagcaaaaccaaaactagagtatcctagagcaaatgccatgaatttagagtgtcctagagcaaatttttcccaaactttttattagaaaaaacataaatggcattctgttgacaagtcacatttaaaggcatttgaagaaaagacaaaaaatgtttgcagtggaccaagatgaaagaagcatcatgcacactccaaatgttttttacttaaatcgaagacctgccactaaagcaacctattatccaggtatcatagtaagaacaacagaaatgaatgcaagagcaaaaaatctaggttcacatttttcagctttataatatctaatatttaatacatctctatatacaccatcccctccatctgaaaataataagacctaacacttcccgtaaatctaatacaactctttggtcatcaaaaagataaatttacaaaattacacagtccgcataactaatagggaacaagacaattaaggctgtgttcttttgctgactttcccaactcaatcccatcgttttccgcgcgcacactttccaaattgctaaacggtgtgttttttgcaaaaaaaaaaaataaataaataaatctatacaaaagttgcttttaaaatcaaatcaatccatttttcaaatcaaaagttagctaataattaattgtgcgctaatgagtcactccgttttgcgtgtcgaatggattagttccccaactcactccaacgaacgtagcctaagattttattttacagaaccatagaccaagtgtaggattgtgaagaaattacaccccatcacatggaacaggttttgacaagacaagccatgtatcagtgtcatggcattccttcaaatgagctggcctgccttgtcagaatcccaacaaccacaatggatatggagttacttgacaactctgaggtaaacatataactctgagaaatgcaatgtcaagtatgcagtttgacaatacttttgccatccaaagtataaattgtaaactaagaattttctctcccctatgtacccttgagaattcgttcaatcccttatgtacccctgaattttgcctcatcccttatatacccctgagtcttcattttgatctcctctatgcccattccgttagttgaccgttaaatgtttttgaaattgtctatattagccctcacttatacttatgtgctagtttaatgataaaacacaattcttatatgaaaaaagaactatttgtaaataaactaagggaatataattatttgacaacaaattttaaaaataaatcaaaaaaaattaaataaattttaaattaacttttatgaaattcatacattgttttcatcaaaatttgaacccaacaaataaataattttggttcataatttctagctaaaactcttatatggattttgtccaaaaaaaataaatttgctcaacaatttatattttcatttcaataaataattatgctccatttgattttatcatgaattacaatttttcacattgtgaattatgaagtagagtagatagcatgtaactgtaagtatgggaaatgggtaatatggtcattttagaaaaatttaacagtcaactcacggtcaactaatggaatagggatagaggagatcaaaatgaaaactcaagggcatgtagggaattttctctaatattagagaaaatcagatggcgaaacttttcaggggcatgtagggaattttctcttaatactactagcagttactactgagtgcaggacttgaacaatagcaattgattaatcaattgtccctttgttttaaatatatgaaataattgttcggttgtctaagtatgaaataaataagtagttaaacgcttcaatcttttgataagttgttcccttctttgtattagttaacaaggagtaagaacgctagattgagtgaagtgttgggtagcacccctctaaaggtgtcctttagaagggctttggtgggggaaaaccttttagattggtataaggtagtggctaaggtggctttgataaagctcttgaacgacccagaccgattcagatggaaagcatgtggaaatagagcatttttcagtaaattccatgtacagatctttaatgtacaggaatgttgtgccaagaaagtcgataatctggaaactaagaattccaactaagattaagattttcttgtggtatattgagaaaggagtgatcctaactaaggacacgtgggtgctccgcagctcgggtgtgcatgaggctagtggtagtctggtggagcttggctgcttgggcacgacagccatagctgctctggtccgaatgggaggtgacacaaggtgacagcaggagaagatggaagagattagagcagatttggtgcttcacacggcactgtggcaaaggagggattaacttgactaggcatttttgcaaagcccacaaactttgtggtaaatataagtacgccctcaactgcattgcgaaggagcaatcttctcttatttaagaccataaaattatttaattggatcagatttacaccctatagttagggttagatgatcgtttcgataacaggaccaaactcatggttgttttgccatacaagaaaccaaattttgcccgtattagaaaattcagctactggacattccaaaataatggtctttgccacaagacaccacaaaaatgtgggtttgctggaagacactctgaaattacagttatttgctggtggatgctgctcacataatttattgtttttactcaagtgaggagagagaacacttgcaaaatgtctatttgcccttggaacatgtattattaatccctttttgctttacatagtggtgcggtgcctgggcccattttgaaaagctaaataaatagagaggggagaaacagattcgaactagatggagaaaacaaaaggtagtgacatcatttttcaaagtttctctctcctaatcatacattattttgattggagaagtgtccaccagcaaattaccacaaacttaagtgtgtcttttagcaaagccacattttccggtgtcttttggcaaagaccacaatttaagaatgtagcaaattttgcctttttctatgtggtccacctcaagaatgttttcatcaacatagttgacctgtttcatctatccgtttaattatgcgctctgtttttactcttttaatcctccatcatcttaccttaattcccaacagcaaataatcaatgttaatgtagccaacatgacaaaataaactggagttcgctcactgctaacaaaacctccaaaaccgccttaaggtttgtttggataagtagggatatctacaatctttaggactggaagagaaattatactgaaataaccaatctgaaaggagttaagaggctttcatattgccaaacaagttcttagggtgtaaactgatccaggtttgtgggcttagggtggtaacaggttttaaaattcaaggcataaaatggactatttgcagaaattacagagttaaaaagtgggcctatttcagtgacaaaaacattgatttaagttgaaagtttattatctacaatcaatcagcaatgtaaagtttgaaattcaaatagcacttctattttggaaggcttactatcaccctacattgtgcaagcatggcaagagtagtgctatatgaacaaaattcatgtaaaatactggtaaacagaactacatgaaatggttaaaggaggtatcttacttaaagataggttttggccaattctgcctgctgcattgctcattaagcttctgtttgcactccctaagctctccaatctcatcccccaatccgttgccaaccccagttgttaacacttgcttctttgcacctgcaagcttccttgttgcatcccgtgcagcattaagcttagcaattaccttctgctccgaggaaccaataccaactagctccccagcaacaaatacattgaccactgtcatcccacctttttgccatgtcttgaattgtgccatcttcccgtgtttctggcatagttcatgcaacatagtcacaggttgctcgtctattgtttctgctgtaataattggctcaaacagccaccttgtgacctaaatcatatacaacacagctattactatcaccaccagtaaatccatctactctatctatctccgtgtatgtgtatgtgatcataaatgttggcttagatatcatgcagttaaatttctccttttcctcaagggaccatcaaaatttcctaactgcacaattgtaggtacatcaatatgatattagtcatatgataaaaaaaataccagacgcttcccataaataaaattgtttatccaatcttttatgttatttgtattaacagtccaccttatttcttggaggccatgtaaccatgtgagtctctgaagaatgtaaagaattgttagcagtagtacaccataaagtaaaagctaagaaccttccagagcttctcaagatcaaatttgcaatcaacatagacagcagcagcaatggcctcaacaatatcagcgagcaccttgggagccttgacaacactaccaccataaggtacagtactaagatcatcctctggctcttgcttcactgtttcaataaactgacctacctgcattattagtagtatagccaattacagaagaatgataattaaaacattaagtccaatatctacctcataaaaatataatgtagatgtaatagcagaaaaacactaacagttcagagcacctattcaaaagcatttctatagtgtcaacaaacaattgatacaaaatgatgcaattcattcgaaaagattaaaatttgcatatcaaattcccgttatgaataagaggtcaaagacaatggaatttgagtcagcatttttttttcatttcaggtagaaaccaactgttgtccagaatcaacattgcttccttttaactacatagtcaagaataaagacatgggcttaatttcaaagttgagaggttgaactttgaactaccactacacctacggtgtccccttctctttttattgctcaaggagataaaacatccagttatagcagtatactaagcattggaatggacacaaaaaatcttctatggttttcacaggtttggaagaatagcacttagtacattcaaaagatatattaatgccattacttgcttctttttctttctataaatgctaaacaccaccaaattgcatataaacagtacaaaggaaggaaatttctaaaaccataagaaagagaatggcgtccatgtggtctaaagtttaagagaaacatatagtacatgaaaactggtcttgacgtttaaaatcaattccgagtgtcaagccgggagacaggaattaaaaattttccaatgggcgattgagcacaccagtttatcccttccttgatataaaccgtgaactcacttatgacgcaatggtctaagcaaagtgaaaggcacaaccatagcatttgtgtgaccacaatcttacttaccatg

SEQ ID NO: 64194 - DNA, 10239 bp, Oryza sativa
aatcaaaaatcgaaattgcatgattctccaataagagaagagatggattgtctcggcacgtacgaggagatcgaggcgggggcagttgcggcggagaagcgggtagaggtcgtggcgcacggcgacgcgcgcgagcttctcggtggagatgttggcggcgcggagcgtggagagcgggccggggccgagggtggggttggtgaggtagaggaagttggagaaggcgaggccgagcgccgagtccccgacgaactcgagccgctggtaggagacggcgtcgtcggcgaaggactggtgcgtgagcgcctcctccagcaggcgcccgtcgcggaactggtagcgcagcagccgctcgacgcgggccgccgcctccgcgcggtccgccacgaagcccggcgggggaagctccaccgggtccggcgccggcggcccgcgcttccgggaggcaggcttcatcgccggtggcggtgccatgccgtcgagcggtttagggtcttaggggttttgggacggcgtgaaatccggagaatttcaagtgctgatatataaaattttccgaaactgcgcagtttgctctcgggagattttcagatttttcgaaaatatttttgaaatttccaaaatgttattttgcctagtttctggaagtctccatgcggggaccgttcggattttctaaaaaacagtaataatgctgtgcaagacacgttttttactatgtactaatatctatatctatatctatatatattgttggcggtatggcatgacgccattcgaccaaacctgccaaaatcatgcgaagagtggggattcaagcccaagacgtcaaaattagttagggcgaagtccccccatagcgaagactatggaacaaggagaggcgaaggatgcagggcgaagagtatatgccgaagggagacgacttcgccatagcaagttcgccctcgcgaggaccgaagaagcctttccggcccatcaagcccaggggctattgggtcgacgatcgcccgacggcccatcaggggaccatgaaccacaattacactgtgtacccatgtaaatgtctctttctaagggcaaccatataaattctccctgtataaccaaaaccctagtagtaagaatctgtaatagtggctataaatagtcttgtagggtcatgtaatagggggatccgaagaaaaattctcaaattagtacagtttacttcttttccaaccactgttgagtaaccacgtctttcgacgaatgcggttgtcgtttcgacaacagctagcgccgaccgtggggatctccgagcgaaaccattgagagcgaatgctaccgaagaaggtcgtgaaggagaaggttacgaggcgaaaggaaagcgaagccagggagatatggccgccgaatagggagcagagccttcggcgcctgtcgccgaagatggaggagcgccatctgcttccgcacctacgccaccactactgccttcggcccctgccgcctctgcgcaggtgctgaacgcggctgacatggcgaaggcggctgcggcggcaagggcactccaaaccagagcagagatcctttcgacaagctaactgctggtgccctaagccgctccgtcgcagccggcagcggcctcaactgcgctcgccgcagtgcaagatcaagtcaatcctgaccccgaaacacaaaccgaaaccaacatggaagccatgcgacataacatgacacgactccaagacatgcttcgccaaatgcaagaacagcagcaagcatacaaggcggcaaggcggtccaaggtcacttcggccccaatcctacagtattcggcaggctatgtcccaccccaagtctatccacaagcaccgacctagccccttcctccaccagttgcacaagcgccaatgtacttcgccggacagccttcgaccgcagcagtgcatccggcccctcacgtgcaactgcaagctcaaccggtcgctacccaagtacatcctcaaccgcctggccaagtgccacaaacaatggcagaaggggcttcggctctgcaggcgcagctccaagctttccttcagcaacccagccaaccccacagcatttcaggtacagccccttcggcccacccggaggggaatacaagtcaaggtgcgcctagttggttgccgtcgaatcagccaggtctgggggcttcaccgtggagtcaaggaccgcagttcgacttcatcaatgcagctcaagcaccagccgttcggccgcaagcaccaacgccaggcttcggattaaaccaagcaccaaactaggtcgccatgacatggtcacaaccaacgttcgacccagccatggcagctcagctagcatcaccaatcggagccgggcagccgaatgccatggcccaacctcacgcgcaagccgtgatttcgcccttcgccacgccgtacccacagcaaggtgccgtgaacagggcagggggtgaaaaggggctaccctgagggcccctttgaatcgtaggaatgaaaaaacagaggaataggaaaaacacagaattctgataggaatacaattgtaaaacagagaattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggccctgagtgtgggaatcaagacccatccaatcccgccccagttcaagttcccgcccatcccatgctactcaagcgaaactaacccaaaggaattcctctccatttatgagtccgcgatcgaagcggctcacggcgacgaaaataccaagacaaagataatacatctcgctctagacggcatcgcccgttcttggtatttcaatttgccagccaattgcatttactcatgggagcaattgcgcgacgtctttgttcttaactttcgaggcacctatgaggagccaaagacgcagcaatatctactcggcattcaccagaggccgggggagtcgataagagagtacatgcttcgcttctcgcaagctcggtgccaagtgcaagacataaccgaggcgtctgtcataaacgtcgcttcggccgggctacttaagggcgaactcacaagaaaaatcgccaacaaggagacacagacgcttgagcatttacttcgcatcattgacgggtttgcaaggggcgaagacgattccaagcggcgccaagcaatacaagctgagtacgataaggcttccgtcgccgccgcccaagcccaagcacaatctcaggttgccgaaccaccttctctcgctgttcgccaaggggccgacatgttccgacccaacgaaaagcacacgaagtgacaatgcaaaaatagcgaaaaggaaataaaacgcacctttattgattttgaataaaaatgtatcgaagaatacaaacccgtcacaatggtacaagtgaaaagaaaagagcaatggcgttacagcctagcttacagataaattacatcttcgcccctgcgatcattctttctcactaaggaatgatcaggcgaactaggttcgtcatcgctactaatatcatacacaaccataagaggagaagggggcaaaacacagactagactgtaacgacgttgggagatcgcctcctgccgatcagtcttccgatagtttcgccaaaagcgagccatatcctccaaacgtcttgaatgaacaagatcttagtcttctaaggttcgcccggggtgcgcccacagccacccggcaaccttaaaaaccttatagctgcggccgtttatcaccatttcgcgataaacaggccgaaatgggcatcgcaccttcggcaaatccttcagtgccacaaatttctcgttttggcttcgccaactcccagaagggggccgaatgcacaactttcggcgaacaccttgacagacagtgcaaaaagggcaaaagacgattttcatagtaagaataggcgaaaaaaagagaaagtattgcataatgtgaaatgggcgtaatcataatacgccaaagacttcaaccacaaaaaaaaggtggctaaaagtgagtcgtacattccaaatatccaaggggccctttttcggctacaataaggggggttagcggtggcttgccgaatatacatcgttcgccactcccggcaaacacaaaagaagaagggaaactacaaaaatctaaggaaagggcagagagcctcacacctctgggtgatcctgggcatcgcctccacccgcttcagctgccgcgtcctcttcttcgcaccggtctgccgtctctgccttcgccagttgctccaaaaggcgcgccttggcagtggaccggccgtccttctgccagaactgttttcgccacgcgcgaagagcgggcgaaatgttctgcgcactgatctcccaatcccccttcgcatagttagggaactcgtcgacgtgctcgcagtcgaactgttgcataaggcccatggtaaaggccgccgatacgcgcgcacaacaatcaccgtacgcagtggcgcagtccgaaacagaaccaccagcctgttgggtccactcggagaagtcgaaggccgaggcatcttcgacagggatccctcgcacctttgcacccatgtcagtaagggcgaggcggagagtttggcacgccgttctcgcggattcggtggttttcgccatctcccgcaaaaaccgctgcgactcctccacagcgctcgcttcagccttgctgaccttcaggcgaagagcctccatcttcggctcagtgaggttataataatcggtcagcacggcggaatgagccttttctttctccagctcggccttgaggcgatcaacctcagccctcgcctcttttcctttctccaactcggattagagctgcttgttttcggctttcgcctctttcaaggtgttggcgagggcttccatctccaagttcttgcggcctattttgtcgtccttggcccgaagacggttcttaaatccgtcaagacaggcccgcaaggatctggatgcaagataggagcaggcggagagaccaaatgttagttatgggacatgaaaaaaaagaagaggaaaatcaagaagagagaaaaagcataccagaaccgccaagcttttaatagcagaacaccactcatcgaactcattcaattcggtgaataggctcagggtgctggcaggtaaggcaagattgcttactccctcgacaaagggaataaggtctgcccgggtctcgaaatcgctaggggcgaagtggggcgccgcaagggaatattccgaggtagaagttttgacggccgcacccttccccttcgcattgactagcggtgaaataactggctgacgtcgagggctaccgaagaccctcgccgcagctgtcacgatacgctctgcggaggctgaagccccggcggcggcgctaccgcctgccccatcagcgccgagtgaaagaatgggggtggtcgaaaggtccaggctgcggccagcgggcgaagtcggagtctcgtcagaggactcgtcgtcgctgaaaatgcgagcggcatcgacgagtcctttctttttggagatctttttgaccggacctcccttcgctgccttgcctgccgaaaacgcaactagcagcttcgccccctccaaatcctttcgacaaaggggggagctgttcgactccaccccggtctcgttgtgacctggacttggagtaagagtatagccaggggtgtcgacgcggttttcaacagcctcatccgcggccttttcggccatgacctccgcccctcttcttcctctccttcctcctcaccgtcacgctcttcgacatcgtcctcgtcatcggcgtcggaatcggaggaagcaggaacccttcgcttcctaggtgcaagcttcacttgtccgcgtgttcgctttctcgaaggccctgcatcgtcgtcggctttgtgggggttcgctcggggaggcaattcgccgttgtaaacccggttcgcccggccagctgcttgtcgtgtcagcaactggctatactcgacgactgacatgtcgccgatcatcctgcgggcttcggcgtcagcctggtcgagggtcaacactgcaaaaataaagggtgtagcttcattaagcgtcgaacaaaacaaaataacaaagcgcaggagtgcatagcgaaagagcagtcttaccgttcgttccctcagggataaccaactcagcaaaccgtcaacctcttcgccatgatcaactgcgacttgccatgactaggagaggggaaagatgcgaagcatgcagaattcctccaccaagtcgcgacagctaaggcgagagcaaaccttacgcagcagagcgaaccgcgcctccatagcgccgcccacggcgatcttgggttttcggttcggcgcaatcgccctgcgccggcaccggagggccttcactgagtcagaaccagccttgaaggggatggtgtggcaaaaccaccacgccatccaatggcggtcccacttcgacatggcggcgttcaccggtcagaggtcggaccgctcggtgcgaacattaaagttcacactcccaaacactgttttcttcgttccagccgggataatcaccgtctttgaattcacggtggtgaaaaatatggcaccgaagagttcggcactaggctcaaacccggaagtccggcacgcccagtcgaagatagcgatccggaccagcgccgacgggctcaactgtgggagctccacctagaaaaggcgaaggatctccggcaacaacgcgttgcacagaaactggagccccgcctcaaaaaacacggcgaacaccactgtccagttgtcgacaggcttcggcacaacagctttccccggggcgaaagcctgcccttcgactaacgccccaaagctaaccaactttgccaactcgccgtcgtctatgagtgaaatccctaagtaggcggtggtgtcgtcgtcaatccggccggggtcgggccctttcgccgaagaagggttaggcttgcggggagccatgacgaaggatatatgcagtgacgaaggatatatgcagtggcgaagggtgtgtgcagtggcgaacgaagggggcgagcgaagggtctaaagggccaaggggtgccataaaagcaagaacggaggaagagcgcgtgagcggtgaaagtgacaagtctggtggtgaaaagggaacggggggagaatatatagaccacccaggcgacgtttcgcctacccacaagtaataaagcgccacgtgtcgcgagggtaggcgaaacggtagattcccatcgaccgagttgcacagtaaaaagcccacaaagggagggcccattactattcctttcggcccgggaaaaataaaaataatataccaccgtccgcaggaggcgaagagcggcaaaacaataccagccgcacagacaacaaactctatttgcaggaacaatgtagatttcggcaggagcatcggtcgaaagggggcgccacataccataccacatgatttgcacggtctcggccgaagctccaatctcacccttgcccatgaggggcttgttggcggtatggcatgacgcccttcgaccaaacctgccgaaaccatgcgaaaagtggggattcaagcccgagacgtcaaggttagtcagggcgaagtccccccaaagcgaagactatggaacaaggagaggcgaaggatgcagggcgaagagtatatgccgaagggagacgacttcgccatagcaagttcgccctcgcgaggaccgaagaagcctttccggcccatcaagcccaggggctattaggccgacgatcgcccgatggcccatcaggggcccatgaaccacaattacactgtgtacccatgtaaatgtccctttctaagggcaaccatgtaaattcccccgtataaccaaaaccctagtagtaagaatctgtaatggcggctataaatagtctcatagggtcatgtaatagggggatcggaagaaatattctcaaattagtacactttacttcttttccaaccactgttgagtgaccacgtctttcgacgaatgtggttgtcgtttcgacaatatatatatatatatatacatatgtatatatatatatatacatatgtatacatatgtatatatatatatatacttatatatatatatatatatatatatatatatatatatatatatatatatatgtatatatatatatatatatgtatatatatatatatatatgtatatatatatatatgtatatatatatatatatatatatatatatatatgtatatatatttatgtatatatgtatatatatgtatatatgtatatatatgtatgtatatatatatatatatatatatatatctttatctttatctctactacttaaaaaataagagatgtttccatcgtccgtcaaaaaaaccagacgaaaaaaaccgagtgaaaaaaaccggaataagaaaagaaaaaacaaacataaaaaaacgcaaaaaaacaaatatgtctgataaaaaaacccaggcaaaaaaaactcttaaaaaataagaggtgtttccatcgtccatcaaaaaaaccggacgaaaaaaagggaaaaagaaaagaaaaaccaaaagataaaaaaacaggcaaaaaaaagaaaaaaagaaatatgtccgataataaaacccgggccaaaaaaaaccagaaaaagaaaagaaaaaccaaatctgtccgatccaaaaaaaaaaggcgaaaataagggaaaagaaaaatgaatccgactccgtcaacgcggtaaaaaaaaggcaaaaaaaaattaaaaaaaaatctctccgattctctatctctatctctatctctatctctttttttaaaaaaaaatagatgcttccttcatccgtaaaaaaagatagcgaaaaaaataaaataaaaaagtccaactcatatatccgattccctcttacaaacaaaaaaaaaagtccaactctagattggtgaaaaaaattgatgcgccggattgaagatctgtttgcaaaaacagaacctccaggtcgacgagagcattccatttttatatgtttttaatttttgagtttgtacttttgcatttgagtccctgtaatttttatatttacatttgagtccctaaaatcttgcaataaggtatttgaggttgtttttgttaaaaaaataatataagagagagaacaaaggcagaaaggtgcataaaaagaaaaagaaaagccgcacaaaaaagaaaataaagaaaaacaacaacaacaaaagtctttttcccctaagtggtgaaaaaaaatgtagatccgaacggaaaaaaaaatctgattcatataaaaggcaaaaaaaaagtgatgaaaaaaaaaggctagatccgattcctttaaaaacggaaaaaaagtctgattcctataaaggcgaaaaaaatctgaaaaaacatctaaaaaagttcgtccgattccttaagaaagtggtgaaacaaaatccgatttctaactgtcgacgtttgatgtcgcgattccggtatttgcatagtatggggatcactggtactaggatatatgtgagactgaggtaaaagagacggaggcgaggatttttataccctacatcctgttggccgaaaccggtcgttgctcttattcatcataatcacaccagtacaatatttggggtagcctatctaactgttgtcgacatgacggttcgaaggtctgactcgtagtcgacagcagggtagccttcctcctcgaatgtgtgcccggcgagatcaaagataacgctttcgtctctcctgacagtatccggagacaccgtaggggactagccatgcttatccctgaagtcgatatccgacggcttgtcttggcgtatattggcttgtatgttgatcttctgtcttgatctattgttccgtatcttctatggttgtggtgggtgtgtcccctttcctcctagggggccttgtatttatactcataggtatccccttgtccaagtagaactagggaaaccaatatggatagaatccgagtagtccttgtcgtttcatgtagaactctagttgtctttc

SEQ ID NO: 64195 - DNA, 11750 bp, Oryza sativa
tacatacatacactttagtcaatattatctactatataattatatagccaataaccccttacgtgatacttaggcactgagaacccgctgttcccagatgtcgctctactacatacccggacatggaggacttaagtactcttaagggctgtcaccacctctatatccacctcaaacataatgtgggatacgcaacaattactgaatattaattacctaaacaccacgtctaatcaattaataataactattatagtatttataactcactaaagtaatcactatattttagttgattatagtgaacaataatcgcgtatgctgattaggaactaaccaagaggtaattctcacaagtaaatctaaattactcagaaagatatttctattgaaaacagagtaattaacagaataaaagaaatatgacataattaccgacaactatggaattcctccgacttcttctactctactctcttcatctcttcatatttctagtatacaaagtggtacaatatagcctcttataattcagctcaagcttggaagtgtgtgttgagagtgaaggagtggagctcttaaataggcaggtaatgatggttgtggaacgggaaatgtccgaagtgccctccaaccgccatcaggaatgcatctgggatgtccatgccaaaccacaggatcaacggtggagatcctggttcggccaaacctgggctagcccacttggcccccagctttggccggtggtctcctcctgttctgccacatctaattctatgagttttgggctgattttttgggagtttaagagcccattcttgaatggatggattccctcttcactttaatctgaatttcctcccaacttcggtggtctatgacctgcatcaaataaacaccaacatttgtagaatattttaaaaataaaccctatcactatgttggttgttttattatctaagttttatgtagatgttggcggtataaaatttgcatttaacagctgccaacaaaacccccacacttagctctttactcatccctaagtaaaggttaagaataaggctccgtttgacagcggcagttcggaacctggggttggggtagggaaccagtggcactgttcatataccgtagcacatactgtagattgatgtgaggacgcacgcacgtgacggcaccgtttcgaccactgacaatttctgtcaaacgcatcgtgagacattgccgtcgtgaggagtcctgctcggactctgagatgggaaaaaaaatcagcttgtgcaagccgtcatgtggcagtagtttagggtgatattttgttacacgttttgaagaaaaaaacatatgagcagtaatattggaaaattaaaatagagcatcagcttgtgcaaggcttttttaacgttcgtcgatctggtaaataaattgaaaaatatttggtgattatatttgactacattttttacatctttccactatgcttatttattttatatggcacgtgtaagcatgtttattaaatttgtacaaggcacatgtatttcatttttattgtgaaccgggaattattatagttcaaccgggtaactctttttgtatttgaatggccacatatttcttttagttgttcaatttaattaattcattccggacacatgccaaatcgctttcaacatattccgataacacgtgggaaaaaacatagcacataatggagatgactcagttgaaacatgattgtacataaacagataacgataaaagaaatacaaacactctaatttaataaataacagatactggtctgaatggagatgacatgcgcggctcatatcacctaccgatagtgattgtagacagcatcagcaatgcagtcacgcaatgcgctcatagcttgctcgctatttgttgcgtagtacatatgaatgaagtatggatgctcctgtacaatgggattaccgttgtacagaggatgattatgccggtagttcacatcgcgactatccttcttgaaattgtgtaaagcaaaagctgcttgtatgatgcgtgtgtgaactagatcgtcgtcgttttgtggtatttctttgaggattttccattgttttttaatgatcccaaatgttgtttcaataatacttcacaatgaggagtgtcgatggttaaatgtctcttcctgtccaactggttgcggtgcacggactccaccaagaacatccctgtggtaccgtacatgtgggtacggtgtcaaaaaacccattctactaggaaatccatagtccgcaagtaaatactttcctgcaaaacatatgataaacatgatcgcataaatgctcaattattaggagtggaaataaatgctctcttatttcaaaattttggatactcactttgcgataacctggggaaattgtctagataatattgtattgcttgattcaaaaccctttgatcgtgcactgagcctggccatccagcatcaaggaacataactcgaccgtcgtgatcacatacaactagaacatttctcgtcgtcaagtggtgtcggttcctgttgtcgatagatgtggctactgatgccacgatggacacatgcgtgccatccacagcaccaactgactcatagaatggtcagaatttgttcccttcaagcagcctaggatgagtgtacgtgaagttgggatcaacaggcttcaatatattcctagacaacgcgtgcatagtgttcaacactcggttaaaatagagcgagactgttgagctcgagcggacccaccggttgttggtgtctctgtttggacgatttcctgccatatatacaagaacatcccaagtgcctcaataccacatacctcccatgatccgtgaaggtggtatttactactcaggagatcatgtaaactatgtatctgctcagccttcaatcggaacatggccttgcattgcctcggattcgccatcgtctccagcatccaactaataccagtctgaaccggaactcgtcgtgcagctctctgattgagctcaagactgcaggctagcacgttgattatggcatcatcctcctcgctccaatcttgctctcctgtgccgtgtgaattccaatcatcgttactcatcgccgttggccttattatcaacagcaaagattacaatacattgaagcatgcacaaatattatattaaatcaaacatatttaattacctagaaaattgtatttaattcatacaaagttaatagtagcacatactcacgtgcactcactacttacgaaatggtagcatgcaaagttgaacttactgaacacatgcttatttaaagtaaacactcaacatgcaacattattacactcaacacattgaaattaaatgtccactgccatgagcactacatgccacacctaacgaaccaagtcctggagcactagaaccagcaccaccatgccaacctccaaacccagttgtgccctgtgaccatggtaccgctggcaacgattgggccatcatcaagatgtacacagaacgagcttcagcggtcgggagtttcatgaagcacgagcagtagtgcggataggtgaacactcgaaccgcagcgtgccaaaccggtccgggaacagggtgaccatcagcttccaccaactccatgcaagcctctgaacctttagacttcgcctcaaccttcgccctagccaggcgctccatcgactccatccatagtgatacaagcctttcaagggcttccccggcggagttgccgcgggacttctttgaacacccctctgaggcagcagtagaagtggcagccctttttcccttacccctcactgcactcgctggtgcggacggaggtggcaatggtggactgtacgctgctgtgagctgagcaatgtcaatggtttctcactgctgttgatcctgtgtaggggctggtactgctccggcgacatcggagtggttcccaacaacagtgcatcctttaaaaaccgcgtggtaagaatcaatgtattttagaggatcatttctaaagcaggcaacgcctttatacacctgccaaaattaatcaagtatgggctgtacattagaggtgttccgaaacatattaccaaaaaataaaaggcaaagtaaagtatatgttgtgatgcatttgtaaaatcagtaatcagtattcaaaataaaacaagaaaattaaattgaactattggcacagtcgttgtgatgctccaatctttgtgtgtgataatggtggatctgctctaatggtcatcttgatgacataagtaatctgaacaaaaactaatcttctacttatcgtatagacacataaatttatatcgtactagttgcacatactgttgtgaagccaaaactagtaataggattcattgtttactgaatctgagatgctcttgttcatattctaatggatgcaaatgcaaaacacaagaaaccaattatgctagcgcttactacaacctaatgacataaggaatacaactagttttcacccaggcttacttaatctgacatgatactaaggtaccagcaaagggaatcttttcacccaggtttttaaaacaagtgccattcagaatccatcaatttagcactactaatatttagctctggttatccattgcttgaaaatttatgtgtcactttctatcttatacaaggataactatcaactatgaatcacagaacatgacgctggccttgatcctttctaccaaattgcttgattggtttctggattggtttaacatacatagataaagccctcttctaatatttcataactgctgcagttcataaaaaatggaactattggcacacatatgtgttggcattagtatgaattacggagaagttatgctatttgttgcattatgaaaaaatgttcaagaagtcacatactacgttttttgatttccaccagtaggcgtcggcaacaatggccgatgttaccggatcacgaccgaggccagtagcctgtccttccagccacacccacatgttcaaccgcttgcgacactcgccccaaaaatacttaacttgatccccggttacccctttgcggcacttctcatacattttcttggccaagttgtcgtaagcctaggccttgggggtgttgaaggtgatggcgtaagcttgaatctcctccaagcagctttaaggaacacgcgtgtctccaaatcggtctagcgggatcgggggacagacatctaccaatcgaaggaaatgaaaattgatgcaacaaaaacataagcaacaagctagcattaccttggtggaatcaccgtcgcggacgatgtcccaattcagcgaacgaacggcggttgcagggctcactcggcaaacgaaatcgatgaccgcttctggagatttggcgcacaccatggttagggcattggcagcatttaggacatcgtcgtcgcaaccttggcggtgctggcgttggaggtgttggagtcgcaagaatcctcacccgactccagcttgtgtgcccggatacagggtgggaggtgtatccaaggggattgaacacgagccggagaggatgggatggccaacagctcgcgctctcgcttccgcttcttcccccttgtctccatcggcgcacccacaggctcggcctcaaatagagggcagctgagcacaccaccagctttgcctccttcttgcaacgaatctcgccacttctgtgccacacgggatgtacgaccacgcgcgccaaggacgatgcgtgcagcgagcacgccggccagcttgtaccatcttggaggatgacgcgacagatcaagagcactatgcactgctccgatgcagctcgaccgaatcgaaggaggacacgacgcttccggcagctttaggcatgcagctacttggaagagtacccgctctagccctagggaagattcgtttgggggcaggaggggttgcaggcgaggggaatcgattcctgccgccttggattcctctgctcacctcgacgaccgccgattcagggggaggaagaaaggggatcgaagggagtcgagagactggttgggggtggcgttctctcggatgaaaaacgcgaggtagggggtgatggatattgacggaaatcgtgggcctccaaaacggcaacgtgggaaacagttttcggtcgaaacagtgccgtcacgtgcatgcgtcctcacgtcaatctacagtacatgaacagtgccactagttcccaaccccaaccccaggttcccaactgccgctgttgaacggagcctaactgtagaatgaaatcttccaagatataattcgagcacataaattattcaaaactatacctgtacctgtgaactttagcaatggctaacttaccatcttgggtaattgataaatggaactgtcttgattcctgtccttcttactccttctatcagactcctggggtttttataaatttttgcaatagcacaaagatttaactcatctagttaaatcttgggtaatcggtagagttccccaagtcctcaatagtagtaggtgcacaaagatttaaaacattaagaacagctcgacggtgctattgggaagaagaggcgcgaggagtgcaagatggttgggccgggccggcagggtggtcgaaccgacggtagaccatagagcttggacatttagcagtggtggagccagcggcatccttaagcccgggcgactaataatgttttccgataatcgattatttttataggtgtcgatggctattggtagtggagacggcaacgatggagcctgggcggtcgcctgacctgcccaggtggttcaacagacggatggttattgcaggaacttgtggatgggtccaagagaaggacaagaaggttctacggtttggatagttcacaaatgtgaagggcgagtagactggtgacgacaggttagccaggtcgcttataaaattatctggcggagacatgatatatcagggacttgacgaggagttgagatatatgaagttagaccagaactgaagaaatgatcctggaccacagtgggggaaatcgttgagggtgtcaagaatttgcaaggtctgcatgatggggatatatagaatctgcgtcactgaagaggaagagcaagcgctatggtggtgttactgtgaaaacacgacagcttgggagatctgcttaactccagtataagtccaaggcttgcctcgagttctaatagcgtgccagctagtttgatcatgcaatcagcaaggaaacaacaagcaggattagtcagccgatagccgatcggccaaaaggccgatagcgtatatttagtagtcttagctgatggagttagactgaattggctatgggctggatagatcagagaatataaaaccttaaatatgccctatcggctgtaatactgtctagcaagattaataaaggaatttaagacaatattatgaaaagagctgatataacaatattcaaagcataaaagataatgtccagctaatactcttgtacagatctatataggcaaatcaatctataataatatatcaagtagagatcaatagtcaatattgatagcccagccgatatgacctaaacttgagatattactattaagtgatccgtctatatagatggcaaatatacatggaacagataaggaaacatgcatattaggtaagttcggctgaaaccccgatattgcccatattattagtcaaaataggctagatattatggttctaaacacgacttagtaagttgaatgtacttatgcaacactaagtatgaaaaaaacacaatatctagacaatcaagccgttgactaacttttcagggtggtggatgtctaaactaatctaatctagcaagaggatttagccgatgccggtagaaaccataaagggagaagcaaccgatagagctaaatcgatatgctgagactagattaacagaatgatagcaattgtcatgaaacaaggactaaaatatctaaaatgacataatagccccgatagcacaagctatcgagacgggttacctctgcaaagagaactcaccgaaaaaacaagtaaaagaaaagggtggcgatacgccgaaattaaattggagttcgtcctctattacaatgctatgggattcatatttataccctgagtacaaacttagtccattatggacacgactcaaaccttcctaaagctaagatatgaacaagaccatatacagcggtctcttaccaaaactatcaaaaccgacatattaatatataccattgccttaattgagctttatctctgattggcaatgacggttagtccaatctaggcccatgccgatcccaaataataccatatcggctgcatcggccatcagccttatcaaccctgatcatcatcaacttatgtattccagccgatacgatctccaaccgatgcgcgaatccgactctgagtccaattcgattcaacaccaaatttgtttcaatcttcttccttcttctccgtatctgatgccaaattccgctgttaacaggtggtaacttctttaggtgattcaagacaacagtgattttttcaaagtatcatggggttcagtcaacagatgcgaaaagcgtggatgttggatttattagctcggttcataagatgataaggaagaaagggttctcttcatgtctgatgagtttgatttgttatttggtaatgacgcgagttatctggccatgaattagataaaatcaaatttaagacaagagatgaaggtgaacatggttttcgaggagtctgtgatacgacagctaaggaggagttcaatttcgcttggtaagacgactatgaagataggagcgaaggtggagcattgttacaggtggagtccagaggaagaagttacatggatgaagttacatggataacagagtctctgatgagatggtgagtctggtgtaggctcgtcgggcggcttgtggtgaagctgcaaaagaagacaacccaagtctgaaggacaagtggatcggtaaggtgattctattacttctgggtggcgtatattcgccaaggtggagtttgttagaataggtgtcgaatatactagttctatttggttacagttgaacttagagttgtaataggtgataagggggtggagttagagtcggactctgtaacccggcaactcttttaaatagagagggggcaccacaatgtaactatagcgactacaatgtagcatagacacgcaaggagatgatcacaacgaggccatggactcagtagcggccaggagctatatattggttagagaggaacgcccataatcagagccccatggatataggcttcagctgaaccttgttaataaatatcgtgtgttcctatgtcgtcatctggcatatcttgggtgattaatgactgaagagatcaagaagtttaatcatcgttccggttccgctatatcgactagctttttaacagactcgaagtatcaaatgtttaggtcaagacttttaatattgtgcaggacaagtctaggtcgttttgcagtgcacaatttaattggcctgagttaggccatgtgtaattcagcgtagtagtcagttttgttcagaagctcatcattttggctgaagtttcctcctctttaatgagagaggggccagccatggtagaccgtcggacaatataaataaatcaactctttgttagagttcaaactttatctaaaataaataaacttaccttcttattgcccttcatccaataatcgagaaattttatcaacttaataatctatccaccaactaatactatttttctattaatatgagatattttagtcatttcaactcaactaaatatgcattagtacgttagtacttacgagttgattttttacgtgacaggaagtggtacaccctatggcacaacattgtgggtatcctcccgcatgtatagctgggccgcacatgctcttctgcctgggccatggatgtggacctgcatgtagctaggccatgggtgtgtggacctttgcccccgctaccgctagcatgacaaatttaaaacgagtgtactcactgtcgtatgctatctgtatcactgtaataaaacgagtaaaattatcaaagttttatcttagatcatctttcgaactagttaattttactctcttatactttggaccaactcaattcccttatctatccatatctagccacttcttcgataatgatatggctttgggcatggttgagggagtttaccttgtttggtttttactttgttgaggatactttattctattatcttaaaaaatggtcgagggagttcatcaacgcaatggaccacttaagaggtctacatgggaaaaaatcgatttttctatatgggcgtcttatgtagccgtatgcgaaaatacctcttgattttttccagacgtgacaagtcatggtccttttgcaacctatcgagggtctcgctcacaaaaatcgtttcggtttgtcaagtcattagagttccaataccattggcattgagctctatactgaactaaaacaaagcgtaggccttttataacaacatggaacgtataagttcaactccccaatctgcatctttttttagttttttttcccaatgattgcttactcttttttgttcctttcaaaattgtcatgtcatgtttgttaatttgttttattttagatttgaaaaaaggtgaaacgaagaataatatattatttaaaatttgtgttcttttcatattaaaagatgtatattatgtgctcttttaaaattttcatcaaggaaagaagcatattaaaaatgtgacatctttaaagggttttttccctcgtgactacttactctctcctttttcttcacaaaagcacgtaccttgtttgtaataatttgttttcttttcaatttgataaaataaactgaaaatgaaagtatgttatatgttttttggtcaaaattatgttcttttcgtatcaaaagaagtatattatatatgaaaaaaaagtatattgtatttttcatctgaaaagaacataaaaatacgaaaaacacatatattatacttcttttcacatcttttccaaattcaaaaaagaaacaattttacaaacaagacatgtcaataaaaggtatcagcagagtaagtagtcaagagagagagaaacggtgcattttttgaaaaaactttctatagaaaagttattttaaaaaatcatattaatctatttttcaagtttaaaataattaatacttaattaatcacgtttgcatattgcgtatcttctcaatcttctctattctcctcttctcaaacacaaaatgatgcaatgactaggacttgaacccaacactcagactcaggatgtgttgggttcaaactgtgacaagtcctacactcaggttgattaaacttgtataatctttgacatggcaaactgtcacaaggtgtggccggtaaatgacttgtggtttttgaatctcctaaagatgaaagatgaagataaagattaagtgtttcacacaaaatgaggtggtaataacgtgtgattaatctgatattttaataattacaaacttgaaaaatggattaatctgatattttagaataacttttatatagaaagttttcgcacgaaacgcaccatttaacagtttgaaaagcgtaccacgagtatcttaaaagtttatctaacttttgttggaaaaaagaacagggccttagtagtaaatgcatacg

SEQ ID NO: 64196 - DNA, 5485 bp, Oryza sativa
ccggccggcgccttggcaagacctaaggtgcagcctgaaatgtctctatatatgtacctcactcctcaggaatgggtattatatttgcatacacgcactcggcacttttagttggagatggagaaggtgccagcaaccaagagagaggcgaaactgtgcgtggtacttgccgcgttgctgctgctgctgggcgcccccggcgtagcaacggcagatgctgtagccacatcggggagtggccgtggcggctgcacgcggagcagcggcaacatcagcatcgagtacccgttcggcatggagcccggctgctactacgtggtcggcttcaacctcacctgcgacactcgtaccacccacccaggctgttcctcggtgggtgctcgatatctccatccccaatggaacagtgcgcatcaacagcatcagaatgaggcgcctcgagaataatggccgtggcgcgaatcggacatggggtggcggcctcccaaaggcgggccattcttcctgtcggagtcggagagcagcctagtgttgatgggttgcgactcccaggtccttgtccgggagctgggaggggacaacacattggttgcctcttgtagtgccatctgcctattgtcatggccctcacaacaggaggacgcttcttaggaatttcagggaaaggtgcatgctcgagcattggttgttgtcaaataaacatcgttttaggctactcgtcctatctcatccagattcacgggatggatcaattggggatggatctgcttgcggatatctacatggtcgaccaaggattcaactatactaccgatacattctattctaattccaccgagtatcctcctcgagcattgccagccttgctgaagtgggtaatcattactctgacaagtaattgtcctagaaatttatctgccccaagtgtcgcagtgcccatagctcttgccaagacacggatgctaaggcacgggggtatcgatgcgagtgctcttatggttatcaaggcaatccatacatcatgtatgatggatgcataggtatttacattgtatatgttatgaacataggtccttaattaaactttgcattcacatggatcattgatttatataagaatcatattgaaaatcatgtgcagtcaaccatcaagtgattttatttttcatacatacttttacacaaatgaactatcagatttataggccttgtttagtttccaattttttttcaaaaacgtcacattgaatctttagacacatgcatagagcattattaaatatagatgaaaaagaaactaattgcacagttatgatggaaattacgagacgaatcttttgagcctaattagtccatgattagccataagtgctacagtaacctacatgtgctaatgacagattaattaggctcaaaagattcatctcgcggtttccagacgagttatgaaattatttttttcattcgtgtctgaaaaccctttctgacatccaatcaaacatccgatgtgacacccaaaaattttcttttcgcgaactaaacaaggccacaattaccaacatacaaaagaaatttctagaagtgaccgatgatgccagaagtggtcccatatacgtggatattttttaaaaaagggtaaattttgggcatttccttacatattttcttcaaagtatggttctatgatcgttttgcaaagatacctatagttctaatcacaattatattttccatcctagacttcttcattatctaaaaagaagatttttcccctctactgaccattacaattttgcatgtctagatatcgatgagtgtaattctcccaatatatagccatgtttcggcgaatgcaataacacacaaggaggatataactattggtgcctagatggcttaaagagcaacgctactcagccaaaaggatgcgatggtatgtagataattatatgagtgtttcaacttaacgacatgtataacaaaacaagtacttgcttagattgatacataatcgactatactagctaatcggtaaccctaatatattcgcacaaacaatttattttacatacttttgcacccacttttatttaaaagttttataaatttgttttaagcactcaagaacaaaacaatttaatttattaatagttcaaaaaaattaaaatttatatttttaaaattttatatataatccacactaccagagaaccgcacaactagataatttatcccttgatttctcaacattgttttagatctccttcctaggtgtgtaccttcaggtgtaagttttattgtttgtgtagacattgatgagtgtgcggtaacatgtagccacatcaaggagtggccgtggcggctgcatgaggagttgcggcaacatcagcatcgagtacccgttcggcgtggagcccggctgctaccatgcagtcggtttcaacctgacctgcaaccactcgtaccagctgcccaggctgttcctcgacgatggcacggtgcaggtgctcaacatctccatccccaatggaaccgtgcgaatcaacagcggccgaatcaatctcgaggacaatggccttggaagcacaaacgggacatgggggcggtggccccccaattggcgggccgttctttctgtcggagtcggagagcagactggtgttgatgggctgcaactcctaggtcgttgtctgggagctaagaggaaactaattggttgcctcttgcagtgtcatctgcccatcattgccctcacaaggacgcttcttaggaattttcaggacaagtgcgtgctcgggcattgcttgttgtcaaacaaacatcattttaggcaaaaatacacttgggtcatttcattgtcaatgtcaagatggagcaaatggggatccctttaaaaaggggatgcatcacatccaagaattctttgacatgtgacaattcactcaagagcagatatcttaccatatttatgtatttgtgtctttgcatggttatacagactcagtatatatacgagtctatggtagtttgatcatcattccaaaatttatagcttaggtctttcttagtctaacatatctcaaaactttatccaatagatttgtctcttcatggatcttccttttcagggttaagcatagctctaataatttctggtggatcaattgttcttattctggtatacttgctactcccctagtagcacggtcaagcaacgcagggttaaaaaactgaaagagaagttctttaagcaaaatcatggattgctattgcagcagctaatatcaaaaaacacaaattttggtgagcgaatgataattaccttagaggagctccagaaggccacaaacaattttgatagatctcgtcaggtcggagatggagggcatggagtcatgtttaaggggattctggacctaaacgttgtggccataaaaaaaatcaaagattatagttcaaagagaaatcggagaattcataaatgaagtcgcaatactttctcaaatcaaccatagaaacgtggtgaagctcctagggtgttgccttgagatagaagtcccattgttggtttatgaattcatttcacatgggaccctttaacatcatcttcatatcgatggtccaatctcactgtcatgggatgatcgattaagaatttcacttgaggttgctagagctttgtcctatctacactcagcttcttcaatgccaatttatcagagatattaagtcctccaatctacttcttgatgatagtttaacagcaaaggtatcggattttggggaatagatcgatctgaaataactacagttgttcagggaacaattggttgcttagatcccatgtactattatactggctgattaactgacaagaacgatgtttttagttttggagttcttcttgtggagttgcttactcaaaagaaacctgttgctgatacatttgatggagatagccttgtttcacattttgtttcactgttattagagggaaaccttattgacataataaatcctcaagtcaaggaggaggaaggtggagaagtccatgaagtagctgcactagcggcactgtgtactaaattgaaaggagaagagtggccttcaacgagagaagtacagatggcactggaaaacatattatcaaaaaagggccccttccataagggaaatagggaatcaagtagacccagtaaaaattaaatatcagctctctacatgtcaattgaaggagttgccacagaagcaagtagacaatctatggaagaggaaatgctattgtttcctcgataattatgctctggcttcagctaggacactagcaagcttgcaattgacccaataacttatgtactgacgtatatttctcttgttctgttataagtaattcctaagatattttgctttgagacaataatgcataagaaaattgcaagtcataactcaagaaattgcaatcggtttgggcttattgagtttgctttacataaccgactacttagcttcgtcctgtttcgttatctaattaatgtgattgatttactgaatcatggtgttgagggatattaggaattacagctgagcattacagtgtcactgttctaatgcaataatgcaactgcattgttctctccagtcatggacctcatggttgtgtatagtcacggatggtgactctaaaatgtagccgtcttaaatcgggaacgctaaaatgtaggtatccacaaccgcaatctgcacatataggaaagaaatgcagcttgacggtatattaaccacccgcccatcttcctctgaacatagagcgaattgagaggggaaaccaacacaagaaacaaccttagttgattcaagaatcatataacaacccaaactcaatacaaaaatgtagtatttaaaaaacaaaatggaggaagagttggcaggaaccttctgtccgagagggttctctaagaatggctgtcatttcgaccatccccttcttctatccctctcgcatactgaaattttgcaagagaacttttaaaatctctaagaaaacttcagttgcatgaaacattaacagaccaaacaagaatggaatatatgggaagcatggcaatcaaattacacattgaaaacctgtgtgatctgaccagtttttattccctctttgatcggcttggcctaaggccctgttcaatctctcgtgttggagatggatttttgttgcacgcaaaacgagaaacctcaaacctcattagcacatgatcaattaagtattaactattataaatttgaaaaattgatttatttgcttttttaaaaaaaacaacttttatatagaaacttttttgaaaagaacacaccatttaacaatttgaaaagcgtgctaacggaaaacgaagaagttgaagaatagaacagaaccaccccccccccccaaaaaaaaaaaaaagaaagaacaacacttgtgtatgcagcaaccagtatgcttccgcaa

SEQ ID NO: 64197 - DNA, 1177 bp, Oryza sativa
tctttttacctccagaagtccaataattaattggtataatatcacacattactaatcgtataatattatagcatatagaacacaaaattggccataactttataaattgatagaattgatcataagtccaaattctttaacatatataagtactaattgttcgacatatgtttttggcaacatataaaacatgtaaaggatagaaaatggtaaaatgattaaaaaaatcttaaaatttagaggagaacttttcgatgcttgatattttaaaaatgagtgatgatgtcctcatcctttaacttgtaaaaagaattctcttccaatgaatgtagattgttgctcatcttgcctcttgtttttatatagttcatcgaagaaaacaccctctctaaattctctaaattcctaacagcagctcatatatataaatttaacactctgaaaattaaatattatggttctaagtatctaaattcctaatatttacagctttatactatcaatctgtcaataaatatagacttctgaaaaataaagaagataggaactaaggaagttgaatccttcggtgctagtgaactattgaactggagtactaaagaacaaatcaataaatcaagccgtcgccgccagaaaacataactactattgaactacctaggacaaatcaatgcaatgaatcaagctgtggtcgttcggccgccgcatcgcgtacctgtgtggtggcctggcggactggcggcctgcacgccggcgacgcgccgacgcctgacggcccgagccccgacgccgcacgccgcagccgccgacgagcacgctgcagactggactgcagtcgccgccgcacgcccgacgcgccgcctacccgcctcggcgccggcagccgccgacgcaaccgctgcagtcgccgccgccgcactgccgcacgccaccgccgccgcaccgcgcacgtctatcctgcggaacccgaagaaccctagcgccgccggccgccgacgacgagcgcgaagtgggagagtgtgttactgccgctacgcatcgaagcaagcggccgaggggatattgcgatgggacgcatgtgggccttctgctgttgttagacaccaagcccaccaaatttacagcccggaattatgttcgaggttggaaaggcccaatacacaacaatactatagtt

SEQ ID NO: 64198 - DNA, 706 bp, Oryza sativa
ttcctgcagccctaagttgtatggtgtgtctttcagggagaagagatacaatttgcactcttgatgaatcatctaaagactagaaataattgagacgatgtgacttaagggagaattagtattaactacaattagtggtaatgacgtttttctttaaaatgtggacttttttcatatggacttgggtgggtatgctagctgtgatgtccattatgaaattgtgttgaacagtagaattttatgatattatgggagtacgactttgaaagagcgtagaagcattactaagggcctgtttagttcgagaaaagaaaaatttagagtgtcacattggatgtttgaccggatgtcggaagggcttttcggacacgaatgaaaaaaaaatattttcataactcgtctggaaaccgcgagacggatcttttgagcctaattaatccgtcattagcacatgtgggttactatagcactttatggctaatcatggactaattatgctcaaaagatttgtctcgcgatttcatccctaactgtgcaattagttttttcatttatctatatttaatgttttgtgcatgtgtccaaagattcgatgtgatgtttttgagaaaaaattttggggaactaaacggggcctaacaaacatcgacgtaactttctggtggaacacagtgctttagtacatatatattgtactttcttaccc

SEQ ID NO: 64199 - DNA, 706 bp, Oryza sativa
ttcctgcagccctgcctaagtagacatgccatgaagatgaaacttatcagagtgtgagacgtgatattcttgcaatggaattacatcatgagtgcttccatctggcatggcctggacttttggtgagaattcaacaatgtattcgcagatggagaggaggcagtccatctccctgttccacatcgccttcttctcaggaggcagtggctgcaacctgtggcaggttccaaacacagttgctgcagccaagaacaagcacagaggtcaacccactgttgcctgcatcaaagaccaacttaacagaagattcatctgcaattctcagaactaccatatagattggtgatggcattggagatggccacagccgtgcagacacccttcccactcccagacatgtcctctccaagaagcagcttggtgtacttctccttcatcagctccatctctgaacaacacccatcaatcaaccaccagaaacaccagaggacactaccagaaatcaaaacaggttggcatatctataccttcatcctccagggacttctcgttcacaacttgctgcagcttcttcatgctgagcttgctcaccgatggcgagaggcgtggtgccgtggacgtcgtgcggctcatgcttctccctcgtggcggcgatggcgtatagtgctcctgctcctcgccaccgccattgtcggagaacgacgac

SEQ ID NO: 64200 - DNA, 4730 bp, Oryza sativa
ttcctgcagcccgtgactgaaaagtgacaacaccatatatttttcatctaccatataactacactggttttttttattacaattggtcaatattctaataatgacttccacacttcagctcttccaagggcttgcgtaagtcctaagcacttcgaagaatagaagcacctccaatttcaacaatgagcggtgttcattatctgcttgcatgttcaaaacaattgatagggacacaagtaaatgctgcttacattattagaaagttacatatagagtcacagcaatgcatttctgtaagtaattgtttggaacaaaatcagataacaactatgagctggaattacgccatacaattcaatttcaagtagatgcacaaattgctgatgctctctttttacattattaaatgcagaacaaagctggcttaacaaacatagataggaaaataatacataccgcaaaacctttgccctttgtgattccagtaacatccacaaattgtccgggcacaaaatggcgaactgtgattgttgttccaagaggaataagtgcatcttcagtaacaggaaactcccttagttttctctttagagggactccttgtgctctgaagtggcccacttcaggttttgttagatgtttttccttcttttggcctgctccaagctgataaataccaggaaaagagttccagaagttaggaacagatcttgcaaaatggaaggcaatggaccaaagttaacgatcaataactctagagatttaccaacaagtttacgtttgggccaataaaataaagtctaagagcacacgtttattacgttatgtatctgaactattcacggtggagaagagtcatctacaggtaaagcaaatacaagacatgtactccttgatgccaaaatcccagaaccaggtgcctgatctataaataagttgttgtgatgaatttcggaagtggcagggcctcagaggtaaaacaatgctactataaaatttcaacattgtcatttctacacatttttctatccacaacgggaatagacatttgcagaaaattgctacatggttttcatttcttttgcagggatatgcttcagttactgtttacagtacatctcaatgaattaccaaccaggtattggagaggccctacaatgtgtgatcagatttatattatttcctccgtttcatattataagactttagcattgtgcacattcatatactgtctagattcattaacatctatatgaacgtgggcaatactagaaaggcttataatatgaaacggagggagtatatatcatttcatgtctaaatcgaacctcaacactcttggaagccgaaaaatctccctctaaattattatgactccaacggaagagtgaagaaacactactttcatttttgaccccagcacttaataatttccagcgaaacgaactcagctgatccactggctcgcgatgtcatcgaaacaagagttcacacagagatcagaaacgcgtagcacctgaagcgcgaagaacccctccttctcggcggtcttgacctggcagacgacgttgtcgtcgacccagaggacggtgatgggcaccttggcgccccacttgtcccacatcgccgacatgccgcacttgacgccgatcacgccggtccgccgcgagtccgggcccatcacccccgcccgagcctctatgatccgtccccctcccgatccctcgccgccgccgccgccgcccccggcggcggcgtcgtcgtcgtcggggtgggagacgaggggctcggcggagaaggggcggcagcaagggggcaggcgtgggcccgcgatggagaggtggcggaggcgcgcgaggaggcccctcgagacggccgccatggtggaggcgggtgcggcggcggcgaggctggagatggtggtggtggtgggtttacgcggcggcgaggaggaaggttgggtagggtttagtgagcttcggaggccgaggggaaatggcccagtgggccggcggaggcggagcacaagcacgggcccacttgcaggtgggcttcttacggcttgaggctttcctctctctgaccgtctctgcgttccttcgaactcttttcagaatcacactacaattttttccaaatgtaggtgttcgcaagacgcgtactctcactaatataaatacaaacacaaacatttttagaagactaacccgacgtatcttgatattgacgaagttatcatgggtgtcttactgtctacaaagacttgttcgacaacgatcttttttactatacagcatcaacaggaacagtgttttgtatttagggcaattgtatttctacccttgctttatgtctcaattgtgattttacccctgctttttagggtttgtgattttgcccctgcttttttaaaacgaagcaaccgtctacctctggtttggacggtagtttggtgggcccgggatttccgaattaaacgaagaaagaaaatgctattataatttgtgaatgactattctaccctttttcaatgaaacaaccaaatccccaaacctttgctgtcccgatccaatcgaaaaccctagcttgctgggttgcaagcggcggcggcggccgcttacgcaacaagcggcgacgcgcggcagggaggagtggcggctcgggccagcgcgcggtggagtcgggcgcgggcaggcgcggcgcggcggccccgaggagcggcggctccgtcggcgcgtcggcgtttgctcggctaaaaactctgggttattacatcctttctataagttgtgagagcaggctgcaaaaacaaatagggcagccagctctgaggtgatctggtgatgtggtcattacttcttccacgaaattgtatgatattgttgctgcttactgctcgatccgtcgatatagatttgagctcttccagagttctccagccagtttacatctgagaaggatgtggtcagatggacagatgattctatcgtcggacaagtctcacagttggtgtttaatatgtttctgaatgcgagccagagggagattctgcaggtatttgggattgctttgggttccagatttgtaagtaaagtatagtaggcagctgaagttgtttgtttctgttgaagctaggaggacagttcttgtattttgctgaatttgatgctccgatagggctgcacctattagcgtctgaagtttggggcaattgtgtttctgcccttgctgtcaaaattttgtcaaaaatattgtgttctggcatcgtttataaactgtgttcaaattattgcgaaaattctatcaaaattgtccaaaatattgtgttatgtcaacttttataaaaattttaaacatttaggtcccgtatgaaattcgcacaaaattaacttgaaacatgtatcctgtgcaagccaaaacatgtccaggggtatatttatctattcatcacacatttaacaccgttaccattagttaacagagtaggggcaggtggttgcttcgtttaaaaaaaaaacaggggcaaaatcacaaaccctaaaaagcaggggtaaaataacaattgagatgcaaagcaagggcagaaacacaattgcccctttgtatttctagctgcagcagcgtagcggctgcatatagcagccgaacatgcccaaatacaatgtctattactgaaggaataaatagctgtaaatgcaaacacctgtctcaagtctagtgttcaaaattttgttagaacccaagttttgtttggaaacaagtactcgcaattttcgactaaaaaaatatagctttttttttaacttgttactaggaaacaactgttaattgcctcactcaacacctttttgggttgatagcaacactttgcttatggtgatgctcaaattttaacgaagcaccaaaaaagatcaaacatgaaacatatttaaattcaaaagaaacagcttactattgtttcgtttatacttataagtagaatttaaattttaaaacctaattttgaaattgattttgtgattttttttaatcgtgatttattttcaacatttgcttttgtatcaccaaggacatgtaaataaaagttttttatacgagtgttttttttctatgactaagtataaggataagcgaaacaatggagccattaatgttgagcttatttctgagaagatttcatttatcagatgtgattcgcatcaacaattcaacttgtaagatagatcaactactcttcaggcctgaccgagcaatcagtggatgaatatataacagacggcattcagatgacgatcacttacatcagcaagtattcttctgatgcccaaagcaagtatgaaacacaactagaaatatattgtcgtcgacacgtattgacttattgcataactacactattctacagaaccgaaacaatctaagaactgccctccgtcaaggctcattgcctgttaaacagcaagctgttttaaccaatgaacagaactacagcctacaagaataacagtcttcaacaggtgaatgcaagacaccgagataaacttgatcacatctacaaactgccttgatgaagcacactgcgtaacatctacagtcacctgacctagttctcattggcaccaatacgagaaagaaagcctttgaaaatcatgtttatgtgatacgatgagccaacctcttcaggtctcaaagaaccgaagctccaccattgcctcctgatgcttaggaga

SEQ ID NO: 64201 - DNA, 2633 bp, Oryza sativa
attcctgcagccccgcggcggcgggcggcgctgcggcgcgacggcgtggcctggcggcggcacggcggcgggcggaggcccaggcggcctcgcggcggcgcggcggggcggaggcctcacggtggtgggcggcacggcggcggaccgcggggcctcgcggcgggcggcgcggcagcggccgatagcatgtgttttttttctttttttttaaaaaatttgtgattcggatctgtgtatttgatttgtgtgtgatgtccgtgaatatgtgatgtatttgtgatgaattttgtagaagttgtgatgtaattttgttttaagattttgtgatctatttgaatatggccgatttggggatttgaggattggggataatttatttgggattttgggatggggatagagtaaaatcaatatattaaaaacacaatgaagaaaagaaaataataatagagcaaccagatctagctagctaggctagctctatctttagtcccggttggtgaaaggctctttttagtcccggttggtaacaccaaccgggactaaagatgtatttttactcccggttttttcacctgggactaaagatcgtcccggattggtagtcccggtttgaaaaccgggactacagggggttatgaaccgggagtaaagcccctttctccaccagtggaactaaacactgccaatatgtggagctcatgaatctttttaccctgttctgtaaaaggaagtgaatggtttccgaacccatccgttttgcggcatatttgcaaaagaaaagtaatttgtaaataaaacttttatatgtgtgtttttagtgatctaaaagcaaaggctggaaaataaacttcgatgaaaaaacccccaaatcaactctacatttaaggctaaaaatttaaattttggctgataagtataagtataagcgaaaagacgaggcttttcattagtttgggggcaggggtatatcaatttaataaatgtattttagatgaataagttaggaagctaacatgaacttgttttcttaacatacgtgtagtaagtttttacatgaatgtgatccatctgtcgacgattgaagtagacagacaaccatggtaaatgcccatggctagcaaaaaagagatttgggcatgcttatggcatgctaaaatgtggacaccctacgcaagatcttttaggattttctgtcgaccactttacaacgcgatgctctaaggagtggccttcttcaccatgtagacttgcatctagcgcagaggaaagccgttgccttttagggcaaggcttagataactaacgtggaggaaagttattgctttgtagggtaaggcctacatagccaacatagaatggagcgggtatgtcgtatggtgttaaggtgccttctgcaagacacgaatgcagaactagatacttcatgtgcaccaacaccgatcaaaaaatagaatataatgcatatacctttgttgaccgaaaactctaaacaacttgacgacaccagatttgaggttcacaacgttgaattgaaggtgtgcaagaatcttgatgttgcctaggggtgaacgtgtttaaatttttcgcaatagataagtctcaaaactaggagcgcgtagatgcacttttaaggtcgtcgacaacctagagatagaggagccgacgggaggagagagagaaagagcatatggatggtgctagttgggtctaaggcaatgacactaagtccagtcagctttggagccaccgacagtgagatggatattagcgactcaggtgagaacaacgacgctatgactcttgatgaggaggagagatacatgagaaacaatgtgacgatagagtaacgtagggagaaaatgggttgttatgtaatttgttccttttctattggcctttatccgtaattttttggcctaaacaatatgaagaaaaatatattacattgatttatatcatttgaagccaccacgtattatgccgaagaaatttcttaagagcacgacttcgatacagtaggtagcacagtactgtatcacactttttctcccagatacaatataagagcatctccaacaacctccttatccccctctctaagttaaattttagcaattttggctcaatttcatcctccaacagactggctatcgagctggccaaagtcctccttccactagccaaatttggccagctaaaatagcctagccaattgtgggccccacgccgacagcatccctctcccctttctctctccgccaactgtcgtcgtcaagatgccatcgctggtgctgtcgaggttgtcgttgccggacgccgccgtcgcccgccgtcgtcgcgccggcgccagatccactattgccggacgccgccgtcgtcgtgccattgccagatccgagaggtcgtcgttgcgccgtcgccagccgtcgtcggcgctgttgtcaaccgtcgtctccgaggtcgtcgttgcccgacgccgcgccgtcgctagccgtcgtcgacgccgtcgccagattcgtcgccagccgaggtcatcgtcgcctgtcgtcgtcatcgccatgccccggcggattcggccggtgcggcatatggtagaggacgccgtcatctcgctcctgccgtcgtgttcg

SEQ ID NO: 64202 - DNA, 2035 bp, Oryza sativa
ctaatcagagtgcgtttgaggaaaaggggggagagatgaggaagaagaaagggttgtagagactgacacgtgggtcccactgtcataggcaaataatagagaggatgaatggataggctgttggagtaaataagagtttgactggctaaattagatggagagttggccaaatagacatttggagagttagatttggagagactgttggagatgctctaacaaaatcacaatccccattgtaattatccacggagtaccgctaggacctgtttgacatagctctaattgctaagtttaactctaagagctgggtctgtagtggagttgttgatcagactaaacccgctccacctatgtggtttattttgtgatagcacttcaacctgctccgtctcctattttaaaatggagttgaaattgtttggttggacttcgggcctgtttggatccagggactaagtccttgccacatcgaatgttgggatactaattagaagtattaaacgtaaactaatgacaatacccatttcataactttgaactaattcgcgagatgaatctattgagcctaattaatccatgattagtctatatgatgctacagtaaacatgtgctaattatggattaattaggtttaaaaaaattgtcttgcgaattagctttcatttataagattagttttgtaagtagtctatgtttaatactttaaattagtgtcaaatattaaaagagagtttagtcttccgattcaaacaccatcagcttcaatagctgtgaaaataattttcttggattcttacatggatgacgatcctgtaccgagcaccgtagcactagcacgttccaagggcgaccaaaaaggtactacacggttttgccctttccatcctgtacagcctccgagtttcatcagcattcgaaacgattttgaatcaagcgtgtactactactacccatggtcctggaattttcacccgcatctgccctgacccatcccacctccaccaccaccacctgcgccgcaagcatcagcccacccccgcagacgctggtcctccccttcctcctcccctgccgccggtgaccgttcctcctgtgcacacgcctcgagttcaaaactcaaaccccagatcagatctaaccccgacccaaccccaaccaggggcagattcgtcattctccccccacacctttattcgaatcttgcgtcctttgatgcggtaaaaaaaaaacaaacaagtcacgcacaccaacaccaacaataatgacccttctcccacacccccactgacgcgtgggccatcgcggagtatgggccccactcgacagcgacacggacgggggctgcaccgcgacgcagtccccggtccgggcgatttgaccggtcaaaaggcgtggccacgaaccaaaccccaaggcggcagcaggtgggccccacctgtctgtgggcgtgggccccgcgtcctgtggtggtggtgggtgctttgactgcacccctcccctccctcaggcggaaatcatttcggtttcggagagagagagagaggatttttttttccttcggcttatgtagtattgcgctgcgtcccgacaagcaaaagcaagaggaggaggccgcggctagcgagcgagcgagagagaggggagaagaagaggtgggacagccgggagatccatccctgtggagaggagggagggaggaaggaggcgttggaggaggagaggtgcgttgcggtttgttcgttcttgctgcttcgatttggtttgcttcttcttcttcttcttcttcttcttcttcttcttcttcttcttcttcttcttcttcttgtttgtggtttgaggcgattacaacgcgagttcgccgttctgcgagggcggtggctgatccgtctgctgggatctacgttttcttcgcggtttcggtggattttgcgggggtttcggggattcttgagacgtcggtgtgttgcggttgtgttcaaacctcccaagcgcgtggattctttttggggggtctctgggctgcaggaattc

SEQ ID NO: 64203 - DNA, 721 bp, Oryza sativa
gagtaaagatagatcatttacgccatagattcgtacccaaatgctcagttttttttattggtttgcactttccccttcgttagaggctcgtatgctcgcgcctgcctcatagcagatgcggatgagttcaaactcaagaatagatgcagaagagagcctgaatcaggaggagttcgtcaagaaacgtgaacagggtgcagggatccctattttggcttgattgaaggcggttttggagggggaaagttgcttagctgaacaacatttttgcgcatagcagcaaactgttgcttgtgttggagccgacggcaatgaaagaatgccttttttgtagctggttttggacataaagagtattttttatggttgctttcttgctaaaaatatggtgttttagtgcaagtcattcagtgtaaatctccaagcattcttatatacttgttccttttcctcctcctggatgagtcttggatgagtgcatttctctctgttcatctctttgctcttcacctgatgattgtttcatggtggatgcgtgttagatgcactgagttgcttagcatggtgaatcagtgctttgtgaactgcgtggttccactttttaactgatgtttgttattgacgatctcgcaggttgaccgatagatccattgcggagttgagtgttgatgcaaagctgattcgccatcgtttagctttttataagaggggctgcaggaat

SEQ ID NO: 64204 - DNA, 711 bp, Oryza sativa
taatattgatacgtctcgtgtcggtaatgatatttatgaaccactggaattaatgtggttggtttgtgtaacatttgtttttattctctctctccaaacattgatatatatccattttcgtcaattcagtttaaatagaagatctagttacttgtgttccaaggttgtgtaccatatttccctgtctgaattttgatgcatacgcgtcgggtgactagaactttcgtactactaattaattatcgatcaactagtaacatttttcaaaacatcatttgattgatcctggatttttggatgactcagtccgatggccagacacctttcttcaacctctcttttttctccatttgctctatcttcttatctaccatcaattgagctttatactaaccctgtacgtttcacttacctattgtctcctcaaccactactgattctttcctcgatgatggcaagcaccaaagaagttagggcattggggtgttgcagctaaagtacatatacatggaggccttgagcagtcggtaaactagtggcggtcagcgatgaagacgatacaatgtggagaggtgaggtggtgccaccggagctatgagtaaagaggaccggatgtaggcggtgttggcggcatatgaaattcaaagcaacttaaggagtatatattaggccatgttcttttctccaacaaaaactggatacaattttggg

SEQ ID NO: 64205 - DNA, 913 bp, Oryza sativa
acgaattggttttgcaggtcaagttagttagacctgccatttgagccgctacgaaatgtcaaggtttgtgtctatctggtgtgtgtctgatagttgagtacatgagtgcagcaatcatgtgtgatgcgtttgcattttgatttttttttcttttttgtctatcatgtgtggtgcgtttgcattttgatttttttttctttttgtctattttttgtgtggtgcgtgcgtttggtagaccatggaacttgagactagaacggtccacaccatactgcatagtggagttttgcaacttcacatgagtgaatttgggctatagacggttctgttgctgtcaactcaaaactccttttaatacgaagttatggtcaaaatcgtaccttgatagagataaaagataatgtcaaactcatatgttctgtaaatacttttgccgaggaagtgctaattactactcaaattagtgcaagccatgtcggtcgttcactgctttgccgacaagtcagagtttgatttgcatctttgccatataaatacatttcattgatcgatcatccatagccagccagaagacaccgacgaggcgtgaccggaccgccaccgccatcacctccgcatggagcggcttggcggcgtgccactagtggttcccctacgtggagcacctgttgggcgacggcgacgtacgagcagctagctgttcccagtgccgatgacgtcgaggccgggcacctacaactacaagcgtgcggcggccggccccttgcctttttgtttggttccctcccaaacattaccaaacctccttgctaaacctagccaaatatgtggctttatttggcttataaattgatggccacaccttatgcaaggtttggcttaaaagatgggtgtataacatgtgggtctttga

SEQ ID NO: 64206 - DNA, 8783 bp, Oryza sativa
attcctgcagccccctcatctcttgcccctggttaatttgcctccctgaattgcaaaaccggatatagcacctcccttatttttaaaaaccggtgtaaatcgactcctttgatggttttggaggtggttttgtcctacatggcgcatgtgggacccacatgtcagtaagaaaaaaaaaataaaaattttacacccggtacgtgtcagtcatccttttattttttttcgtcacctctctttcccattctctctctctccctggcggagtcgtcgtctccggcgagcccttcccaatcgcccgcaacccagtcatgaacaccgcggcgtacctgttcgacatggcgggggtcctcgccggggtctcctggccacggccccagctcgggtcagccccgtttggtgaccagatggatcagcccattggcctacccggtgttgtacagcaccctctcctccgcaccgacggccttgccgacgcatcgccacggctcgacgacgacgaacgccgtgccgcgatgtccctctctactgctgggtttgtctccatggcgtcatcgcgcgcggggaggatgagctcccacatgatgggccggggctgctagtgctgcgaggtggcagggtggccttctcctcctcctcatcgtcgttctcgcccgatgccgagctcctccaggatgatgaaactcgagcatcgccggggaaggcagcgggcggcgtcaagctggacccctcccccgtagtcgccggcatggccatgcagctggacacctgagcaccgacgacgactcctacttcttcagcaccccttacgccatgtcgttcagatatagctccatcattaagaagcaagcaggcaggcaggcaggcaagcaatcaattgaacaacgcaaaccaaaaaccgctgtagcagctgctagctagctctggtcacaactcgctagagccaaccgcaatcgatctcaacaacgaatgcttgaattggatttcgtggcgtgcgcagggaggagctcgccgaccactacgccggagaaagagagagaacgggagagaggatgactgagatgtgggatttttttttattattttttttaactagcaatagggtcccatgagcgccacgtaagatgaaatcgcttctgaaaccacttaaagagtcgatttgcaccagtttccaagaatggaggaggccttgtaaccggttttgcgattgagggaggtacagtagacttattccccttgcctaattaccccttcggccttcaaaaagatgtcgatgtccctcacgaaggaagaagctgtcgtcgctcctccgccaaaacttgtcggctagctcaaggacaagccgaggcagtactcttttagctcgatatgctaaccaagccatgaaccaatcccaagctcggcttggcttgtttccatccctaggtctaggtgtgccaactcctgccagacagtggggtggctcgaaatcgagctcgcctgctttatattcacgatggtcgccattgccaacaccatgggcgctgggaggaagaagctaaagtagtccaagggcacttctatccaggatggcattgtaattgtaccatctacgccacgcagtggtgaacaagaataaaaattattgaaaatcctatacatatcaattagcaaattattaactactatactaattaatatgatataaattagctagaattgagtaatttacctgtggtcctgtgaccctggtaagcactacgtaggttcgcccattgacaccgcgctagttgtcagtggtaatttattaaatcccatttaaacggtggtgtttcaataaaaccatttttttgcaatggcgtgatctcaaacttctccgtgtcagcgtacgtacggaaatatggaattattgttctcaacttgttttttaacccttatatatggtcatggactagtactccttgtacgttatggaggagtatttattttctctggtcttcccagctgtgttgttcaaggagtacatggttgcatctgattggagtagtcatcagctttatttttatcttctctagaccgtgtagagtgactgtagagtgtagacgtaggatacagtactacacaggaaaggcgttcataaatgcgaaaacgataataactgtaccacctatagaacagtgaatttacttccttctgacccagaagtaaatgtctgtgcaatagcatgtggtaaattaaagtcttgcatctgcctcaacattactgctaggttttagtacctttttttctctttttcttttttaaaatactgtgatatgttcatgtctgtcccatgattagtataaaaagctcttaagttcaatcttcagtgtagtactagtagtttgtagggttgatttgcatgcatggcatgttgttttatattaattaacttgcttctaaattccaattgatatagtaaatgagagcttcctggctagcttcctctctctcatacacacaagagacaccatcataagaatgtcttgcaggtatgtcacttctccaagggacagtgtagaacctcaactctgaccatattcaaacacataaaatgctgagcacgatcagtaattacttctacctctgtttcagaatataagcatttctccacatttctaaaatttatctgaaacggagagatgtgatgtgacacaccagaaatgcttatgttttgaagcagagatagtaatatatatagccatcaccatacaataacacaataatgatcacatttagcattattcatgcctcgagctcgaaacagtggtagtactactacatgatcacgaacttaattaaaacacaaaatataagaagggacctaattaaaacaaacaaacacaaccaaccaacaaacagatagaataatcctcctccaaatgcatgtaaagaaaagagatagaagagacactactcataatagaacgctagctagacacagtgcaagctaactgcacatatgaagatataacgcgcgcgcgtcatatagccatccatattgcatgcaacgccgtgcgctacatagagcacattacccgcgcagcagcggcgacgccgccggcgacggcgaggtctctcatggcttcttggcctgcttgtcggcggcggcgggggagccgggcatgccgccgccgaggccaggtgagccgccgccgaggccgccgaacatgggcatgctgccgaagccgccgaggccgccgggggtggagccgctgctgccggggaggctgaaccccgggatgctgctgccgggcatgccgccgaacgccggcaccgcgctcccgaagcggtcgaacggcgggaacgtcgtcggctgcaccaccgtgtccttgctctccgccgccgccgccgccgccgccttgatgttcctcgcctccgccgcgccgaccaccgcgagcaccagcaccgccgccaccgccatcatcttgctcgacttctccatctctagctcgatctctcttgcaaaagctaagctaagctcgagtgtgcaagctgctgctgctgctgatcgatgtggagttggaggaggagggagagaggaggggagaggatttatagcggaggagaagctcatcgtcatcgatcggcagagaagacggtaggtgggaggcgtaactgcggatgttaaaggagggggtacctgctgctgttactgcaatcctgtgatccccattaatacttttgctcttacagatcatcaatataaatgtagtacacatgtaggagtaatatgatatggagtagtatggctctcaatgactttggatgaattggcacaacggaaaggaggaggaggagagaggagagaaatgaacaaaccctagctagatctgtggttgtggttgggagctagtagtggcattcaaaatgttgtgaaacccttttaattagacagcttgcattgcatgtaaggggggttagtgtactaagaccaagtataatagcaggctataagccaactatatgcttatgtggaggaaagagaatttaaaaaatgcagaggattggctctcatacaagagctagctattcacatacttcaagacaaatacattaaatatataggtaagagatagagagaggaggagaaaaaaagaaataaccttatagctcatttactatacatgtttactccaatataaattataagcttatagttagctctattattaaacttgctctaatgaactagttatggattggtgtgcctgatgatgatatcatatggcacttggtaggcaatggaaaacaagagagatggcatattaatggcattgcctttttttttgtgtgtccaactgtgattaaatgtgggatactactaatgaaggacttagcatctattactgatattaatttaacataaagaaaaactttattgatctcagataattaattgcatcaatgtgatatattaatcgatctaagagacaacctgtcaacctctgcatatagctaggatatggatgccctaggatatgcagagagcctgagattattaaaaaggaaaaagtacgaattacccccccaaatctatcgcgctcgtccgaattacccccctaaaccacaaaaccggacattcttcacccccaactatgcaaaccagacaaattaccccccctcgacccaatccgcggtggttttggcctatgtggcgtacacgtggcaatccagtcagcattttattttatttttaatggtgggacccacatgtcagacccctctttctctcttcctccctctctctttctctctcttcatcggttagcggcagcggcgcacacgtcggtggccggcacgcatggcgcggcgcgaggaagggcgatgggcggcggcgcgggggcgggccggcggtcggcgcgcacgcggcgcaccgggaggtggaggggatgggggagaggcgggcgtcggcggccatggccggaagcgtcggggggaggacgggggacggcggacggaggcgcacgttgggagctggagcggtgtcgggaggaggacggggaggaggagcaagagaggcggaagagggaggaagcagcggcggaggaggaggccgttcccgcgaccaaatccgtcggcgccacacggggggacgaccgtcgtcggatccgcacgggcgacggccaccgcacctccccactaccgtcagatccacacggttgcgcaatccaccttgccgggagaggagaggggagaggaggagtgggggagaagaggagaagaaggccgttcccgctcgtcgggtcagggcggggcagcagctgcggcggcggtggcaactgcggtggaggcggcgcatgaggtcctgtgggcgcacggctacgcatcgacggcggggcggcaactgcggtggacggcggcgcgcggggaaggggcggccgccgtagtgccggcgtgtccgagctccacgccaccgcgacggtatgggcatgaacattatgccgctacaaaactataacacgcataagattaataccaaaatccgagatgatttgaagttttgaacccaaacccacagagaactctaggcagctctcggacaaccgacgtataaacgtacccgtttgttctccatttaactaattaaaaggaggacatttttgaaccaggagaaaaagaaagaaaatctgtttagattttagagcgattaatcggttgaagctagacagggagatcaaagaactgtttggccatgactttctataagcatggatacgtacgatagagaatctagttgatcgtgacacttaacactaggaaagaactcgtgtatgcgtgtgagtgataattaatgtgtatcatcctggcaattataacaattaatcattatatatcgccgctcgattgattcatttcatcgttggtatacattatatatttatatggttgtgtgttactaccacgctaatgaaaacggaccatatatatgttcttgagtgttcttcaactttcacggggttaattattaatcaatttattaccacggtcagatcataacctcatcgctgcctgctagtcttgtgcgtactagcagcacaaatccagtactggtttgacaaaaaatggtaggatcaaatatgtcagacattacagcttgcgtgcatgtggtgtagtagctcttctgttctttactccagttcagagagaatcaaattcgctagctggagtactatttccgtaacttggatggagcttcaacttcgctagatagtaacaatgggaggttaaatttctacttgactaatttaatttagtgactatagcaaatgataactattactgttgttttgtttgttataatttgcctttagcggctgaggaataaacacaacttggaactaccagtttatactttgcatacatctgctgttaattgcatgcacctgcagatcgatctactcccataagcagatttatagctcttggaactttggaagaatggtagttgggtgacataatgctactagatgcatgggcacggccaacatgccctgatcagggatatggccggggtcttttggctcatagcatcatactattacacctagctagagattcctagttagctagaaaatgacaagttgattattcgtgtggtccttttatatatctctgctacttaaaaatatggttgttctcttttcaaaccatcgcgtgtaatgtcagaaaaccccgtagaaaaaactgaatcggcccacctcccatcatacacaatttttccccagctaaaaattaactagctagaaaaactcgatagaaaaaataaaccctatataaaactattattccttgaaatcccattgcaacgcatgggcatagcgctagtgagtttggaaaattggtgagattttcctattgccatcatatcttgaaacgactcttcaaattaataaaataataaaatggcgtcactgttaatgttatatgtgcataaattccttttgctcttaatttgattttaattgtggcatttctctaatgtcctagttaaaccattttttccaaaaaagaaaaaaaaacctaagccctcatttcttccgtgcgatctaaatagttataagagatccttcaaaaaattagaaaaataaatattgtattgggtgtcttagcctataaaaacatgcataatcaaactcgtctatatgtacggacgaactaaaacaacaatccaactactttggtgccattggaattgttattttgtttctgcgtgtgtggattaaatttgaatttacatgttagtacatggatgtatatgacatgattatgtatttcaattcatttttaaatttatttggaccatgtatatgtgaaagcgtaagattaggaagctttgtaataaagttgagggaatgtccacaatacctaaatttagacagatccaatttaaaagattttataggttcattaattaagacttggcagaagaactaataagtttctctaacagttaaagacccttaagatcacaaaattaatttcatttcaaaattatttgcaaaaggatatcaatttgtaatacatgaagccatacatcgttataagcaataattaaggacgaccttataagatatatatataattctccatagtgtggtagtacgtactgcatcagaatatatgctagctatgtacactactagcctagtttacacgcagtacatgtacgtatacgcccgttgtgaattgatcacggtgtgacgactttgagccatggatagctgtatatataacgatccacggatcggagtcacgcgccagccatcgctagctaagctgtgtagccccacagaggcaatactaacccgtttgggatagaatttttactggattattactatttactatcaatttcattataaaggtaaaaaatattataaacatatatataaattttacagataactcagaacaattggtctaagcaatacagtagattttctaaaggcattcatattttttaaaaaatatgggaaacgtgtagtgtaaaacaaataatcggtgtcactgattcgatgaagtatatgaaaacaacatggcccactgtaaattagggggtgtgtacgtgaatggtttagacgacgcgatgaggcttacaatcttgtaaatggccaaaaattcagaaattttaggggtcaccaaaattttttaaaaatattaaaattatttaaattttaaataaattatgtctgaattctaatatattttggtcagctcataaaaacttgaagaacaaaaataaaataaaaaattcagatgggatagtttcttttttagataatggattagattaaaaccggcctatacaaatttgtggggcgagacagtttcatgcccagaggatatgtgaaactaccgaaatttccatcctagcacgatcgatcaagggattggaaacctctgacgaacgtggtgcctgacatgtggaccctacctctcgcgggcccacctatcaatgaccacgtcaggggaagttcacgtcagatggtccctttcctcgatcgatcgagttgatcgattggtggcaagtggagagcgccggcatgcatgctgcgtcacgtacgtcggtgacatcgatcgtcgttgcccatggatgcatgtctgattagctctaagctgcggcgcccatggatgagtgagcgagttagtgaccacaagtccacaactgatggacccagcagctagcttagctgatggagaattaacgagacgagacgagctagatcgacgtgtgagatgacatgagacccgtgcaaagacag

SEQ ID NO: 64207 - DNA, 1656 bp, Oryza sativa
aatcgctctctagcacattggatcctgctggtatatattctaccattctggtgcgctcgctcgcaggtgaccacaattccgctaaaatcaatcaaaatgcactaacctatagccagcgcgccctcctggtccctggggagtagtgcactgtggtggtggagtagtactccttaaatttgaacatagtttatatttagattaaaatttaaaagtgaaattcttttgggaccgagggtgtacgtagctgactagctggtggcgttgccatatgcgtacgtatctggttttgcttagctcaacgcagtaaatgagagctacgacgacagctgagcagggagcaaaggagggaacagagagattcagagatgcaggtgtatggccctgtcctgccctggatccgtcaatcgacagccgatgttgcctggcaaatgtcacatttctttgcaagttactactccctccgtttcacaacgtaagtcatcctaacatttctcatatttaaattgatgctaatgaatctagacatatatatctatctagattcattaacaccaatatgaatatgagaaatgctagagtgacttacattgtgaaacgaaggaagtagtacagtaattaggatgggaagagtacgcacaggagtgtgtttagttcctgaaaaacgttagaagtttgaagaaagttaggagtttgaaaaaaaaagttaaaagtttatgtgtgtaaaaaagtttttgatgtgatatgatgtgatggaaagttaggaatagggggaaactagacacggccatacatatcgagaattctcgagatgtttcattcattcattaacttgggctgtagtttttacttgctgtccattagccatttgctgcatgctggtgtactcatcacatcggttttccgcctcgcctggacgacagccggctaatccccatgcgcgattctccagccggtgacagctccgtgaatttcgaccccgtgtacttaacaatacttacccctgtttgcttttattattaaacttctgatacctaaaaatattatgcacatatgaacacgccttcgttttcaatcaaaaatttaggtaagagagatttgttgtcggccttcatctctctaggtatgtgttcggtgcactactggtgggtctggtgtgtatctatgtgggtacatctctcatgtcataaggaaaacactacctcatatataatttcttataaaagacaatatttaaaacccaatgtcagtttccacttagatttgagccttcaacggataaaatgcatactaatatcagggcgatattcttttaaaataaaattaactgcgtggagattgaatttcgaaaaaaggccggtactatatattgccagtgtaatcatctgcttggaataaaggtggtgtacattcagagtgcactctactgttactactacaactatacaagtacttagatatcttaattgcatgccaatacaattatacaagtatagtatagtagtactagaactagtacacagtagcacataggagaattatagacctttttatggtcagacacccaccgactatatagtagaaatttctggattatatatagtcggtgcattgcataagcgtaataatattcaacagtatctgccgcctaactactta

SEQ ID NO: 64208 - DNA, 1469 bp, Oryza sativa
caacatgcacaaatcttgaagtaaatgtaatgatttgaaattatgcagaagttacgtccaagttacaatataattatattgcaattgtactatatttgtatttaatacttttaaataaatttatcgataaatatatagagaggaaatagcaaaactatattttgatactgtagaaaaataaactgaccagtggcagtagtgacaagaaaaaaaccgtggcccattttctaaaccaatttctggccgaagatgccggcccactgtctcaatcgggcccttctcatgtaggccttctcctccgccatgaacagggccccgtcaaggcccatgtggccacagacgaaatagcaaaagtctcctcgcaaagatggccggagacgacgaccaaccacggcggcggtggcggcgcagggccgggattccgggaggggacgctcctcgaaccggacagagagagagaccgtacagggcgtttattcggtcggtcgccgtggggtgggggcgccacggccacatgcccgacgatgggcgatggccacgctgcgttgatagctacgtcacggagctcgccacgacggcatcccatgatgattcacgaccgccatgcacatatgctttgccccagcgtatggcgacgaagacgcgattgcgatgatggtcctggtcctggttatggttatggttatggttatggttactagtactcacgttagataggccaagagcggcgccatgattatgcatgtgtcgatcgatcaatcaggaggtgtgtagtacatgtgtacttcttggatgcaaatccactgctgtactgtacctgcagtacgtttcacctgacgtgtgggtcccacctattccgggcccacatgtcagtggcacttactgcacatgtattacaggagaggatcgtaactcgtacttcttcggttccagattaaagaaaatataatatctagatctataatagtaatgtttatttgttttgggacaaagaaaatacatggtaccatctccattctaaaataattgtatttctatcatttaaattttatcttaagaaaatatatttcttatatcatacaatataaaggattttgattggatatgacatattctaatactacgaatctgaagtacagatttgtagtactaagatatattctatctaactaaaatctcttatattttagtatgaattgagtatttctactaagcaacaaattagtatttaggtaaagatataatccctatatttctacgcacatcacctttctttaattaagtttacatataaaatatgtgcatgtctagtggtcattaaatagggttattactattatttttacggctgtttctaatcctctagtatcttagaaattaattattctgaaatgggggtggtactagtatgtacagtatgtatcatgttcgccacatccgtatactctactctattattccgccgatca

SEQ ID NO: 64209 - DNA, 3200 bp, Oryza sativa
agtatcgactggtatagataaaattattactccctccgtctcaaaatataaattttttagactttgacgcagtttttgagatgctaatttgatcaacaataactataaaagtaaaatattttagataaaaagagttacatattatgataaattgtataatgataatctagtaatgtcaattttacatgattgcgcttttttattttcttgctattgatagtcaaagttaaaaatgtttgatttgatactatgttaaaaatacttatattttaagatggagagagtaatagtgtatgtatatgtgatacaagtacaacggcatgatctaccccagtctgagggcctgtttggtacagttccaactcctaaatttaacttcaggagttaagtctggagtagagttgtggagctgtctctaattaattttgtgagagagctccatccagctctactttcagttttggtggagctgaaattgtttgtcagctctagaagggatggagctgtgaggcccagagagtcccagagacccagatctactccggtaaccaaactagataatgcgtgtcgttacgagaagtaattaaccgggaaacaaatcatgggttgttatgtggactacagcctcgacgacgcagctttgctagcgccaccggcgccggcggcgagcggccgggggacagtggccacgccgatccaggccactgtccccaaattcacggtcaccgcactgtccatctcaatttttttcctttctcctttcccttttctttctccttctctttttcgtcgccatggtccctgcctctggctctgcaggcagtagaagtgagctcctgctgcacaactagggaagtgatgaaactgcaacgctaatcacggttgaccggcctcgaaatccgtgcctgtcgactgtattaactctcgctatcttcgtcaggagcctcaacctgcagcatctggacatctggatctcagttaaatttacgaacgggtcctttctcaagtccagttccctactgagagcactctataataatagagttaacttcctaatattaatcaatcttaaaaccaacacatataatagattagctataaggttggatataattttcttctcctctctctatctctcacttatatattaattgtatttgtcttgaagcttatgttaagctagctcttgcatgagagccaacacccttaactttttgttacatctctcctccacataagtttataataggcttatagctaactattttacttgctctgagcttagctatagataggagtagcacgcagtagctactggagtactcctccgtaaaaaaataagacaaactctatatttccgtgtccaacgtttaattgtccgtcttatttgaaaaaattaaaaagataagtcacgcataaagtattaatcatgttttatcctctaacaacaataaaaatactaattataaaaaaatgtcatataaaacggacagtcaaatattggatacgtagactcaggttttttttttttaaggagtactcaagtttagtgggaggatttaagcaggaggcgccatcatgagctgcggtgatgattgggtaggtggctggctaattagggcttaattaatcgggccggggctcacacctcgcctcacatggggaggtggtcttatccgtataggagtactagtgtgcaacgcgcctacgaggacgccacggtatacccgcgcgatttgcatctcatgtgatttcgatttttcttcggttgggtcattggcgagtaagagaaactagaccgaaggttcaggtccttttgaattacattaatggaaaaacaaagcaataggtaaaccataaacttctgatagaaatataagtgtaaaataaaagattagaaaataaaaaaaatataggaattaccgtttgattggagcatagaaaaaacgtaggaatcatatgaaagatagattcaaagggattttccaataggttgatctcttgcaacttttctttaaaatttctatacaattacccataccatagaaatttgaaagtataagatatgattcaatccttcgttttaaaggcttctatatgaattgaatcatccaaattttctacacttttcctacaaattaggccctaagccagaatttgaaatattgtaatttattttatagtattggttttttaatagttaacaacatgtatgtaaaaattttactcatagattgttattttaattactaataaacaatataaataagcacatgccgatggacacgtttatttatacatcctcaactcataagccattacagggtttcactcatgtatcttttcactttggtaaattttgctacaagacatcacgacttcgtgtttttagctccaggacaccgcacaaagttactttttgggaaaaacactcttaaaatatggttatttgctagcggacaccacgccattaaaatcataatttccggttgaagagcagagagacatcgcgtgaaatgtcaaaagtatccttgggcccacatgtcagctctcttatctctgtctacgagacgaggcggggcgcggtgccaccaacagccggagcggcgtctacgaggcaaggcgaggcgaggcagggtaacaagtctgcgtttcactttttatattctgggagtcgccagttacaaatagacttcatgctatatactccatccgtccctaaatatttgacgccgttgacttttttaaacatgtttgatcgtttatcttattcgaaaacttttgtgaaatatgtaaaactatatgtatatttaacaatgaatcaaatgattggaaaagaattaataattacttaatttttttgaataagacgaattgtcaaacatgtttaaaaaagtcaacggcatcaaatatttagggacggatggagtatatctctactattataaaaatttttgccggtactttttgtacgtcatccgtgtatgagtcggttttgaagttcgttcgctttttttaaatacatgagaagttgtataagaaatctctttaaaaaaaacttacatgctaacttaagatgatccgacttctaattgcagctcatgatttcctaaaagaatactatatatatatatatatatatatatatatatatatatatatatatatatatatatatatatatatgggctgcaggaatt

SEQ ID NO: 64210 - DNA, 719 bp, Oryza sativa
tattgtattttttatttgcagaattgctcgaccctaatccaccggctcctccgctactcgcgcgttgcggccgaccacccgcttcatgttctccctcaacggcgttgggctcgtcttcttcacattcgcccggccacctcgccctcccctgtgcctcccgccgccatgctgctgcccttcctaaacgcttctatctcaccgacaggagtcaccctcgagaacgcccgtcccaatacagacttgccaaatccattgaacccggggagaaagaagagggacggcactggccatcggcccggatcaggagaagggaggggcgctagctagcggaggaggagaggaggcggcgtgtgcgagtgagcggtggcgccgtgccggatcctccgccacctgcgcatcacggccgatgacgccacggcgaaccacccgctcgtgtcctttatttatactccttccatttagaacaccaaagaactggttaaaattacctgcaattggtgctaaattaaggcacgtgttgagatgttttcagcaaagaaaatcaagcagtgtcttccctaggatcactggttctctttagatctttcgttgaacttgtagagaggaaaatacccaagtaggatgcatgcatgcctgcctgcaggcgagtaccaaaatcaccgagcctatactaagggatactggatggtgatgcaaatgagcaaagggctgcaggaatt

SEQ ID NO: 64211 - DNA, 2082 bp, Oryza sativa
attcctgcagccctgcatatctccgccacctcctcgttctcgccggccgccgtggtccagcaggccgccgccgccacgacggcaacgacgaggagcagcgtcgcgtgcgccagtgatctcgccatgtctgcctctggtcttcactagctagtctccactcggttcccaacgccaacgttgtcgttgcgggatcgattgaggttggccggagacaggggcgagagggagataaatactcgcgaggctgatccgccgtggggcggtgtggtgagggaagcggcaaaaatggcgggtggcctccggctggccagctgcttcgagccgctcgtttggtgtttgctaaaatgccaagctttctatttttgcatggaacccgcggagccgttggaacacaaagattgcagtaaaacttcttttttggaaacattttgcatttcttgccaaattaacacatgcatggttttaacttggtagcaaaagtaaataactaaatactgggaatatattttatctgcaattttgcagaaaatctgtacatacaagtacaacaatgcctagattgcaccatgcatctgcaagccaagggattaaagtgtacatttgtgatcacgccagctgtccatggatgatggggatcacggtcctttgctgtggtcaaacagacctaaccgaaaagtctgaattcctaccgcgccacaaaaattgttgtctaattaatcaagctatagtatacatgtttttttatactcgatcaggtcataaatatttgatgtttacaatcaaatttagacaaactttttaaaattttgataattaattttgtatcaagatgaatatgtaaaatcctacaagtttttaaggcaaatcaattgaaggacttaagaaattaatggttggaatttcaaaagcttaaccaacgtatgacgtattattctaaatgccaaatatttattgccaatctagccatcaaagggtcagtttggtatttgaggtttccgtttattcacatcagtcttctagtaggtatagtgttggcttaaaaacatcgtgggactcactggatgtgtcacatggttaatcctaatcaatatttctgttagaaaacgtttttgcccttaatctgcatacactaaataagagaaaaaaaatagagttgtacacgtacttcctattgttttagcacgtgcacacgagggttgagttttaaatgattgtagtatgcacatggaagtacataaatatttcctttttagataaaaccaataagaaagtattgtacgcaaaattcaataaaaaacatcatataatgatgggttaattggatccatgctattacaaatataccttttagataaatgacactattattcacatatcagctacatgccactggaatttgggaaaattgaaatcgtgtcactctgtcaagtttcccgtcatatccctagacgtgaaacccacatgtcggttccatcttcatccatcctccctcttctttcttcctcacgtatagttgattctaatagagatttttaatagaaaacgtgatggagtggggcacggttccaatttccccaaattttagtggcacgtagccgatatcataaacaatagtaacatttatctagaatgacatatttatagtagcatggatccaattaactctataattattgttggatacttggatgtaccgctgacatgaacttagttatatgggtgtctcatcatacattttcaccacatgaattgcaatgtgtgtgtgtgtgtgtatatatatatatatataaggggtataagggtcgttgatcaaccatccatgtagctttgtaagaacatgttcagttaatatctaagagagaggggttagagggaaagcgattatacagcagtagttggttaggtttacccagctatgtagcttttctaagaacatgttcagttaatatctaagagagatggattagagggaattgagggaagtaatttcacactataaaataggtgtgaactaatctttttcaaaccaaacaaggactaagtaagttcaaaagaaagagtttgaactaaaatataaaaact

SEQ ID NO: 64212 - DNA, 2904 bp, Oryza sativa
gtgcattgggcacagggcaggcaaagaatacgcatgatggcacacacatgtggtctacgtctaccgggatatgatacgcatctatggctctcactactgtaccaccctacatggcatcgtcctttgagtgattaaaataattagtagtactattagaaatttgattagtttacgctaacctagtagtagattagtttagtgtgagctatcactgtttttttcttcttccatttcagtaggaagcctaaccggagtagaatatcctttgattacaagcacgactgattcaaagtttgaaattcaagatagaaataatttcaacattaggctacgatcagttgagccactgttggcaacatgtagaaaaaccaacaaaatattaaaaaaatatttatggctaaaatttttacatatctaatatgagtagtttaaatgccaaggttgtgctcgggaggagaggttagcaacctctccccatacacggaaaacgtggttacttattaacatatggttaattaagtattatattaaaaacttaaaaatatattaatatgattttgtacaacaactttcccatatatcttttttattaaaaaacaatgtttaacacttcaggaagcatgcacgtagaaaacaaaagaatagaagttggtactccctcgatcttaaaatataagcaatatggattgattaggacacaccttattactacgaatctggatgtaggaagtaacttatagacattagtaactgaagaatagattatgagaacaaatataaaaaaactcataagttctctttttatttaaattttaaagttttttttagttcatacttgtaccatgtgtctgctcgtggtgaatttcgtggtgttttttttttactggttggtttcacctgtcagtggcagtgccagcttcgagcagtgcaacggaaaagggcaaaaaagtcagcaggcggaaaaaagcagcagcgagaggagagaggagaggggggcgcaggcgcaaaaagcaagctaccaccgcagcccagctcgaggccaccaccaccaccaccaccacggcacggcgaaaggggaagaagaagaggaaaggaaaaaaaaaaaattccgcagctgctacctctcgccgccttcgccgccgccgccgcgagaaacccagcggcgtcccgggaaaccctagccccatcccccaccccgccgcgcgccctcatggggcgtccgcgtcggcgccagtagtagacaggagcggggggcccgccccgtcgccgacgaggggcatccaacgatggcgcggatacggcgcgcgagctccggacgaggttagtgtggcccgatctgagctgagctctccctcccgcgcttgctttgctgctggctttagctaggtggtgtcgtgtggtctcggtgttcgcgctatagctaagcgtagagagcaatccgagggtttagctttcgcggcacggcggcggcggctcgtgcctgtgcggcgaggtgatgcggcgaggggttgggcttgaggggagaaggtgcgtgatgtcggctaatcaactactgtggtggcggtgggggggttggcgggtttgttccaggatcttagtcgtcgccgcttgttcggtagctcaactctcaggccgtgagaatttgggtttggtgtcgcgggaatggtggtcatactactatgtaggattcagtgctctctgctgccgtggcgatactggatatctggaatctgatcgaagaagtggggcttagcttaggttatcaattatacaaatccatgccttggatagctcttggttctcttgtattgagcttttctatgttgattacttaaagctgtaaggcggttttctaccacagaagcactatacattttctggaccttccatgtcaaattgcaccagttcggagataacaaccattgctatacagaacaagtactttttagtctagttcatctaggatttgtatcgaccaaaaatatacgatgagcagctggatgtccctagttcagcatacattgggttttaaaatagtcaaaattgacattagtctgtatttgttgtagcctctgatctaagtttgagtcactacaaatggatttgtgatattgattatcaaattcaggccaatggatcctcctttacaagaaaatggtcattactgaactcttgttactggaatgatgagaattcctgcattgctgggtttgcggaaagtatctactttatgcagagaaaataggcaacatcatgtttaccatgtttggccttttctgggaaagttattataagttttaatttgtgtttatggcttcttatggaaggaagctctttcgttttcttgcaataacttgtctttctagaactaattagctcaagtcaaaaaaatgtttaatccaccaccatagccatgttaattagattatgctttcatgcagggtaataaacatcattataggttgaacatataccatcactgtctctgctgagtttatcaactggagataaacactttgaaaatagctgtcatactatttctggttctttatagctaaataatggtggtttatcgaaatatttacatggtctgtaaaatctttaactacacatgccatgaggtcttatgaaatcctctttgctattgatttacactatctttacttatacttggaaacatctgtgaatgcatataaatatatgcttgtgaacttttgttcaactactccctttgattccaattataagtcgctttagacttgtggacacaaagtaagaaaacagctcaaatgacttagttgacttcattggaaaagagagccatttatttgtgagaggggtatcatttatttagcaagggcaaattgggaagaataactgcagaaagtgcctagaagttccata

SEQ ID NO: 64213 - DNA, 1448 bp, Oryza sativa
agttgcacctgaccagtgtcaatgtacatacatattctttaaggcgttgacttgttgattcttcattgtactgtttcttggcagggcttttggaagatgctcgaagaaaaccttcttaaattttttggctgtggtatttactctggaattgattaccagaatcaatttgattgcccaaacatcagctctaaatgtggttgcccctgctatatctccatctcaaagttggagaccagttcgctccatgttgtcaaaagctaaagttgacattagtatttcagtcagcgaacaaagacgaaagaagctatattcatcaccagctactctatctgtgcaccctccaatgtcagcgccaagctatagctccatttctggtgattctgatctctccttttattcttcagacatgtcagataatttggtgcagcataacagacgctcagaagcagaaatttctactcatgtagatgctgcgcctcctgatgcagcctcaaatactagtgcagctccttctggattagtacaacctccagtatctcctcacaatggtatgtttgattgttagagccttggaatcatctaatttatatgattttcattattcaagcatgacttgaaattatatggtgtaaatacaatgcgtaaagggccatctggttattcgagtagatacacaaaatgatgcctgtgtggttatttctgatttgcctttccaagaatttgttctttgattgcacctcaaccgtaggcatttgagtaaattgtgcaattcttttaccaatcaaccaagtgatatcaacataaattattcaattgcaatttgcttattaatagttaattagaaatgttaactctattgtgcatatccacattcacattggaatgtacaaagcttttacttagatctgtgtggtatcatggtgcaccttgatgattcggatcaacattttggagatcaatgctttggatgtttctatgatcgcaaacgccggcaacagaaaacgcgcaaagaaccagaattaagctgaggggataaagctccatcattatcgtgcttaagttttgttggtcattatcttttaagttagtcgtcatctttagttcactatctcaagattgttagccatttatctccaagtttgttaggcgtgtcaaatcccttgatctagaaaagggtatccgggtgtaaggaataattaagtaagattaatctaatcaagtttaggcatgtttagagcctctcgctctcgggggaagagccctgcctcccgccagaggatgatcgcgagtttcgcccctaccccctccaaaatcatccactcgagcattcactgctctgacagccgctgcaacaccatcaccatcgtgcgcgtatcactgcatacttgaagcatactgaaatgctcagtgcctgcgatccttttggccaaatccaattctctgaatac

SEQ ID NO: 64214 - DNA, 720 bp, Oryza sativa
catacaggaattagtttctcagccgaccaagttaccgcaatgaattattcacttagtcagcatacagttcagatcaaccctgtactagttggtgactacaatcttcttaatttaacctggttcaggccactggttctagctcctggtaatgctaactgatcttgactttgctctatatattacaatgccgcagtttattttagtgttaaggtagagaacactgtaagactacttcagtttttttttgcttctttaatctctattgtctactgtactagagaaactgaagaatatatatagtatgtggtaatactgctcatatgtttgtgattatcaaataagcagatgattataaaaaaatcactgtgggttggcatattccattctatagaatcaattagcaactatatgccaaagaaaaaacagaaaagaaaagtaagataaaattacaatattcagttccttacatttcttattctgtttttgttctgctcctctatacccttcatgcatacatagagtgcatcttttaatttgcatccagttctactgagatacatatatcttatactacatatgctttgagtttagcactggttgatctagtactctagtgcaaactttgtacacactacacagtttcttatacatattccggtcattaattcttggtgtatcaacttggttatacagttaatgtgctatttgggctgcaggaat

SEQ ID NO: 64215 - DNA, 988 bp, Oryza sativa
agtgtaatcatcatgaaaggaaaagttgacctgaaagcttgcatggaatatgaacattgtgtggtgtttatggtttggagagggaacacaattaaaactactaagtatgcactacacaaatccttcatgacttagtagaatgatgagcatgtcagtattttttaagtctgtacacatacctgtatctgatctttgttaccagcagtaatatttgaaatagtccagcaagcctctttcttgatgcttttcttgagattttgtgtcaacagacttaggaggcaagggagggcttgatgatcaatgatgcactgtacaaaaaaagggggtggggggagatgatgagatggcaatatggatgtcaaaaaagcaattaactttcatgctgtgatctacagtagatatttcatattatatgaacaccagctttagcatagcagaaaaattctcagctctcctaaaactcaaacaataataagaatacaataagaaaagccaagtttggctgaaacaagtacagcagctatgacttgctgcaaagcaggcaatgaatttttaggcaaactagcaaattgcctatgcgttgcaatgaaaaaaaaatcatgctgtgcacactgcatgctcatcatttgaagaatatgtagactggctcttttcaacccctttatggattccttccctgtagatcttaccaaacaatatggacattatcttttggaggacgtttaaatttattgagcatgtgggtttcacccaacatggagggcccatacattagtgatagaggtagtgctggcagattcactgccaccaccactactaccttttaaagtagtatagagtatagatctaagtgatactgtgagaggacaaatctcaagtatttaagtgacacaaactagacaaatctttaattgatgggcgtaaagagtaggtcaaattgccaaacatgtgcatctacatatgacaaatatgtgcatttatttttcaa

SEQ ID NO: 64216 - DNA, 868 bp, Oryza sativa
attcctgcagcccaactagatcactggagctagcaggcatgtacctggaaacatttcaaacgctaggagttcgcaaccgtgccaactaacagtacttgtaatattgtcaacagaaggagaatcagaaatcaagtgactaatcgaggcatcgaaacgtggtgctaagtgttgcctacatctagcaggaacctaccctcacccgcacgctagtagacatgcgggtataataacaaacttaaacaaatatgccgcagacgaatcaaaaaccctctcaaaaagtgcaatccaatccaacacctacctaaaatatgggatccaggacacgatgggatagcgtcatcggaggcaggggaggggaggggaggggagcgggggggaatcgaggagtatactactcaccttcttatcgacgccggttgcggcggaggcggggacgggggcctgggcctggagcccctcgcggcgcttcttgaggaggctctcctcgcggcggctcttgcggatctccaccatgttgtcctcgcgccgccgcctcccctcctcggcgtccaccgccaccttgtagcggttccgccgcacctccacccgctcgctcgggcgcagcgacatggctggctcgccggctgggtgctctccccccctcctctcctcgcggcagcggcggcggcggagggagaggcaaaaaccctagcgaggcgtcggggcggaggaggagaggaaagaggaggagaaaccctagtggccgcggggaaagggggggagttaaagctcacacaccacgatccaaatattctctgcgatttattttctttttctttttttttaatctgcagagtctgccacaatgacctcttccgcgggccgcggc

SEQ ID NO: 64217 - DNA, 1132 bp, Oryza sativa
aaagtgaaaattacacgaatcatgatatattgggcagaagacatacctgaaccacaaagtatcttgtgctgccttgatcatcatcacaaatgaaccattcgcaaggacaagatcttgaagagttcagatcatctgcaacagcttgtcttgtttcttccttggcagcaaccatggaggtaactgaatttgtagtggccacaaatgaagcttcatccatggttaaaccttcaccactctcaccgtttacaatggccatgatggttggatcgttcttgccatcattcctggaaccaaagggaacgacgcccatagcccgtgaatgtaaataagaggcagcagacgacatgacatggtatgcgccgaaggggtttacccccaacccactttctttcttcttattgctccctggctcagggttctctacaacttcagattcttgatctgaagattcaccttcctcagtcttcagctcctgcttctgatcaacaccagttttggctttctcttgtactgatgaagtcacaaaccgcaaattgtacctccgcagcaattttggctgagaaagcaaacagttgctaagtcaggcaatgaaatactaatatcacacagaatgtcagaaaggaaacttgcaaattgcaatcataatctagttatgaggtactagaaaggtaattgtgtaattaacaacatcacgattaccacaccaaataagtatccatatgccagaagcagcagctcaagtgaagcaaccaattgaaagacaacaatagacaaatacaactcaggcacagatagctccaagagtataattgcattaagcagacctggcactaatccatcaaatccttcaggaagaccccactataaggtccaaaagcacataggggaccaggacgaataatcgataatggcataatgcataattttgcagaacagtaaaggaaattcttcactatctctgtaaaggaaatgcatagacaatacgtagtagaagccaaaacagactaaataagaattcttagtaacaccacaacctgcatttctcttgaatttacagcatggacaaggactcaaccatgaacagttcatcaccagcaatcgaattggcgtgtagacaatccaccaattattg

SEQ ID NO: 64218 - DNA, 4326 bp, Oryza sativa
caccaccgaccgcaccgaccctctcccctcctcctcctcctcctcctcctcctccgccgccgccgccgccaccgagcggccatagccggagcagcggcgcgtgcagaacgccccgcgacggctgctgctggtggtgccgctgcgccaccggaggcggtggcggctgcggagccgcggaggcggcggggctgatgccgcggacgaacctcagggcctccatggccgcctcctcctcctcctcctctcgcgaccgcgaggttgccgttaacaatagcggggttaagtttagccaaatcggcgatgatccccgtgtgctccaccactcgagatcaaccaaccaaccaaccaagttcactctcgactccggcgatcgacggcggcgggtggtggtgcgaggagaggagcagcaatggaggagagaaagaggatgggagggaggaggaggcctcctatatatgcggagacggcaacgccatgggagggaggtaggagagaggaaagagaggggtgggattgtttgtgggggaggagagagaaaccgtgaagaaaaatccgtccgtccccgggttgcttgctccgctctaatatctttggtaggctcgttttggcatcttgttgggttcctttcaccctctgatttgacgcattcacagtagttttactgtctgaatttggaattattgtaattttaggagtactctgtattctcacgcctatttcaaaagtcaatatatatactatgttaaggtgagtgaaattttattacgtataacaatcattattaacactacacgtaagcataaggtgtggtgatactgtactatttttaaacaaatactttcatacttttatatgtttttcttgccgtgttataattagtattttattttttaagaaaaactatgtggagtgtagaacgaacattttggtcagaggaaggtatgccatgttagtacgtttaccacgtgccaggacaacgttgtatgcgtacgagcgtatcggatacgagcgacacggcggaggctccatccgttttttgccacctaggccgagccgcagaagatcaggaggaggagtcacttccgtggacgcgtcgtccagcgacacatgccccgggacacgtcagcggatgagaacttctccgaggtatacgtggaggccttgcgtgccccatgcaggcgtgggcctcggttttatccacccacagccaccacaaatccacattgcgagatccggcccatcactggagtatgggccgagttaacttttgctgctgcgtaccatgtgcaagtgcgaatgggcttgagatccatctaccgttggatggtcggacacacacatttgaggaccttgaatagcccatctcccaccatcagcttaaatttttagattaagctgatcgatacatgtaacttaacatggtatcaaagctataggccttgagttcgtatgctgcctggcgagcctcgtgtaaggggagtgttggaatataaaatgaattgctcatcttttcccatcaatttaggtttttggattgaacttttcgatacatggttgaataactaattttgtgataactattcgaggctacaaacgaaagaattaaccattctaagctattcgagagtacaaacaaacgaattaattattacaaagttaaaaatacattaagatatttttctaagaaattcgtaataaatagttttctaaaaaaatattaccatttaggacacagggaagcgtaatagctgaataaaatggttccatctgaagaacacgacctgtgtgctcaactgtcaatagagacacaataacttcttgcaattatcctctgtgctgtttgacattttcttggttagtgaagaacagatgggtaaccgtgtacttagattggtgattacttgcacgaatcagtaaaaaagaaacattttctcggggaataaataccgtagttttcatcacgtcaggtacgtggtaggtttctcaacccaccagatttttcaaaacttgcccataaattcagtagcaagtaatcaacatgtcatttctgaaaatgataacataaataaaaatgattaattttgtgtagcaaacaggggtgaacgacgtacggaaacacggagcattagatcatcgccatgaaaattgagatcaggagatcggtagattatggtcaagattagttggccagcttttgggaaaaaatagatttatgctcaaatcagagcagaattaaggagattgatgcttagtggctactgtgttctgtactaccacccagtcacacacgttacacatgaaaaacagagaagcgtgcagcatgttttctgaatgcgaaatcgatccccgctattatatattcagagtttcagacaatcaggctggtgctatctatctacgcttgcatttcttcctcctgtcctatggcacataagaacgagcatgagaagttgtgaaaagtaattgacaagaacgataatggcttgggtctccatgacctggtgttggcacaggagcttcttgctcatgatggcgtgcgtctgcagctggtcgatcacttgctgcaaatcaggtttacactatgctgttgctgctcttttggtgtcatatctgaaactgaaatcgatttttgtttgcgtttttctgaattctgatgcatgcagacgaagcagcagcaggagccttccatggtcagaagaggagcactgaagacatcgtcgccagagctatcatctgcttcagcgatcgatatgtaagcacatcctcttagcaaacattgactgctcgtaatcaagcttgaacagtaattaacacagtttcagaccaaaagaaaaggagagaaagaattcgagaagaaaattaatgcacgctgtttctgattatgtgctgcgagaaatgtgttttcttgcagatcttcagcgggtgccaggggcagtacaggctggggccggagggcgcgctgcgcgtgccggcggcggcggcggaggcgttctgcggcgggccgtgcctggcggagacgaggctggtgctcggctgcgtcgacggcatcatggacagcttccgcttctacaacggcgcctccgtccgcgacgtccgcctcgcgctcgaccgcggctgcggcctccggggcgacttcgacgtgctgcggcgcctcgggggcgacggctacgactacggcggcgggccacgcggcctcgtgaccacgccggcgcctctgctgctgggcgccgtcgtcgcggtgcttctgtggggatgatcaatggtgattaaggaaattagaactagtttctggtgattatacatgtatgtagacagtacagtatagtatgtactctaccagagttaattaactgcagcactacggtaccagggcgtgtacgtacttcgagttagtcaaccgtatgtgagccttttttgtccattttgtagaatgtccaaggaccactgtgaatttgtttaagtgaaaaataaacaaatatttgctctttgattcaaaggatttaagtttttcaaatcttgtgaaattttaattgaatgacttattacatgtagattttagagaaaacttagcaaaagatccaacctcttagaaaaattcctttaagtttatatctctcattcgattcatatgtttttcctgcgatccaatagaacgatgtgtgtttctccgtgttttcaattcactattttacacttttcatttctatcataattttatgtatttttatttctctgtttttccattcctacgattgaaagagtagtgtccaatgtccttttaacaaaagaagttatttattttgtttattttattatctaagagttaaagtatttaaattagtacttcaacgttgagttgagccattggtacataattaattaaatataaattagtttaaatttaaaattttgattaatactatcttcatccaaaatataacaatttttagttataaatctggacacatactttcatagctaaaaatgtttatatttggaacgtagtgagtataattatcaggcgacaactatgagcgatatgcttgtcactccataccagctaacacgcgcggctatctatcttgctcgccgccacctgcgaagctgcggtgcatggttggtcgatttctgattgatgtcaggagtggcgtactagtgctgctcgttgtcgtcgttgcttgaacgcatcttcgtcgttctccccagcggcggcgacggcggcaccgcctcgtccaagggcggatgcagaaaatagcatgagcgggtgctaaggatctaccacttagatagactaaggatctaccgcttaggtagactgaggaaaca

SEQ ID NO: 64219 - DNA, 1477 bp, Oryza sativa
attcctgcagccctgattgatgtcaggagtggcgtaccagtgttgcccgtcatcgtcgtcgctcgaacgcatcttcgtcgttctcccccgcggcggtgacggcggtggccaccgccgtcggtggcggcgaagatgcggtgcatagttggtcgacttctgattgatgtcaggagtggcgtaccagtgctgttcgtcgtcgtcgtcgcttgaacgcatctttgtcgttctcccccacggtggtgacagcggccgccgctgtcggtggcggcgaagctgcggttcgtagttggtcgacttctgattgatgtcaggagtggcgtgcgtaccagtgctgttcgtcgtcgtcatcgctcgaacgcatcttcgtcgttctcccccacggtggtgacggcggccgccgctgtcggtggcggcgaagctgcggttcgtagttggtcgacttctgattgatgtcagtaatggtgtaccagtgctgcacattgtcgtcgctcgaacacatctccatcgttctcccctgcgccggtgacggcgccgccgcctcgtctaggtaacatttaaatataatttttttttgaaaaaacgcgtgcattcggaaaaaagggaaacaaattgaaaatataccgtttattttttttctctcaaaatattcggatgtaattttagtcgcacaaacataccgttgatactgtcgtctcgcacggtgagagcgggacctaattagcgagaccgacagcctcgccgttaatcactgattaattagtgattaattatcttgattagcaattaattaattattaattggataattaatcactaattattattaattaatcgctgatcagtctatttccaaaacgctgtcgcaccctcacgatgcgagaccgctcccacatcagtttgccaaaaaaaaaatacatcaataatattactgaggaaaaaaatatatgaacggtatattttcaaatttaattcaaaacgagagtccgctgctctcaaacgcaggaggttggttagtggcaggaaagagtattggtgttttggcgcgaaaagagtcgagagggcgcggagccttggcgccactaattcagggagtgggtggcagtttcgtaataaaacttgtttattttccgcgagctcccagaattccgtagaccctctcctgctgcgtgcgtccccaaatcaggagtcctcccaaccctcgccaccggcgccgtccgccccatctccgacgccgcctccccccgaagcgaagcaggtacacgccacctccaactcttccctcttcctcctgtttattcgatggcctcacgcttaggtccatctctgcagtagatctgatcgctaggtcctcctgtttaggactagggtatcagtatcaggtatggctggagagaacggcaaatttccttggctggattttcttaggaggggaactagtggtgatcaaggagggaaccacatcgattttcctgtcgca

SEQ ID NO: 64220 - DNA, 2608 bp, Oryza sativa
tacatcaggacctgcagcattcgtcaatggagagattctgaagatgttcgtcggccgaagagtgcgcacggtggtccaagcccagcgcgaggaaggcgggttgcttatcgggcagtccaccgatggtcatcagctaaccatcaaaggggcctccggtgcccctatgtcgcactatgtggagattattgggatcgctgaacccaatcaggccatccgggctgaagtttgcacagattttggtgaaaacttcggtgagaattgttgcgcctcgcattcttttcctccagtaaatagtactatgaattgttagtctgtacagtttgttatcttttacataaatccagacagtgcctgtatcttgcctattctgatgctcccccaccaatggttttttaacatgttacatagtgattggggttcgttattcttgtgttctatattttcttgagcaaaaaaatgtacagttcgcataaaaatcatactttcataagtacgttttgttacatttttcatcgtattcatgcttacaagagcaaatttctgcctttgtaaatgtgtagctgtttgtgttctatacgaattcccaaatccagaagcattcaaaaactaatattgattgtttaattgttggactttttttacctacagccaaatttgactttagttgtatgggaacttcaatctcacccctatttgtgtcaaatttgtgtctgattgatcatagagtagattttaggatgacatgcactcttgtctggttggtaaaatgtagcttttgaagctcatgggcttaacttctgggaatgagcgatttgcgattgatcatctagagtagatttcaggtggaaaaacattcttcaactaagttgaaaatgtagctcttgaagttcatgagtatacttctgggaatgaaaagctattttagcttatatgcccaatgttacagcgtttctttgtatcaattaataaaataatctcaatcaacgtttcttttgttctcgtctgacacaggacaactagtatgtggtgctaaatctttacatttgctgcaagaattttatcttagacaccctcattacaccattgatctctctatcatgtttgtctgcagatcctgcaccattcaatggactgtgcaagcttgcgaatggccagatgaaggatttgttcctgtagaggtcggcatcacatacaagacattctgccaacaaagcatgtctcatgttcatgatttctctagctttaagatccgtccaactgtttttgtcagtcatctcagtataatcaagctacttagggtcagtattggtgcttattaagacatattaaccttaagctatgtgaggacaagcgtgtgcttttgttgctgaagagcttgtggtgtttgctccttctaagcaaagcaaaccaaagcgttgtgctgcattgttactgtcgcttgcatttggatccttgaaagctgtgtttcttgttatgctctccggtgcatcttgatgaagtgagctagtatgatgctttctgatgaatttcaacatatcaacatagtaacccaaagtttcaaattaactgcatgctcattgtcctgatgcaagcatattactttgattcatttgttttctgtttataaggcgctttggtggttgtttccgactaattttgcacgcatccacccaaacttgggtcgtttgcagcatatatatgctcacttctaaaaaaacaattaaaatgaaggtcgtgactgataagtctgaacattaatcattcatcctcttcttggaacaaaaatcttttcaagcattcaagatcaaaatgcttcttccttgataggagtggattggtattgtgtcactctcgtacctatcacagcgattacgaggcctcatctttttttcacttaaccatagaaacatggtatcttggttatgctatgaacaaatcaaagagacaaaaggaaaaggtttcgtttgggctcctcattcgtgtctcactgcgtttgttaactactaccgacttcagtgtcttcgccgacagactacttgcatcaacaactacttgaaaacacaatggtgatgatgatgatgatgacaattgtcaggctaatctgtttttgaaagcaaaaggcatgacaatttcactgtattaattgaggaggaatatcacctataagagttttttttaatgaatgatatatttcaccacacgcacactaaaaataagcactttattagatcatgcagaaaataacaagaattagtggtattaagttcccatcaaagtaccaaaccaaaggccaaaagatcaatgtagccagtcaaatgcatcacagtgatttgtacagttgtactaatgcacatctgaagtgatggatcaatgtagcattgccacaaaaagatagaaacaaacagagcaaaattttaatttacatcctttgttttccttttcttttttcatgcaagccctcgcaagattacgtaaagtgctatttgaacttcaaaatgtggcgatttggtagttttccctttgaaggcgggttttcgcgtttacgcttttacccagaggaaagcggatgcattgacttggcaagcccgtagctccgggccccgaaccc

SEQ ID NO: 64221 - DNA, 2731 bp, Oryza sativa
ttcctcctgctccccgaagcccgcctcctcctggagtatgggcgagaggcacccgacgcggatgcgccccgcgacgaacagctcctcggccgagctcatcgccgcggccccattccctgcaccatgctggcgcgcggcgaactctcagtccccccccccgccgccgccgcatccgtggtcaccgtccacgcccggagcatagtgcgccgccgccgccgtcgtcgtcgtcgtggaggacggcggcgagcggaggatgtagtgcacggggctggccggggcgctgaagaagaagaactgctcgctgccgccgccgtcatcgtcagcgtcgtcgacgtcgtccttcccggcgcagcggcggcgcgtggggcttgacggcgccgtggcggcggggctcccggcggcggcgtgggcgtggctcagcatcggcggcggcggcggagtgaagggaagggaaggcgaggcgagattttgaaggagacgtgggtaagcggagtggttagcggccgggggggaggtatttgtaactgtgcgcgcgcgagtctcgatcgtgggcccagactcgcgctactacgtggggcccgtggcatttaggtaaataaatgatcatttctatttcgtatttatttcgaaatttctaaagtatagaccgaaagaaatttctaaagtttagaccgaaagaaaaaacaaatcataatttaggccgaacgaaagaaaggtgaagatatagggtgtgattggttactggccacaatttactataactaacattagataaattgtgacagtcacaaaagtgtggtgaataaattgctaaccacaaagtgtagcaaagttgacaagaaaatctagtttacgacatgtgggatatgctattgaaaaaatatggcaagtcacaatcaaatggctggctaacaaactgtggtagctaaaactgtggtatggcaaagtgtattccttagtatcaagattgttcttgaattgttgtgagaggagttgcgagaaatgatgagatcgagtgtgaatagttatatttggattaattggtaaatttaggttgtatcatcgaaaccttcgtatgccttttgtacactaaatgagctaatactaaagcacacgtcgccatgcatcatacttgatctattccaaaatgttaagcaacaaactaatgtttgatcagttccaatatttcaaaacgagtgcaatctagcattcgagctgtgtagtgacagtgtgacacacacataagagcttagtgctgagcctttctcaacggcttaattgcgcgtgtagtttataactaattaattactactaatcaatctttatatactaccttaaattcggcggggtcaacaattctttatatgcaggcttcgatgaacgtggcgagcacctgcatgcacatatgcaggctggcacgcacaaacgagaattttttttttttgagggaaacacaaacgagaataattatttacttaattagtgcgaaaaatacaaacacgaacacggtcgagacagtggagaaaagtgagaggaattaaacaaccaacgtcaacagcaacaacacgtagcgcccatgtatagatgtatagtacaggtggtgacgagcaatataatacggagtatatctagctctctcacagagaaaaaaagaaaaggagaagtgtatttgcgagtaatctacgggcacatttaattttatgggagaagcggctataatatatctagatcgagtgtatatcagtactatataggagtgaatcgtagattaatttgtagtggtggaacgtacgtgggtgccaaagttttggcaaaccgctccttcgcaaaagctacatgttagttattaaaataaaaagcacaaaatacaccagtgatatgatggtaaaatcgtagattcatgacttcaactatcacggtttaaattaatcccaatactcacaaatattacacgtacatgtaaattgattttcaatgaggatgtgtcactgatgtccgtctatttgaacgtgtgtacatgcatgtagtggtagtttcaaattactttttattttatttttttcctaagtaaaatttattggctttcaccatcaattaataaattaatgtaaataatatttatggttttagattcatcataagaaatattttcatatcatattatttacatgttaaattatatattttttaggaattaatggataaagttagaaatatttgacttaattatattaggatacatgataagtaatcagaaatgaagggagtatataaatttatgttgtagtttacgtgaaccagcgtgtacattacgaatattaggtacggtgtgcagtgccgttttgatcttgatttcacacataacacaagttcattttgatacatcaacaactttattaaagcatgtgtaagtatagttgtgtgtgtcttttatgtaaatgagaaaaaaaaaactagaagcaaattgagatggaactgttaggatttcttctagccctgatccacatgtatgtcctggaacgatgacagacgcgcgtggcgtgagttcaggtcacatttttctctacaagcataaataaagttgtaggcctcctttcgctttttctccgagagatatcgagacaccctaactaaactatcaaagtaatccttggattgcaagtccaaaaaaggccacatatttggattgagcgagacgatcggtcgatgatttcgaagcctgtcggcttaa

SEQ ID NO: 64222 - DNA, 4321 bp, Oryza sativa
attcctgcacccgcatgggtctgggtcagaggcaggatgatcacttgcagctagcaactcgccttcacgtagcaaattgcaaaaggaatggaagaaagtgatgggcgataaggatttttcgacttgttcaaagtctttctcgaacgatgtgttaattatagttcagtcctcgtcgatctgggtactctcttgtttaaggtaatacgttttatttatgtttttttgcaaaaaaaaaatccctttttttttatcgggaacatgagcttgtgtagcaagatgatgttgtacgtgagtattggaacaaaatggcccaatcatctcctctcagcccaagtagttgttttgggtttggattagggccgttagcctgacgaggccttttcagtttgtacggtctaggtaaccattgaataagccaaatgacatatttgcaaacgagaagtaacttttaaataaaataagccaaatgatatatttgcaaatgataagtaatttttaaataaaacttttatatgtgtgtccttagcgacctaaaagtaaatggtgaaaaataaacttcgatgataaaaacttagaaatcagcttcaaatttaagtttgaaaatttaaattttggccgataagtataagtataaccgaaaaagtggggcctgtaaattatctgcgagatttatgctggcagtccactcgtcagcgaaaaccgccgacagctgttgctgctggattttgaagcgtgattcctatagcggtccattttgaatggacaccattgatacgaacagatcatttcgattttgtatgggatacaaccgtatccgacgaatcgccgatctcatttttgtttcttttttcttttactctaggcggcggttttagtaggcgttggatgaaagagcaacattacaaagggtacaaccagagttcataaaaaccgtgcggttatcaaaacttttcaacttttgaaaccatggtaaatctcacgaaaatcacatagttaccacgataactgatccacggttacctcaaccaaaatagtttggtgaaccctgagtacaactacaccaatatcgttatgtttcttgtttgatgcaaaggccattctctctggtactataaaagcagagtcgccattctctctagtactataaaagcagagtcgccatctgccattccgttcgtgcgcatgtttgcacactccacgtgagtaacaatacaatgctttatcatcaatcatcatcctagactatccctaattatatgagcatggtccattacattgtataagtacttctactacatatacttaaaaaatatctttataggattcttacgaataataaacataattgttttgatttaactagatgaaaattacggaaaatctaaaatttagacatacttacaagttagcacgataattggtgctagtgagagtttagtaaaaagaaaaaagaaagtactacatatacaacagaactcacactaccaaggcttctgcagctaaattgttgctaagcgcttgctcacatatattctccttaatggatataaatcctcttcgaagacagatctaaaccctcgtatcctctctccgttgccttgccgccgcccgagtaggtcactggccagtcgagcggctgctaggaaggcggtggcggggttgttactcggcaaggaccttgcatcctatgttgcgacgaagtggggctgtcgagtctggggttcccgtccacagatttggcagtagcacaggagacggcagggaggtgggcagcggaggcatagcgacgatgggcgggcccacgcctagccacgtgggttggtgtcgggaacggaagtggtcaggagggcggcgggtagcggtgaggctacagtagcggcgtccctttgggcaacggcgggtgtggcgaaggatggtggcagcctaagcgttgatggtcagtcctcggcagggaaaaggtggatccggtggacgtggtccctaggcagtggtggcgggctgggagtccaggaggcggaggaggattccgtcaacggttacggccctatggatgacagaggcataggaatccagcaaagtggaagcgaatcctatcaacttgcgtttggtcggctaattctaactagatgatgatgaatgaaggtgggctaagcggtggtgtatggcgtcagctcacttcaagcggatgaagatggcatcagcgaaggttcgcaactatggcacaattgggcagcggcgactagtcgactaccacttgccaaatctagccgtttcaagagaggatgtcgagaggcagggttgtaccgaggtcgtaggtttttcttgcttcttcttcttcttctttttcttcttctttgttgttgttgttgttgtgtgttcttctctttgttgaggtgtgagctatacttttggttatatatatccttcgtggatgtaaagattggattaatgaaaatccattaacttaaaaaaaatctgcaaatgactactggggaaaagtaattcagcattatcaaagcaagataaaagaaaaaagaacaactttgtataacatggctacatcacatgtccacactcttctgttgaagaattgaggtgcaggatcagttgggagtgtgagctgattcatcagcaactcgtagccaaacccaacctttacaagccctctcgattcgctgcctcgttggcaccggaaggcgctctcgcctctccaaagcgaatcaaatcgatcgatcgctttccccgccaaaaagcaaggcatgcacagcctcgctgaaagcaaaccgaatccgaatgtcgccctccacctccaccgcacggaaaccctcgcccggcgtggattccttcccttcccaccgctgcaacccaccattattctcctccgggcaccacgtcgaacaccttatatacgccggcaaaagcgaagcgatccgcaggcgaaatccttttgattatattcgttggtgtggttgagctcgtcggggtgagtaactagcatcgatgcaggcggcgatgccggcggcggtgacgcacgacgacctgtcgctgcggaaggcgcaggagaggcgggcggcgcggtcgagcgggcgggcggcggtggcgctggtgtcgctctcggtgctctgcggcatcgtcggcttcatcctctgcctcgccgccgaggggtcgcgctccgaggcgtcgcactacctcatgaccgtcggcggcggcggcgccaacgcggcggcgaacaacgggcaggtggacgtctgcttctacaactccagcggccgggcgccgctggcgttcgccatcggggcgttcctgatgctcgccgtcgccatgttcgccgagcacgcctacatgctgctcgccgtcgccgcgccggactcgtccgcggcggggctcgccgtcgccgagggacacccgcgcgtcccctccgaccccgccaggctcacctggcagacctgctgcctcttcttcgtcacctggtacgtcaatgactagtctaccgccattgatgacgccatgattggggtttcgaactaacgctcgatcgtcgctgctgcggcgcaggatctgcttcgggctcgcggaggtgatgctcatggtcggcatcgcggtggagtccggccacgtcagcgactggaggaagccgcgggcggtgtgccaccgggtgcgcccgggggtgttcgcggcggcgggaatcctgggactcatcaccgtcgtcgtcggcttcgtcgtctacgtcacggccctgcagacgaacaagctgcgggcgcagcaccccgtcggcggctactacgtcggccacggcgccccacacccgggcatgccgccgccgccgatgccgtacggcccgcacccgcacccacaccagccgccgccgccggcagcggcggcgacagcgccaagcgcgccggagatcacgccggccgcttgccaggtccagccaagccgagcggcgtgcgtcaccaagcagtgcgctgatgcagtttgaaacgagtagaagaatttggagattaagcagagacggtgatgtttaaaaggcatctactcttttccgcgtaacatgttctttcgtgatttgctatattagagcatttgatttgagttatttgcttgtatgtcacaccatttgtttttagcacaaacatgatttgaattgtaaagcacttgattcgtgattacatctcaacaagtttcaatttaatttacttggtctattagcctccgctgtatcattattcggaaatacgtgcagcatccatcacaaacaggtagaccggagttacagctccttggtggtaagcacggttatcacgcagtaaccgcagtaaac

SEQ ID NO: 64223 - DNA, 786 bp, Oryza sativa
acaccatactaaaagatgcaaacactacatagtagtagcctgatgaaaaacgcagacttcaaagctttaatccctgttacagacgtagtgatatgatatccgtgaccagtagggaaataatgtaacactggcccccttgaaacctttagcttattgaaccaccagaacaattcagtaccccgcacagtggccacaatttaccacctctggtcaaatctgtcgaggaaatttgaaatcattacttgttgcctcaagtgaatgataccagaacagaaaggatttatggtaagagtggaaacaacccacaataaacacaaaccatgttgaggattgagagtacctgtatttatttgaattgagcagcaccaccgccttggccaaagtcaaaagtagcaccttggggagcagctaccgtggtagctcccattgtatcatcctcctcatccatccagtaggcctcaagaatcttcacagctttttcatagatctcattgttatcatggctctgcaagttctcaatcttttccaaaccttccgcttcatcaatcatctgggaaaagacattcacatcacctgcagccaaggtcttgtcggtttctcctactttaagaatgttctcgagaccctccaaacaaactgtaacgattcttatatctgggcaaataagaagatcacacaatggcttgatgcagccctcgctcaccagatacctattttaacaaaccatacaatatcaaatccaaatgaagcttaacatgaaactatgaaagcgggggctgcaggaat

SEQ ID NO: 64224 - DNA, 1552 bp, Oryza sativa
cccattctttgatgagcttcgagaccctaatgctcgccttccgaatggccgctttttgcctcctctcttcaacttcaagcctcatggtaagttgtgaaacatgatcacatttatccttgttgatattaccagttaaagtttgttcaagcaggcacttcaattgttctggttatttccgttgtaaacttacaatttgggagctgcaagtcataactttctgatatgatcagctacttacgttgcccctttcttgtttcttgcagaactgaaaggaatcccatcagatattatggcgaaattgatcccagaacatgtgaagaagcaatgctcctatgcaggagtatgagacagcttccgcacgacccccctggaaatttccatgacaagtgcccatttcctcccccctggacgacgatggatcgtcagcatatgcgtgcatgatggttggtgaagatgtgaagttacgttgttgttgtatgaccaccttgttgaccagtgtagttgagtagcagtatgttgcgatggcgaaactttgacatgtaaccggtgcacccacaccatccctcccctactaaccctcacccacctgagaattgagaattcccatagctgatgatctgtaatatgttctagagcagtttaagaatgtatttattatggtgtagttgatccatatgttgggatcctcctcgtcgattttcttggttctttgtgccctagactgctacctggtttttagactgttctgaaaatgctgctagtaccttctatctactgtacttgtttgctccttggtgctattgctccagcctcagctatgaggatgctctggcatatgaacgtatggacaagttcgtcgatgacctgaccttggtagttttacctgtgttcgagttgtgctggtccaggtgtttggctgcgttgcaaggtgtgcaagtttggttcgtccgcagaggtcatctaaatgctgttaggagtctgctaacactacttgctcttggaaagttgtaggggctcattttggacgtagaaatttcacaagattttagcacgaatcagttcagttcagttacggaattcgtctaaaattaattgatttctacagatttcgcttgaaatttcgttcgttccaaaaggaggcgttccgtttcttgcagaaattaacttctctaaaatctagcgttcctttgctactccgtagtttccgtcgaataatgtaaaatataatcgaaatgtaaaattcaaatgtactgttgttcatgaacactttgtactcttcagtctcttttcgcccaacagcagaaactgctggagggagaagatcagaattcagaagagttgtcgagagagagaagagaagccgcggaagggggaaaaaagggaggcggcggaaggggatcggagatgccgctgggcaagtactactgcgactactgcgagaagcagttccaggacacccccgccgcccgcaagcgccacctcgacggcgcccagcaccaccgcgcccgcgccctctggtacgacgccgtccgccgccaaggttgccccccca

SEQ ID NO: 64225 - DNA, 917 bp, Oryza sativa
aaattagattaaaaactgtggataggacttaagttctgacttgcccttttattatccaggccctgtctctggaccaatggcgcagcagtctaatattcaaggaagtcaacccaattttgttggatatcaggcagcagatggaagttctttctcaggtgatctgattatggcacactcagcaaaaaataatattgttacagctagctggagtagtgcagaaaattgaatggctctcactgcttcctcccaactgatgattggattttattccaacacaacttctcgttttctgttctaattaatttaggatctggtttttagttcttacataactttctccattcagcttggattaaatcaatgaatggagacatttggtagttattatatgttagtcaagcacatcattattaaaatatgaacttaatgtcttgactctcgaccatagctgccgcaacgagtcgtaaaatggactctatatattacctttactctcgccttttttttgttgcaatatagtaaggtccaacgtgcattcatagcatattttaggtaggttgcttttgtagcatgccatgccacagctattggacctgtgaaacattattgtatagataatgtaaaatggggatagaagtgaatgaaaaaaatggttttctctatttattcagcatgttttccatccagtcacctgtcatgccatgaataggacactttgcacctgccaggttgccatgcaatcattggatgtactcctttatccatgtaggtccaatggttggtgctactaatgtggtgcgatgtttctaggcaatttgattgcatctctgtctgtcggttggtctcttttattgatgaatgaggggctagatactatgacatttaaatagtttggcttaccctagaatctgtggtca

SEQ ID NO: 64226 - DNA, 1531 bp, Oryza sativa
ccttttgtagactggggttgaattgcttgttaatctgaaggtgccatatgttgaaacttcatgccggctatgcaatagttcaaacacacaatgaattttactattgctctctacaaatgggtttatattagctgtgagaatgctctcatatgcagtggaacctgtacctctagtgaactgggagcctggttttcacttaaaatgctcctattaggaagtgatccctctttgtagttaaaattgtgttgtccgaagggagaagactaaaggatgtagctcccctgatctacgtggcctccaagaaaaagaacagcacgctacaacagacctcagccacagaccagtggctgctcgatctagaccttcctccagcctcaagctggacaacggagctggtcagccagctaatcaatgtctggagtgcagtgcacaacgtgcatttcacagagaatgaggaggacaagatagtgtggaagctcactagccacggtgaatataaggcgacgtcggcctacaaagcgcagctcctaggtactactgccaccaactttaacatcctaatatggaagccgtgggcaccgcgcaagtgcaagacctttgcctggttgatcatccaaaatagagtttggacctccgacagactggcaaccaggggttggcagaacaactctttctgccccttatgcagacacacccaagaaactgctctccacctcctcgcagaatgcagatacaccaggaaaatttgggcggcgttatctgattggactaggtgtggtcaactgaaccctggacaatggcaaccagctcaatcggtgttagagtggtgggaggccaccgccaacttgaaggaagtcccaaagaaagcactccgcacgttaacacttctggtcaactgggaaatctggaacgagagaaatcgtagaattttccagcacaaagagctatctacaggaagtctgttggccaaaattaaagaggaggccaaaacatggtctcgggcgggggcgaggcatcttggtagctggcttgctttttatttttagctcagtaggaccgaaggtcctgggcctggtttttcttactcgtaaagtttactccttctctattcaatgaaattggcagcttgccgattcgttcaaaaaaaaaattgtgttgtccagcctccttttggcactgtcaggtctgtaattgaatgggctggaaacctggatgggcagggattctagcccatcaacattatgcttccataagatatgttacacttaaacctagttactgaggtttcaattttggtctccatttaccaaccaacttttttaaatttgtagaaggcgtgttctataatctgggattttggccaattcacagtgccaattgtgcgtcagcaatcaggaagattgcatcactcatcagcctgacaaattttgcctacaataagggactaggctcatctgacgtaaagtcagagggacatggccactgacgtatgggcccatgaaggtgggccccacatgtcagggacccacgt

SEQ ID NO: 64227 - DNA, 3821 bp, Oryza sativa
tgagcttttaagttgtttgtttagaggtttcaggtaaatctggatttcttgcaaggaatttgcactgttcttgcaaggatatttttgctggtgggtcacagaaaggttgtgacaagggtttggttgttctggggctctgctagtgtggactctaggtgaacagaatcattaggcgaatgctgtaaatcgaaatatctgctagttcttcagtttgttcatccaacattctagttgtgcttttaggtgaaaaggatagccctttatgcatgcacaatgttctgtccttctctgtctgaatttttctctcggtttagcacatagttttgcactgcatgatttggtacagtgttacctaactgaataactgaattctattctcaattcgttcaattcgtgcactgcattagcaggtgaagtatacgccatgaccaagctctttgttggtcataccaactgctgatccaggcccagtacagctcgttttcttctacaaatggcacaaaaatgactgcaatgtttgctctctctgcatctcgttgatacatataacaattagcaagatatattatcagtcgtgtcaataccagttagtctgacaaactaaataaaacccttcagaatatgacacttgtgctcattctcatatgataatacgcctttctgtatttcttgtatgttctaaggcaaaatttgctacaggacaccgaaagattggaccctttattgtgagatacccgaagatcgtgtatttgctcgtggtcacttaaaaaatgtggtaattagctggcggacattggccgcattattttattattttcggtggaaacggagagagaaactttggttaaagacaagtttgcctatggtcaatctctctttctctattcttcttcttcctctctttctgtgtgtcgttggaccctcagctccccagccccggcggcgagcgacatgcatgcgtcgggcggagcgaacagccgctgaatccaggcaccacgatgggcagcggagagggcagcgacgggctggatcacgggctgcttgcttcttgcttgaagatgagaaaccaaaattctgctgcttgaggacgaaccaaacgacaaggagggcttgctgctgctaacaggtggcgtgagttggatggaattgccgcgccggcggcgggtagagcgatgacgacgagccgcggcgaggcctgacgggcagaccgcgatggacggcgtggacggccgactggatctgacgacctccgcacggatcgggccactctcgttgaacgcttgaactcgccgttgcggatccgacggggatggcgacggcggtgtcgaagtcagtggctaagccgcatctcaggttgcccaccaccgcgcagccgctgccatgaccgactgccgcctcccgccagccgatctcctcctccgttgctccccttcctattccctttcaccataggctttgcctcaccgaggagagtccgttttcccctttcccctctccctccacctctgagccagaccaccaccgccaccaccatagccagccggagctgagctctttgtgttgctgttccggctatctccttctcccctttgcttgacaccaccctccccggatgcgcgtcgctcaagaacatcatccgccaccaacgtagccgatccccggccaccggagcaccaacgccctactctctccctctcctctgttactcggctggaagcgggaagaagaacagtgtttaggggcattttgttacttacacaacgctttctctctctattttaaccggaaataataaaataataggagaaatgtgcagcagctaattaccactatttatagtacccatgaaaagatcacgatcttcaggtgtctcatagcaaagtctgcaatctttcggtgtcctgtagtaaattttgccatgttctatgagctcccaaataaacggattccaaaaaaaaatgagaaaattgactgttttgcttgctcagtagtcagtagcggagtcgaaataagaaacacaaaaaaatcactactgatggagaggctgaatatagttgcattatttctttttttttttaaaaaaaaaacttaaattcatactaactcaaggcttgttcagttcattgaaaaaaaaaaaaccttaccatttgttggtgtagacaaaatttagcaagattaagggcctgttcactttgatgccattttcaaccttaccaaattttgataaagttgctaaaaaagtggctacatttagtttgttgccaaattttggtaactatataagaaatcctgccaaaattttggcaagttgccaaaatggtaatgccaaaatttggtaaggttttttttatatcaatgtaaacaggccctaatatatgaaggtggtctttagtttgatacattacaaaattttggcatagttttgtgagtagaagtttctagaattaccaaatgttggtagcaatagtgaaagttgtgatggtaaaatcttgtttagtttgttgtcttatcaaaatttggcaatatcaatttttttagagaatggcaatataaaaatttggtatggttgattttggtaacaaactgaacgccctcaagtgcatttttcaaacggtgtcggggctagccctctggattgagatcaagcacattgccataactttggggtattttcagccctccgatctacagcgaacgaacgagagtaatcgctacagtatactacagtatatcgtgaatagtaccctggtacaatacatttgtctacagtaaacaactgcatatcactattgcatactgtaacatcagactcattttactgtgcgtctctaccatttgctcctaaggtcagaggagccggatcctagtcctccggcctccctccacaccttgctgtccaagctataaatgatatggcatcattgacgattgatcttaagaaaatgacactagattcagatattagaattatataatgaacacaatcagtactaatttctgaatatggaatatgtcatggtaacaatctgtgcaatcgcaaattaaccagcaagttatctcaaaggagagatatacagtttcaacaaaagaaacaaaatcagaaaattggcaattgagcagccacgttggttatctgcaagaatgacatttgaaaactaggtcagcatgccaataacacaacagcaaaacaaaagaaaggggaaaattatgagaaattggcaaaacaaagtttaatcaaaatcaagttccttttcctgatcattagtctcagcagctctcttttctaatgattctgtatcttcctagacagattttcatagctcatgaccctaggcctgcttttgccaagaaatattgagaagttgtagttgtacaaatttaattggcacacaagatgcctcaccttaagagattaaaaattatactcatttcatttcgtttcaggttataaaatgttttgactttggtcaaagtcaaactgtttcaaatttaactaagtttatagacaaatatagtaatatttacattaccaaattaattttattaaattaataattaaatataattttataataaatttatcttggataaaaaatattactattttttctataattttgatcaaacttgaagcggtttgacttcaaagggagggagtagcagtcatcgtccttgcaactgtattaggacacctggcccaagatcctacggacgaaagagtgaaagatcagagcccaaaaatagagaaaatctatcctacagtattccgtctcttcccttctttctgtgtctcttcccctccactcacgggctgcaggaat

SEQ ID NO: 64228 - DNA, 3749 bp, Oryza sativa
aatctctcgggattttagttatcccgtgactgctaggagcaacggaataccgtggggtagcagccctccaaaaatatgcgcatgtgaagtagcaaaaccgaaaaaaaaaattggcaccatatttttttagcaaaactgtaccggagctgagcaccgttggatccaaatcaaccgtgggcagatgtactgctttacaacgggtggcactggtaaagccccacaggataacacacccgatgcgcgccaagctcgccgtgccggtcccctcgccggcgccgccgcggccgccctccgtcacgttccgctgcctccgccccagaacaccacccacccgtgcgcccgccacacccgcgcgcgcccttgggaacggcggcggcggcggcggtggcggtagccccctgggacgcgcatggccgggcgtcgccgccgcgctcttcggcgccgggttcgtcctcggcccgctcctcgacggcatccactcccgcgtcggcctccagctctaccacaacggcgccgtcgatgtcggccccctccacacgcacatcctggtgatgaccggcgacgcgttcacatcctccatccattaacgattctttgcatctttgctctgctcttcgccggagttgctgaaccgtggtcgccgtgccggcgcaggtgccgccgctgctcggagcgttctactccaccgtcgggatgctccagctgttcttggacgagagggtgtcgccgccggcggcggcggcgggcggatcgaaggccaccgggagcccgcagaagacggcggcgtcgctagtgttcgtccatgtccatgctgtgtgcacatcttcgccaccactgatgattcgtttctctggtgactaatgatctccgatcgccgccgccgccggtgcaggttcctggcggtgttcatcgaggcgagcgcggagatgtacagggcgggggtgcccagcaacgtggaggcgtacgtgctgttcgccggcgccgagctcgcgtggctgctcctcgacggcacctggctgggcttcgccgtcgcgtgcctcgtcggcaccgcctgccccctcgccgagatcccactgatcaagtacacatatatagctactagccacctcccacattcttgattctctcttccccccatcaatggcgtcgcgtcgagctcgcgcctagcttgattgattgatctcaccaacgattgcccgccgcatcgtgcgcaggttgttcgactgctggagctaccccaacgccgacgtccagcttcttggcgaggtaaagaacacccgcatcttctcactccctgaagcggccgccattggtgggagctgagctgagcatggttgcgtgcaggggatcgtgagctggacgacgacgtgctacttcgtgtacacgccgttcttggcgaacctggcgagatgggtcaaggcggagctggcggtggacgacgcagctcggtgacggtgaaagcgagcaagatcacaccaccagccatggtgtccaactgatgtgttcattctctgctcggatcagccgctgcccacactggacaacacgcacctgcaggactgagacaattgcagtggaaatcacgcagatcaatgtagagagagatagttgctgaatctcttggggatctgaacatttgacctgaagctaaggtgggattaagtttcatggcccagaattgatctctctcaagtctcaagtaatcgacgttccccatccgtacttctcgatttaactctgtcctaaatcaaatacttttaactttaccatcaatttataaaaagtgatatagtttgacagcatgtggattatatatcatggttactaaaaacataaatcttacctcctccgtttcaaaatatggcaacctaagagaggattagacgcaacctagtataatgtatctatatttgggacggaaggagtctagtgttaaactatataaatttttagaaccgacgataaagttaactatgtgacttactacaaagctgaaacaataagtgatttgaacatagcaagtataatttaaataagattggggggaggggggtaattagcaactgtaatcgatgaactatccatcatcggcacctctgttaatttggaccccatttgtcatttggcaaccacacacgctactactccctctattccaaaatgtttgacgtcgttgacttttttaaacatgtttgaccgttcgtcttatcaaaaaatttaagtaattattaattattttcctatcatttgattcattgttaaatatacttttatgtatacatatagttttacatatttcacaaaagtttttgaataagacgaacggtcaaacatgtttaaaaaagtcaacggcgtcaaacatttagggaaggagggagtataattgatccgctcagtcaaagcccgctgcctccgctcccaagtctggcggtggcagatccgatcctcctgaggccaccgccgccagatctgacaatggagaaggagaggcgaagggaggtcagccgttcccgagtctggcggtggcggatctcccaaggccgtcaccgccagatggacgacagagagggagagacaagggaggccggccgatctcaagtccagtggcggtgtatccacacaacccgtggtcgccgccgctggatcaacaatgaagaggaagaagtgagggaggttggctgctccgaggccgacgaaggcgaatccacccctcccatcgctggcagtggcagatccaccgccggtggccgtccccgttgccgacatcgatgtgtgccacactatcggacctgcctccgcacaccgaactatcatcgatgctgagcttctgccgagaaagagagagggaggaggacgaggatgaggtgatggagataaggtggagaggaagtggaggagaggtggagtggagaggatgaggggagagagagagagggggaactgaaatatttaaaggatgagctcaacctgatgatgggtttgtggcatgcaggcctctcaactgacccgtctgcgaaatatgtttattttcacaaacgattcttgaaccgtcaggatggttcttatctggagaaatcaattatgtagcagtgcgatacatacaaattttgaagtcctaaaaaaatcatctatttagaacggacgtagtactttttttctacgaacttctgtacgcaagatcattgaaatgccgtctcatgagtcatgatccaacgtcatgcatgtatgtaagtacaccacatactccctccttccctaaatatttaacaccattaatttttctaaacatgcttgaccattcgtcttattaaaatttttttgtgaatattattcaaaaacttaagtagtgtatatttaacaatgaatcaaatgaagaattaaaatttacttaaattttttgaataagacgaatgatcaaacatgtgtaaaaaagtcaatggcgtcaaatatttagtgacggatagattacacacaattaaaagatgccattactttacacgctgaaaatgatcggcgtctatataagaaggtaatctaacacggacagccaacgactacgagacgcgaggttgaagacaagtaagtactcctacatgcaacacccagacagagactagggcaacgcacgctagctctcgatcgagcaccatgccgaccaatctctcctcctcctactcctcactcttcgagccactcctcgccctctcctccctcctcctccgccgcctctccgccgccgtccgccacca

SEQ ID NO: 64229 - DNA, 4680 bp, Oryza sativa
cgctcgagctcgacaggctgtacggacggacggtggtggtggacgtggacgcgtggctgctgctgccggccgtggacgcgttcaccttcttcatggtcgtcgccgtcgaggccggcgggttcctccgcggcctcctgcttctgctcgtctacccgcttctgtgcctcctcctcggcgacggcgatggcggcggcggcgcgagggcgagggccatggcgacggtggcgctggtggggctggaggagagggaggtggccagggtgggccgggcggtgatgccgaggttcctcatggcggcggcggcggcggagggcgcggaggcggtgagggcggcgcggcggtcggtcgccgtgagcgcgacgctcccgcgggtgatggtggaggcgttcctgcgggagcacgtcggcgtggacgccgtcgtggggccagagctgaggtcggtcgccggcgtcgtcgccgggatcatggatgacgccgacgcggcccgggtggcggcgaggaggctccgggcgctgctcggcgacgagatggatcagggcgaggccgacggtgccggcgccgccgtggggctcgtcggagaggggaggagtggtggcacggtgcactacctcttctcgcgttactactgcaaggtgagccgagctagttacgttgagcttttcctttttactgctctctccatacttaaaaaaaaactccatttttcagtttttggatataacatttcgcagcacatcttatttattaaaaaaaattatgattagtatttttatttttattagattatgaaatatgaatagtactttctatgcaactattttttctaactttttgcataatttttcaaataagacggccagtcactatatctagaaataaagtttttatgggatagatggagtactctttctgtttattttacttttgtacgaagccgtcatatattttaggacaaagggtgtaattagtttcaaattaaatggagataagagaaagttgcatttgcaccattgtgcatctcaaccgaactctacatttttcatttattcatctcgagatatctgctttggtgtttataccaattaggtagtacaacttatagggatagcgttgtgatgtcatcttcttgtcttctttttgtttttctttcaaaaattcattttgatatccatgtgtatgccagcaccttaattattttgtattcgtcgtgtgctcacgtggattttgtatcatgaaataggtgcagatggacgtgagaaaaaaaaaagtcgatctgtgtcttttggtatttttccttgtagacatcacatggtattttccctaaacactgtagtaccaaaataggagtaagtgacaaattaagcagcaagcgacacatgccgacctcattaatttgcttaaaagatgagtagatgacctccacgattggctactctctgtttttcttttccaatttggtgaacatccttttcgcactatccaattataaagtactgttaactgatgtccctagcaaagaaaagggccaacgaatgtccctagaaaaataattaaatctaattaatgtcccagggataaaaaagctaattaatatgtccccagaaaagaaagctactaattaatatcatttgcgaaacaatgcataagtagttaatgtgaattagtgattaaagaatgaatactctttcctttctatatatacatgctcctaataataatttaaagagttttttctttgattcgatattgttgcaatcaactactgttacttagttaacaccgttgttatcacagagcgtgacgtgtacacaattaatgtcaattaattaacgtgcatgtgtccaatccttgcaggaaaccttcactgcgactgaggctgacaagcggcggtggcggccgctgccgccgggcggcgagtgcggcggcgtcaagccgctcgtcttccacgacggccgcctcgccttcccgccgacgccgtccgccgcgctcgccatgtacgcctacctccccttcggcgtcgcgctcgccgtgtcgcgcatcatcgcgctgtccctcctcccctacggccgcgccacgttcctcgtcggcgcgctcaccggcgtgcactaccgcctcgtcggcgccggccacgacgccgccgccggcggcggcggggggaggctctacgtgtgcaaccaccgcacgctgctcgacccgatcgtggtggcggcggcgctggggaagccggtgaccgcggtgacgtacagcctgagccgggtgtcggagatgatcgcgccgatccggacggcgaggctgacgcgcgaccgggaggaggatcgccggagcatggcggcgctgctggcgcgcggcgacctggtggtgtgccccgaggggacgacgtgccgggagggttacctgctccggttcagcccgctgttcgccgagctcggcgccgacgtgaaccccgtcgcgctcgacgcccgcgtcgacatgttccacggcacgtcgacgacgccggcggccaagtggatggaccccttctacttcatgatgaacccgaagccgtcgtaccgcgtcgagttcctgccccgcgcggcgccggcgccggcggcggaggacggcggcgacagcatccgcgtcgcgaaccgggtgcagcgacagatcggcgaggcgctcgggttcgagctcaccgggatgaccaggaaggacaagtacatgatgctcgccggcaacgaaggcgtcgtggccgccgccgcggcggcggcggcgaccatcaaagccagtcgttgaacaggtgttcgatccggtcgtcgtcgccggcgatgtatcgcacatgcatacactgcaaactcagttaccataacaacagctaggaagaacttgcttcacacagttcttatgatactcataatcgtgtaattaaatatataaacacgaaaatagtttattaaagactttatatagctcattttggtccggactctggggttttgatttgaagaaaatttctaaaaaataattaatagtactcttaattatctattgataaaattaaagaaaatgcctatgaccatgcgctggattgcaagataaaacaaaaatcagacgccatcacgagtcatgactcatgagcaatgcattcactaaactctgtttttatttatcgatatctgcaagtccgcaagcatacatgcatgtaacaaggagagggtccaaataagtgagtttaatgatttttcttctcctaacctatttatatggtacgtgataagattacactaatgtatttaaacaagatctcatattatattttaataacaaaaatatatatgtttcaaccaataaaatttgatgtttcatagcgagagcgaaatgttccgatagagattatattgtatttcacatttttaatttttaatctatttttatgttttagtaatcagaattcaatgtttcttcatacatgtgagcaacatgtttctgatttggatttagctgtgctttacttttttttaattcatttttatgttgcttcccttataaagatgttcaatccgtgtatttataattgtttcattcgcggtgatttctcacatattttgtttcgaatgttttaacaactaaactttttttcttcaaaatgtataacttaatattttgatcaccttgttttgaggctcaggtcgggtgtttgacccctagtcttgtccataaaattaatttaaacttagtcgggtatataacttaattttcgctaacattagcttgttgctcggaacaaagcttatcatgggtttcaatttaagtaaacaaaactgttctcggtcctccaaagattccaaaccacgttcaataagaatacatacttccttttgtttacaaaaaccaacctaaatttagatttattcagattggttgtcctataagaagtcacatattattctaggttagtttttttttttgacgaatggagtatataagtaaggttaggatttacctactagcctccgtcccattgaacatactgtcttaagtgatgtgtgcgcatgcgtcttctatataataaaaaaaatacacatagttaattacttttgcatgacattgtactagagcatcgctttcaagtccgttaaatagcactatatatgtggttagtctgttacttgggagcaatattaattatttcaaaaatggcatcactgataaagtcaaacattatttagtcagcatcaacattgttgaggcctattccatgtggtccatgagatacccacatgcagatgtagtcatcagatatccgcacaacactctattcaaattgtactaatgaagatttgtgtaatcatttaattaacaattagcatcaacatctcctttccctcccaaaattaagcatcatgttattttcaataagcacgtcaagacatatgttatggatcgtactctgtgtaaatataaaatatcatggggttatcacacgtaacaggcagcattgccaatggcattaaacagaacaaacgatttagctcaaaggcagtcatggggttatcacacgtaacagcagatggcaatatggcatatgcttgggagcttgcgcatgttgttaaccaagcaattggctccaggcagggtttaccgcggggaacagtaatataaatacaatagtaaccttcttaaatttaaataaatttaaaaaataat

SEQ ID NO: 64230 - DNA, 3493 bp, Oryza sativa
aattttgtacgattttttacggttaccacggttaccgcgcggtaaccgtgcttaccaccgggacgcggtttggaaaaccctggcttggtaagcttttttttttttcttcccctttctttccgtgtgtttggggtattggggtgggggagggggattgcactcgtacacctgattttatctccaattgtaattctactatttcttcttcaactgtgtgattttgtcctcattttttaaaaacttattatgccctcgttctttttaagaggactaaacgatgttaaaatttatgtatgccctaacagatttggccctacttgtatgaggactttaattatgattttacctctgttttgacatcaaaattttaacatgaactttttacttattcagctaaaaaaaaagagtgcacacatgcttgacatgaattttaaaaccgttgaatcttcctctcgcggaatagggcaaacacaagattctgttaaggaaaatggggacagtaggaaaagtagggcaaaatcataattgatgttaaaacaaagataagaatacaaacgctgcttttttaaggcaaactcaaaagcgagtgcatcacacctatgaatgcatattttactcacatacctattttaatatacccttacataagtacttgtttaactagatgcaaagtgaatcaaggttcgctctacctagcgaagggtgcaatttactttttttaaaaaaaacactctgttagtgttaaatcatgcacagcgcgcgctataatgtactattagtacattatagcgcaatttatttaatttagcagtatgcgctgtaatgtactacaacacacaaatatttttttctcccaattcacactggatggtacagtagttctacactcagtaaacgataactaagggtaaacccgtgcgctttttgaactttctacagaagggcacccgtgtgtatatcatgtaaatgtggctatgcaaccaatttgcaggagcgttcggctcggcacaaatttaatgatttcgtttccaatttgtctagttgatggaagttcagcaggatgaagcaacaggcataaaagaataaaaaaggtagataaacagatacgagcagaaggatatcccgaaatcgaaattattgcgacacgaacacagcacgacaaagattgcgatgcatttctccaaggacgactacgtccaacggcatgcgtgcatccggagtgtcgagttcatgttcatctccagctaatactttggataagtgttcagatctagcttttttttttaaaaaaaagaaaaaggtccatatcaaagtagttcagataagtacccttcacgttttaagtacaaaaggagagtgctcaagattgtcaatccatcgctacatgcatgcatatatgggtattttcaagatgagcaaattgcatatattggtccatgttttttaaccatggtttcacattggaccaccattaactgaatgctttcactttacaccagattttattaccaaaatatatcactttggaccagtggcccacttgccagtgtggctgaggggaaaaaaaaaggaaacttctcggttgggaaggaaccagcgagtccgctgactcatctcctaccacaccgtcgatctctttccaacttcacccaaccatctcatggcggtgtgggcagagatcacgctaaagccttgggggcaacatggggagcttgggactggaaagactcgtgtggaggtcgatgttaggcgacgtcagcaaagaggagctcgtgcacgtccaggtacagcaaaagtcgagtcacggaggcgacggtggtggagaggagcttgagctccgggatggcgcgcgggcatcggagtagccgtggagatcgaggttgagccgggacggcagagaggagcttgagcccaagtatgacgtgctagtgctactgaatattgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccgcgtaggtcaagctggggtggtggataggagctcgagctcaaggacagcgtgtggatgctgctgcctgctggtgcctggaggtcgacgtcgagcggggggagacacggcagaggtcaaggccgagggtggcacgccagcatgggactatgggagagttcgaggtcaagacggggcatgacgatagcggagattgaaatcgagactgggaaatgcatgcatgcgggaacaggcggaagtcgaggtcgagccagcggacgacatcggcggagattgaaatcaagccagggaatggcgtgcgagtgtgggcggaagtcgagatcaagccaccggacatcgagcttgattttaatcaccggccggcacgacgggaacaaaagtcgagctagcgtgacgccgtgttggcgggaggttgaccccgtgctggctagactacgagcttgagatgcgcgggcgtcagctctgttatatatgctcgagctctcttaggcgtcgtagtcttcgtggtctacagccatcgatgaaaacagttggagatgatcagatagtgatgagagattggctctgagagactgactatgggccatacgcccaaagtgaaaggttttggtataaaatttggcctaaggtgaaaacattatattaaggatagcccaaagtgaaaccatggtaaaaaaatatcaaacatgtaatttactctttcaagattgacaattcgacatgcttacaacccaaagaacgatgaaaaagaaacaaggagaaaactcgcgagaacaaacaggaattaatataccccctccaaagttataatcaaaggaaagaaaactgtcacgcatgagaaaacgtgatttttttttaacaaagacgccctagcatagcattaccagtacagaaaagaccatgccaaaaaaaagaaaatttcaatcaaatttgataaagccttcctttcacggatatattttatattttgagtgttttttaatttttaattttcaaaataaacgttcctagacttatttttaagataggaaccttttggtcacaccgatctgactgacgtggcaacattgttctaccacgccaccctgactggcatggtaggataaataacaaaactatcacgcccgccgcaggtggcatgactgtttggcgtggccaaaagattcagattttagaataaattttagaaaggtttattttgaaattaaaaaacagaagttcaaaaaatactaaaaattccatccatcacaaaacaagaatgagaagacaacaatactgcctgccatttgacaatgtttcactaaactttgtacatcaatggataagtaaattttagggccgccgagggaccgacatgatctccaaaatacaaagttaaacattgttttcgggctgcaggaat

SEQ ID NO: 64231 - DNA, 1830 bp, Oryza sativa
aattcctgcagcccgcagagttgaaaatactgcaagtggataaacaaagtctagtaatgcattatgtgtctatctcaatcaacaagcatgccagttgtaatttattcagagaaaagactacctgagtaaaatgacctgattctcacatattttacaaatcatttcttcctcctttctcttcttccagttcctttctgtagctttagctttagcctcccagactttggcttctctgctagtgaagtcagtagggacagcattgggatctggggggccatcttcctcatctgacttttcacgttcgaggggcctcttctcatcattcactctaggcgtcacattgttagtagttgttgcaactggaccactgtatgccttcccataaacttcattgaatagttcatcatcaatttcaggacttggttcccttgccattggcagataataatctattcaagctagtctttgctatgaaaagctgaggaaatagaaggaagaagttgtttagtgaaggcaaaagaaatatttcaagtctgcagtgatgtttgcttatcaatgtaaataaatagaagctgttgcacataaaagtaaacatagttcctagagggcattttttgtcattggttgaaccatagggcttgttcatttcagctgcctgtcgctgtgctgcagcagctagccagcttctcccgcaacagctgattgatgcaatggctgtggccttttggagatgcagccaagcggctgcgctgtgccgctgcagccccaaaagccacagcaatcgctcccaagcaggcccataattgctttctcccttagttcatataagctactaggatgcacgtactagtcgatatcatacaggacatgttcaattcgatcaaaaaaattggctccagacctacatttccctaaaagccacaaactgaaacatgcttctcatgaagttcataaaagcagccaatgaatatctctttcacgatgatattgaactcatgcgcatttcaataatatatatatacagttctgaattacaagtggcatatacgactaaagattttcttttctttcatgcttcatggcatttctaatgtagaaaattctaaaatttcacagagagcgaaaaagcagcaaatcgattccgaaccctaccactaccagcgtccgcataagcaatccctagccatctcataaatcctcgcgtctatcagtttaaccttggacaaatatacgcagtgccccccaactcagaagggcgcggaacactatccatccccgctatttctatgagcgagggaaaaaaaacaaaagaacagatgcgcgaacaaatcgagccaatccgcctcgccctaccccctctctacccctaagagccgcatccgcgccgcgcgcgaccgacggctctaggccggcattggttcccaccgggtgcggccaccccacgcgtccacagatacgcaggtacacgacgcccaccaccaccaccaccaccaccacccccaaactgacctgctgatgatggaggcgcgcctcttcggccttcgggagaggaggagggggcggcgggtgagccccgccaggccagtggtagggggcctccgacgacgagggccctcgccgtggccgccggcgccgtacgcggcgggcgggaggggggaggggagggttcgggagtgggaagcggcgaggcggcgacctaaacgggtgaactgtggttcgggtccgtccggctcgggaatcacgatggtttggttggggtgggctaggagtagaggattgggatcctctggtttcattgatacgtggggccgggacaaatgaaacatactt

SEQ ID NO: 64232 - DNA, 6270 bp, Oryza sativa
tacattattaaaacatgctcatatttttttccctctcttctacaactaaaatgagaaacgtgattagcatataactaattaattattaaaaagataaaattataaagcaatttgtatacagaaagttttcactccgtttaatagtttgaaaaactaacatgctcttaatgaacatacattaaggatactccccctgatcaacccatcatcttttttttctggagaattgaaaccattatttattcgttacagagcaatagaatacttgtggttgggttctgtcaaggtttaccaaaccgtttagggtggggttaccattaacccgcggtttgattgttattgcggtaacctcgcgagatataccgtggttcaaaaactaaaaaggctaccgcacatgataaccatgataaccatacggtttggtaaaccctgatcctgctactccctccatcctaatttagaagatgtttgtagttcaacaaaacaacaaaaacatccaccaaagattaaagagaaaccaaccaaaacaaaagataaggagaacacatttatcgaagtctatttgttatctccatctataattggtaaagagttgcataaccgccgtctcaagcttccgacatgctacttgtatgaactcaccatcttcttcagatctttgtagttgagctcagagctgaagccaatatgttaccctaaaaattacctgcatatatgtaatagatggtgatttgtcaaaaaccgcattattcctgcacaactacaaagcccaacgtatagcagaagctcctacaagaatatgtgttatgcttgctctctttcttgtccaccccaaaagccaaccatcaaaaatatgtgttttgctactagggagatataaacttatagaagatgtttaatagtagagttaactagctataaacttatatttgagttaacatatatactccctccatttcaaaatataaaggattttgaatgtaggatatgtcacatttatccaaaatttaacttcaacaagttgcaatgaaatttgttttttcattatagtttgtataagttgaattttaaccagcatgtttgtgaaatatattaatttagattaatctatctagtcattttttttaaaattttttataatcatttagatggcatgcaaataatgaggggatgtttttaaaatccgctcccggtcgaggcggagttgaaatccgctcccggtcgaggcggagttaatcgtttgggttagcttcgttgcaagttgaacacacgttacatgggtgactggaaatttataatggtataattcggagagtttttttccaaatgttgcttaagatagaggaagaaaattcggagaggtttcggaattggacttgggatgaactcgatttaggtctcggaaacgaatgaatctggtccggaatagggatataaaccaaaaaccgagatttagcattaattaacacaaaagaaaaactcggaactaatcaaactttggcattaattagaactaatttcctcgaaagaaataaaaaaaaagtcggaactaattaaactttggatctatgtgcatggttcacttgtggtagtgccgtagtggtgtcactgtcaccggccggtgggctggacgagctgcgagaaggtggcgcgctccgcgacgacgtcgtcgggctccaagacaacgtcgacgcacggctcgtgcgggtgcgacgtggacgacgtggccagcgtgttgatgctggccgtgctcccgtcgtcgaggtggctgctgctgccggcggcggcgtcgagcgcggggacggggcggccggcggcggcgtcgaacgcgtcctggaagtgcatcgcgctctcgaggttccagagcacgtcgcccatggtggggcgctcggtgccgttctcggagaggcacttctccgccgtgtcggcgaacttggcgaggcactcgggcgcgatctggtccctgatcgccgggtcgacgacgtccggcagcgcgccgccgcgcttgcaggcgagcgcgtagtcggcgaggctgacctggtcgcgcggcagcgccgggtcgagcgccgggcgcgccatgagcacctcgaacagcacgacgccgaaggagtagacgtcggacttgtcggtgagctgctgccggcggtagtactccgggtcgaggtagccgaagctgcccttgacgacggtgctgacgtgcgactggttgagcgtggtggggccggacttggagaggccgaagtcggagaccttggcgacccagttgtcgtcgacgaggatgttggtggtcttgacgtcgcggtggatgatggtgtacttggcgccggtgtggaggtagtggaggccgcgggcggcgccgatgcagatgtcgaggcggtggcgccacgacagcgtgggcttgccgccgttgtggtagaggtgctcgcgcagggtgccgtgctccatgtagtcgtagacgagcaccatctcgccgtcctcctcgcagaagccgatgagggagacgaggtggcggtggcggagcttggagagcatctccacctccgtctggaactcggttatgccttgctccgacgacgggttggaccgcttcaccgccaccttcacgtcgccgtccaccacgccgcggtacaccacgccgaacccgcccacgccgatggccaggtcgttggagaagttcttggtcgccgccttgatctccgcgaacgagaagtggcggcacatgccggcgatgttcgccgtgatgtgccccgacgacttgccgctggtgtgggagtggtacagcggcagccacgcggaggtgtgcgagtcggcgccgccgccgcccagcttcttgctcctcttgttgctgtacaccaccacgcagatggccgccacgatcccggccgccgccgcgccgcccgccgtgccgcccatcaccgacgccatgttggccgggttgtcggtggagaactccggcggcccgccccagccgagctccttctccgcgagcagcttgtacgggacggggtccggcgacgccaggctgccgccggtgttgttcaccttgaacacctcgaggccgttgaggatggcgtcgtagaactgcgggcggagcatcaccgaggggtgcaccgccacccacagatgctcgtcggcggtgtcgttgctcagcctcaccgcgtagtccttgtacaccggcacgccgcgctccgtcgccatctccagcacgtccacgtccgtctgcgccgtccggttgttgatgtagatgtcgaacacccgctggttgccgtggatgagctggagctcgcagaaatggaggcgcacgacgtaggtgaagttgcactccacgtggaggctccaggtgaggttggagttctggttgaggcgctggtccctgcccatggagcggccgccgaggtacacctccggcggcgcggcgtactcggcggcgtcgctggggtacttgatgtggaagtgcgggccggcgttgtagacgaggccgcgcagggggccctggacgaacggcgtgtcgtcgtaccacggccgcgtgaggccggagtcgttggacggcgggatgtaggcgccgccgacgttgaggcggtacatggtctggaacgcggcggcggagacgtcggcggtctggtcggcgaagccgaccatggtggccgggttgttgaacatgtccggcatggagatcacctcgatgccgttgacgaaggcgtaggtgacgttcatcatgggcgacggcgagaaggtgacgccgaagtggccctccgggacacgcggcagcgagtactccctgatgaggtacgcctgggtgagcgccttggtggtgaagtagacgctgaagttgtggagcagcgtgtatcccgtggtggtgaagacggagaaccggaagtcctggggctccagcccgttgtacgacgacgggtagaagtggagccggatccagtggcggtcgcgcgggttcaccgtgaagttgtacaccgtgtccatggtaaacacccgcgccgtcatgtaggggatggacgacggcagcatcgtctccagctcgtcggcggccgccatgatcgaagacttgccggagtccgtcagccacgtgtcgttcgtcgcgtccgccacccacctgcgcccctccgcgtccagcccgtccgtcgtcgacccgcagttcaccaggatcctgtccgccgggctgtacagcttcgccgtcgccgcggccgcggccgccgccgccacgacgagcgccagcgccaccgccggcgagcaccgaaccctaccagccatgagcagagggagagggaggagacaaacagagggtagggagaagacagtgtgaggcgcacacagcaatcgagatgacgaggggagaggagcaaaacgaggaggctgagggaaacagtattagcggggtgacacgtgtcagcgactgggagcgcttgccgggtccacgagaggagaggggcactcgccatgggcatgacacgtgtagggtcaccagcgcagctctctgctgttcaatcaggacacgagctacagtaccacaatttgtcactgaagaatacaaccacatcacctaattaaatgtctatgatccatacagtaaatgagacaggagctataggagcaaaaaagaacttggaacaaaatcatttccatcatacaaagccaccgaatgttcttgtaacaatttggtctttcgcaggtggtgaataaaaatggaatttacaggatttacctcccaataaaactggttaggtcacttgcaccaccagccttcaaatgggtggtcagagactctgaggctctacccaaaacagcttcacaaaccaccactgttaccgcccttcgtgaagatcttcagagaaagccgttctcgatatgttctcagtctcaaaggggctgaggcctgaaaagggtccagaagagaacatggatgaagtgccatcagattcataggtggttgaggactgcctaacattgggtcgtgctggaggtgttggtatggattcctggaactcagagcgttggaccatcttcagtgactgcaccacctcgcccattgttggcctttggcttgcctccggtgaaacacaggcggctgcaattgtgcatactcgcacaaaatcatcttttggatactggccaccaagcttgggatcagctagttcttctagcgtatctttatctcgtaaaattggtcgtgcctgcgtagtcaaaattgagcaaataagtatctctacacctatgcagggataagaatttggtactgtctacaagaaatacgttgacgtttgagagttggctttcaaaaacctaatgaacaaacctgacaaattggccagcaaaggttgatgtgacacaaggcttttagtggaaagatcaggaaacatttgtgtaagctcataaacataggcacaaaaagaaacaaacagatagatggcgctttggcacaacaggcataaaaaaatgttgaagtgtaaatttactcacacataaatctgctttccacccaaggatgtacacaatgcatatgaatagagaggaacataaaaaatgtctctcttttttcgaaaaaggaaacagattagtagtaatattgctctaagtccatttgtttgtttgccttgtcgagatatatcgataaatatctaacatgcatggctagtgaacttcagatgacaattatcatactaaaggatccatgttcagatataaaaaggtaatacaataacagctgaagataagagcagaaagaaatctaacccatgtcactagattttcctggccagaaggttgtgacatatccacaggcctcctcccagtaagtagttcaagtagaacaactccatagctatatacatcgctttttacaagcaagtgtcctgtcattgcatactctggtgctacatacctgaaagcacgacagctatatgaagcaaaagcagagcagaaacatctggggagtacttcaaggtggtcaacctgcttacccgaatgttcccataacacgtgttgagagataatttgtgcaaccttccggtgcctgtttggccaaaccaaaatcagacactttagcatgaaagtcatcctcaagcaatatattagaagccttgaaatccctgtggattacgcaaggctgagaatcctcatgaaggtatgccaatcccctggcagcatctagtgctatcctcattctagtgtcccagtccaaggggcggctagctcccaatgtacctgaaaaaaatgtaagtagtcagagactcaagagtcaaggtgtatcatgattacatg

SEQ ID NO: 64233 - DNA, 1532 bp, Oryza sativa
gaaatatctgctaccgtctcaaaacataattaactatcgagtgtactacatataattaaatctggagatggaagtattatacaatgcagcatgtatgaatatggccgacatgcaggatttcacatagtggtggtactcgatatagtagatctacttagtggccactccacatatggagatcactactagcgctagctgaatgtatgagctctgtaacgcaagcatggtattggtgacacaacatagctaacaactcttgtgtatttttcgtgtcaactttaattactactcactcgcagtgaccatatgattcatatgccgcaattctgatgcgaccggttctggccttctgggttaacaaatgcatgcacatatgtcaccgacgcaagtgaaaggataagcataattaagcatgtcactttttaaaaagtttgtaagctgttggtaatcgacacgtcgaagctattaggagagatgaacaactgaagtactatatatgcatcaatcaatggagcttttcagtcggtcaatgttgggtttgcagtggagatgtactcagcagcattggctactgccggcaccatgcttcattgacctgacaaaacttgttccttacctccaactggtagaatgacaggttacatgtatatatcgccccattattttagaacaatcttggggggctcagagcatccatatatatttatatatggcagagaaaaaaatcgcaactaaactagaacaagtgcagattgataagttatagcgatgtctcaggtgataaatggcaaatgcctgttttatttgggttcagtctcagaaatcacagcaatgtatgcatgatttcttgatcaaataattaaacaactaaataggctgcagtcctatatatgaatatgaatatatatataaatatatatatatatatatgtttaaacaatcttactatgattcatacagatctgataaatactacagcccatgtataattcctaccaccacagcctgcaatcaggtactattttctccaatgtaatttaggtgtttcactaactccctacagaacgcatactgttgtatttatggaagtattacattttggcagagacacaagggtggatttgcgaggatggcttgtcaccagacatctctcaagtatctcccttccatctgcaagctctttacatagctttctgtgtttgagttgtccaaagaaccctgaaaattcaaggtaacattcagcaaagtggagatgaaagcaaagctactgttaaactctaaagagctttcatggcacttcacataattactcataatgcctgcttagaaagaggctaggctaggtgataaatactaagggacagagttctggatttgttttgacctcaatcaagaaagtgcaaactttctagaggtagagcaccactgcatcctcccactaagaattaactgaatctaacaggtaccaaaggtaatgatatacccaaacaatacctgttcctgcacaatggtgtgtagtgtgcggtgtacat

SEQ ID NO: 64234 - DNA, 6942 bp, Oryza sativa
taggcacagtaggatcagtaggcagtttgaagtttgactgcctaacaaaaattggagcccagctacattcttggctctcttccaagggaatcgagttctgcatacacaatcatcagattaaaatgtttactggtcagcacgaccatcacatacttcaaacaaagtttttatgcttgaccaaatgtatgaccattgttttcaaagtgtactccttcgaaaatataaactctcattatatatgaaacaaatcgacaactacagaatatatgtatcaagaacttttcgaagtctttcatattgctgagggaaagatgcactccctccgtttcatattacaagtcactttgacttttttttctagtcaaactaacttctttaggtttaactaagtttatagaaaaaattagcaacatatacaacaccaaattagtttcatcaaatgtaacattgaatatattttgataatatgtttttcttgttggaaatgttgctatattttcttataaaattggtcaaacttaaaaaaagtttgactaagaaaaaagtcaaaacgacttataatatgaaacggatggagttactatataactatagaattttcagggagtgatacaaggttgagttactgaatagaatgagttgtttagtgttattggcaaggccatcacggtaagttcatcatgagaactgttaacctgacactttgtccatacatcaagaaacttgagaaattatgattcacgtggagtttttaaagtgggtaagaaacaggttcacttaaccagttaaagttggacacatgtaatgaagactggatcttgatatataagcatcaaagcgagctatgacggtcatattcaattatctaccaatcatccaaaagaaatgcagaaagcacagtgactataatatagaaacagagtgccctttcactatgatagaacaagggcttaccttcatccaagtagaacaaactcctttatggatccttccagtaggggtttgcccatacactagcgcacatgttacatgaattcttgttggagtcatcctgcagcaatgtgaatggttttaaatagataggtcaatttgctcaggttagaagggtattattcctgaccaaggtacctcggtgaggaagatatcgagtagtatctcggctgcagtcgaggagcaatggctgcaaagaagacaccaagtggaggctttgctgatgggaactctgtcataacttccaagagactccgttgacttgaaactatccattgagaatactccttctgccaaatgaagctcatgtgaagccaaaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaagaacccccaaaaagtggagtgccatcctcttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcatgaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgaagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcacaatatcaatgtagaagcaccagcaaaccttgttaaaatgctcgtactgcctatttccgaggccaaagaccccaaaccgaagattactcaaccattcacctctctcattcccctgcactccagccaaacaaacaggccgtcaacagaaaatacaacgctcacccatgaaagggccatatgaactgtggatttgagagcaaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcctcctccgcaagcgcctgcgaatccgcaaccaattaagacccagggttttgctgcacgagaggtgacagacagagagcgagaaaatctatccaaccttggcgaagccctcggcggtgccggtctgcgtgccgaagaagacggcgaccctctgcctgccgtcgtcggggtcaggctcggcctcctgcttcctcttcgcgggggcgggggcccgcggctgcggctcctgcgccctcacggcgggcgcggagatggaggagcggcggacgagcagcgcgacgccgcagccgacgaggacggcgagggaggtggtgagcaggacgatgaggtggcggttctcggcgagcgagggcggccacccctcctcctccggtcgtccccgccccgtgagcagcgccgccaccaggtccagcgccgacggcctcagcgccccgccgccgccgccgccgccggagtccatagcgcgcgatgggatcgaggcggaggcggaggcggaggcggcggcgcgcgcgtgcggggtggtggccctagtacgtgggagaatttgggcgaaatattttttgggtttttgtggagttgagcgaaacggacggtgatgtgcgatcgatcggtacgtggtgtggtctgtggtggcgcggtgtgagtgtgtgacacgtcccgtcgggttgaggagagcgatgcacgtttcggcgcggccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactccaccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttagaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttgaggttggcgtcccaccgctcgtagtggt

SEQ ID NO: 64235 - DNA, 11686 bp, Oryza sativa
gcaccgccagcacagcccgtgcccgcacgagcagaacacctcgctgctctcctcgccgtcgccgccgcccacgaactccacggcgcggctgcacccgggccccgggcaccacctcatcccggcgctctcctccacgtacgaccggagcgcgaaccagccgaaccgctccctgtcctcgccgtcggccaccgcgtcgaccagctcgcgcacgacggccgccgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcggcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggcatggccaccgcggcggacagcttctcggcgcaggcgtcgaggccggccatgtcgtccaccgcgctctgccgcgccttcccgtgcgccgcccaccgctcgtagaagtgcatgtacctgtccagcgacgccatgccctgctcccgccgccgcttgtcgtcgctggcctcgccgttggccttggccgcgtcgtagacgttgcagttgtagtactcgctgctccggtgatcgctccacgggctgaggcagagccagcagaactcgtgcaggcatggcggccggcacgtcatgtgcatgcacccccggttcttctcgatcggcagccggcacttggggcagtgcttcgtgttcgccagcacccagctcgccgtctcggacttcatggcgttcttctccgaccacgcgtacaccgtctcgcacgacaccggccggtgcgcctcctcgccgcaccggaagcagaacccgtgcccgtgcctgcactccacgtcgtcctgcttctcctcgccgccgccgccgccgacgaactcgatggccagggtgcacccgggccccgggcaccacttgatcctcgtgccctcctccacgtacgaccggagcaagaacgtcgcgtaccgggctctgtccgcgtcgccggccacctcgtcgacgagctcacgcaccacggcggcggagcacgctgggtccgggcaccggaacgacaggcgccgcgtggacgtacccgcgccagcagccgacgcagtagaagtgggagcacccggccgatctcatctcgccggcggggtgctcgtcgaagcagatggcgcagacgagcgggtgggcgttgcgcgacacgggggcgccgccgagcgccacgccggtggcggcgccggctcggtcgccgtcgcagaacagcctgtcctggagctcgacgaggctccacttgtagtgccggaggaggacggcggcgaaccccggcgggatcgcgaagagctcgccgacgttggccgtgtccgcgtcctgccgcgcgcggacttgctcctcggacagattccggtacctcctgtcgatcttggtgaggttgacggcggcggccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcggatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtaaaattatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgtctcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttataggaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggtgttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgttttcagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtgcaagcgcgtagatggccagggcgtcgctgctgatgtaggccagccagatgaaggtcctgaaccagtgagggatggtgtacttgcgcatgggggcagccagcagaaggaaccactggatgcccaggctgcacagcaccaggatgcgcagctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaaga

SEQ ID NO: 64236 - DNA, 2853 bp, Oryza sativa
catttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatctggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcat

SEQ ID NO: 64237 - DNA, 1846 bp, Oryza sativa
ttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgacgaattaattagtctcaaaagattcgtctcgcggtttccaggtgagttatgaaattagtttttttattcgtgtctgaaaactctttccaacatccgatcaaacatccgatgtgatacctaaaattttccttttcgcgaactaaacagacccttagaagaattagattcaggaagtagaataacatgagaggaagtacaggggaaagacaaatattccctccgtttcatcatattataagttgtttttgacttattttcctagtataaaaaatatttggttatagaaaaatgtagcacaaaattagttttatcacatgtaacattgaatatattttaataatatatttattttatgtataaaatattgatatatttttctagatgtttggtcgaattttaaaaaattaaaaaaaatcataacgactcgtaatatgaaacatagtattatgaatataaaataaaacagagagtactataaatgaaagtttgttcaacacattatcacaagaacaacagatacaaccgacatgaagggggattggattctctgacttacatatcaatgtcttaaagttagataaaagtaaatcgaaaattaaaaaccgattcccacaagagctagtatatgcaaacacgcaaacaaatgctcaacacttgcagcatgaccggtccccagcagcgcagtaaaacaaggaatgattacaacacatgttaatgacctacgtcaaaagacagcacgtataaggagactcatctgaagtagggttattgtttgattttacttatttaaccagagttcaaacaatcaattaagtgttgagatggttaatctatcccgagcctcatcggttgacctaataagtcaaaacaaaagccaaaatttaaattttctaacttgattttgaagttacattttaagatgttttaaacataatttctttatagcattgggttttaaatcactatgaacaaatatataaaaaatctacctacaaaataaattttattacctaataaactgttttaacttattagaaaacatagtcaacggatgaggctgcccgttttctaaacagaggcagtacatagttgtacaagagacgtatcccgtgtttagactttctctatactatattcattctagtatatatcagtacaaattaggcatacataattaatttgatattgtactgtacatcgacgaaattcaagcaaaaaaacaattgatcttgcaatcaatcgatcagttagctcttctagctaaaaaaaaaaaaatcaaccgtgcggaatcggcgcgccgccgccgccacggcggttcgtgtccggcggcggatcgacgtacccataatccgtctcctgatcaacagcgacgccgacgacgccgcgcactggccgcttcgtctccgtctccggcaccgcggcgtcagcctgcagattcactccaccaccacttgtcgtcgtcgtcgtcgttggcgacagcactactattgatgcaccgagctccaccggcggcggtggcggc

SEQ ID NO: 64238 - DNA, 2658 bp, Oryza sativa
ccttattggggaaaaataaaaaagaaaaaaaaagatatggtacaacaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaatatacagctattcctattactgttaattattgcatatttatcttctaatagaaaatctaggtattggcattttaatgagtcatggtgctcttgaatgatatcaaatccgtattatagatatgatagtacaactcttcaccctatggctttactaaatacgatgtcttctgggatagtcagattaatgtaacccttgctagagcttctttgagagactgagagcctgagagacaagagcttgtgtggagtttggatgtaggcctgcaaatccccatatactagactgttcccacttttcagtgacaatgagtgctacaacccagctgattaaccatatagcaaattgacagagacaatatcatggttaggaggaaaatgtgcatgacactagatgacaatctgaaattcattttacttggggattcttctggccttccagtttttctaaaaaagttccaagatactccttttaaattttctgttcatgcaataacaagaaaattacttggatttcataaggatcactcacagaagccctctacagtacttaatcaccttgagatgatgttttcatacattgctggtgataattttaatagccagttctctcattaatctaaaagtatactaaaaatacgcattttacaggatgtaactttatttttctgactgtattcccttgatacttttccagggttgggttcaatttcacagcccttgtaactggtggggctggtcttcttagtgcatttgcaccaaattacctttctttgatcgtgctgaggtttatggttggtgttggactgggtggtggaccagttttatcttcctggtttttggaattcattcctgctcctaaccgaggaacttggatggttattttctcagcattttggaccattggcacaataatggaagcttcactagcttgggtaaatttctacattttgccaaagtaatactactgtttgcaatctgccttgggtcatagtggttcaactgatcatacaagtcagttaaacagaacgatgcaacatatgattttaaaacagtcgctatatttattaaaacagtggagattgatgtaattgaatttctttggttctgcactgcagcttcgatgcatgtgtttctgctaccctgagtaaatttaacagtgataaaatattagaatagatcagatcccatggaacagaataatgagcttgcatttggttagtcagtgatgatttatgcatttcatataatgtaatggaaactgcaatgaacaatatgttgccttctagtatgtactgatgtatgctccaaactgtcattctaattttgtaggaacttattatttgtttaattttcaggctgtaat

SEQ ID NO: 64239 - DNA, 1443 bp, Oryza sativa
tgcaacaataaaaagggaaataaaatcacaaaccattgcctcatgtattatcttctttccttgcagatatacccaaccgcagtcagggctaccggagtcgggtttgcgagctcaatcgctcgtttcggtgggatcttgtgccctcttgtggccgttggtttggtgcacgcgtgccatcagactgcagccatcctgatattcatcacggtgatgctcgtctcaggtgttgcagtctcatactttcccctggaaacaagcggccggaaattgagtgaccacatcgcggcgtaagagctaagttgcgagcagaatctgacagtgttgcaagtgctagtttctttagctatacaaaattacaggattgagctcctagaggccattcagattttttttttctttcagttcgtttaaagatcatatatatagaatagaaatgaaagatggtggatttcagattttaaatgtcattacattgttttaaccagacatatgtaaactgccaaatcgagatgcttgctttgctctcttgaaatgggatgatcaatatgttttgaaggaattatagtgcgtcgatcccccttacgcctcttttctttttgcaacagtactgtatagttttacatggcttataatattatagttcaaaaaaaaattcctcgctagaaataaaaagtgttgttcagaaaacgttcggtacactacaggcaatagggggaaaataccagtaaaaaagtggtattgtactatttttttcttttcttttttattttggctgctgcttaattaatgggccgtgttgggccggcccactgacagttggcacggccccacgcgaggaccagatttccaaatttcgttgaaacgaaacgaacggcttcccgccactctcggcttcctcttcacgttgctttctcccccaacctctcctcctccctttttccccaattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacggtgagccaagttttttctgcaatttttgttttcagatttttcattcggtttcctctctttcaatcgatgatattcatggattggattctgaaagatgtggtttcctgactgtttgccttctctgtttcagttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatgtaattcactgcagcacttt

SEQ ID NO: 64240 - DNA, 3102 bp, Oryza sativa
ctattcaagtgaaaactgcatccggaactactcttatcattgtccttcaaaatatattattcctaaatggctcacagcggcaataccgaagtattgatgttatcaaatatcaagagctgttaataaaatttatttttttaggcccaatgcaatcgttatttgttttctatagcttaactacattacttaaaactcataagtacaatctcaaacgtatgaattttcttaagcacatcagttaggaactaatctagaatggttttcctccttttgttcccaaggaatgtgaagaacaacaagttcactgggtggatcccaagtaaactgaagagcattgacaatttagagtaagtgggacatccagtcaatatgcctatttttgttgcacttgtgaaatctgatagttctggtcacatgatgaaggactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggtcagaaccaaccatttaccccgctagttgatgactcgagaagtatttatgcacactgtatctcttgaattatagaaaactacgtgggttcctttcagccgtgcatcattttgtgatgtgtagggaactacgaataattaatgtgatatgtgattctggtaatttaagtttgagacgtgcactaaaagttctcatcttgcttcattttctaggccgtaggaattcttcagcagtaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaagggacaaccggttgcgttttcagggcaaaatatgctgatggacgggtaggctcctactgtttgctttctaagatctttccaaataaacttgtttacaggctcaattcaggtaatcatctgagtaaaaattgaagtgacacaaagatcatgtcaaatatgcatgtaaaacacattgcagtaaccaaattattaaactgaactagatactaaggtctcaaagaagaatgcttgaagagttcaaagaggtcatataccttgaattatgtgtgtactagctcatcaattaccatgaacaaatttcaggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtaagttgacaagtaggagtaacattgaatcctagaatccaaaaatacatcaatttgaattcatgtgtaagattgtatccctttcttgtcattcattcaggtacctacatgaggtctgttcacctccagtgctccacaaaaacataaagtcttcaaatgtcttgcttgatgctgatctcaaccctcacctctcggattgcggcctttcattcttctatgaggtttgcatgcagagtggctcttctttaacaattgatgaacaaagtataataattgtaagaacaatgtggtctaacggtagggaaatctctacaggacgcaagtgagaacttgggacctgggtacagtgctccagagtgctcaagaccatcagcttacgtgatgaagagcgatgtctacagcttcggagtcatcatgctggagctactaaccggccgaaagccttatgataggtgaattaagggggcaaaaagataaaaccttgaaattcactactgatatccataatgtgatgcatcatctaatgtctgcactctgcacattatgcttactttctctatgtggctgtctgatggttctacagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggtgagctccttattgtcgaagagatatccccatcaatgtgctccatgtctgaatctgaagtaatttcagacatagtatgctatgtcattcaacctgagtagcaccccaaggtccttagttcaaatctatatatgagcgaatttcatattggttatttgagggctaagttcctaactttataaaggctgtatatatccggttgaatgtagagtctaggtaaaaaaaaaaccttctattaaaaaaataaaaaaaaaggtctgaactctcaagtcatttcagacatactatgaagctagtagtctgaactctcaagtaacttcagtacagtatgaagctatgtctgagctctgtactgtactgataatgggaaatggggggtgggattgggattgggaaatgaatgaagggttaggattaaatagaagagggagaatgaatggttaggatttaaagatgggtgggaaatcatttccctttcccatttgccaaacactacctgaagttactgaatttggtcttgttggtggtgatgcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtt

SEQ ID NO: 64241 - DNA, 738 bp, Oryza sativa
atatccaaaacaaaaacatgcatgcctacctgaacctcaccactacaacaagctcacacacgtttacattggacaaggtaggtttacctggcaatttttatatagcaggatatatcgcacatatatacatttcagtgaattaatggaactgaaatcaacaacacgctggctagatcgacaagcctctcaacttctgctcttgctcgggtaattgcaaaagagaatgaataccatacagagattatcattttcgtaagtacgtaaaacaaccgcaagacatgattacgacacgatacgcttatacacactaattataatagtatactcattgcgtggaagaattagaggagctatctagggcaattgtcaacctattcattcatactacttccgtctcaaaataagtgcagccgtgaatatccgtacccaacgtttaaccgtccgtcttatttgaaaaatttatgaaaaatttaaatatatttagtcacacataaagtattattcatgttttatcatctaatagcaataaaaatattaatcataaaaaaattcaaataagacgaacggtcaaacgttgaacgtgaataatgcaaaactgcacttattttgggacggagggagtatatgctatagatctggggcccaccggaaatcccacctgatgtgatcctacttggaccaatggcctctgcccaccgtgcatctgatcctatccacaattcgtacgggctgcaggaa

SEQ ID NO: 64242 - DNA, 12472 bp, Oryza sativa
ttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatactggatgagctgtttacatgtcttcattctcatttttagaaggaatatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaagtaacaaataatatgctcatctgtgtcttttttcgtccatctaaaactgaatgtttctaatgcatgttttgttttcttccaatctttgctggatcagccaaactgtgtcgcaaaaataatctcagtaaggaacgagaagaaggtaccccttttctttatttcgatgttgtcgtttcaaaatattcgccccagccctctttctttcctggcaaatttatctgtttctattctaatgtgtttttatcattgtccaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactctttcttcgccacgttgatcacgttgtctccgtgttcatcgcaccatgccctgcaaaaacagatactatcatctcagaatttctgaaccatgtctgttaaatctgaatgatgacggaattgtgaagttttcagtactttgggaagaaggtcttgaggtcagatttgtccactggaagccttgttgagatggcctcaatttgttgatccctacaatgatgccaggacatacattttacacacttcaaacaacagtaattgatcaaaaaattcattggcaaaacagacagattaaaacttacgaaaagttcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgccattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatggcgggacgaaggccttgtgcttcggcttgtcggaggccgccgcggcgggcggcgggtcccggaggtcgatctccgaccactcctccatggaagacgacgaggctggtgccgccgccgaagccgcgccgccatcgccgacgtccgcgtcggggcagtcgaccacgacaccgaacgccgcgaggcgctgcacgagtgggctcttggtggagttgtactccgccgccgagatgcacttggcgtacaagagctcctgcaaaaggagaagggagaagcgttcgatcaattgctcgctcggattggagggagggaggtagaagaagaagaagaagaaggcgatgcgggtgggtagtacctggaggaagaggagcttgtcgcggaggatggcgggctggtcggggtgggcgggcgggggcggggcggcggcgagggtggcgagcatgtcggcgcggaaggcgtcgacgtcggagggcgggacgatgccctcgcggtggagcgcggagaggtggaggatgcggtggaacgattcctgctgccacttgagcgcgtcggcgtggcgcctcgccgcggcctggtcggcggtgaggcggcggccggacctgaagccgccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtggtgagagagtgaaggggaacgggttttgttgggctacggcccaacggttggggagaagggaggaggaactagccgttgagttgaatctgcagctgcaagtgggcccgttcgccacgaggtcaagaagcttcttcgcctaacatgttgatctcagccgtttaacgactgatccaatggttggtcggggagacatcacgtttaccggagtatccgatactatcatgtaaattaaagagcaagtgatccctctgttccatatttttccctatttaaattttattaagcttgatcgagttttaaaaaaaatttagcaatatctaaaatatcaaattaattttattaaacctaacattaaatgtgtttgtttttttattaaaaacactattatatttttctataaacttgataaaatgaaagaaatttagttagaaaaaagtcaaacgacttataatataaaatagatgaagtaaaaaaaataagggagacgaagatacaacaattcatcaattcaaaacacgaagatcgattgttgaacagatatatgcgtaggcaagaaactgcaatccaatcgtccagcattcacgattgtatgtattccacaaagaaatgccaacgtaatcagataactgtgagtgagttcagtgattttcttgaacggaataataccagtttttaacttttgataagagcgttgagccacaaagctgaaaaccatgctgaaaaccatttgctggatactgctttcatcccatgaatatagcaatatatatagtactatcagataagacattataaaactatgaatatataaattaaattagtttcattaaatataacatcgaaaatattttgattatatgtttgctttgtgttgaaaatattactatatttctctataaaatcaaaacgacttataatatgaaacgtccctccgttttttaattataagtcgctttgatttcttaagtcaaacttactagaagtttgatcaaatttatagaaaaatttagcaatatttatagcaccaaattagtttaactaaatctagcattaaatatatattaatagttttttgtgttgaaaatattagagaaaatgcatgtgcgttctaatgtgttgaagcaattttaatctcacacattatttgattgatgaaaataggagtcctcctatgatttttgcatcatgcaaaacctatacgcatgcatgcatgtattgataacagctagatagacagatatactgacatactgtagtaatgtctggctaaacaatttcattctcagaagatagataggattcacaaaccgcatgaactagacgtacgggctccgacttagggtccaaataggatttagtttggctacatctttatttttttttctctttcataatcggaaacctgactctagtatcataccttctattcatcttcacacatagatagtttttctatctaaaacgaataaacttgtgtgcagatcgccggccatggctaccgtcttcccctaccgttggactaaaaccaagcatctcaccgagcgtccacccacccacggccaccctcccgacgctcacccatggatcgtcctcgacgtccgcgcctacatcgccgaccgccagaacgccaccaccgccaccacctctctcaccagcggccgcaagctccagatcaccatctgcgccgcgccgccgccgctcgtctcctacgtctgcgcctggtcccccaacgccgaccccgccctcgtcttcgccaaggaacccgtcgtcgcctgcgtcaacgccgacctcgtcttcctccgagtccacagcgatcaagtctaccacctggtctaccacgccggcggcggtggtgacagccgccgccgccgcccttcgctcacgcttgtccggcaccccgaccgccccttccatcgctgtcattaccttagtgagctcggcagcattgccatcctctcccgccgccgtgccggtgccggtgacgaccacgacgacgactccaccggcttctatgtctgcagtcttgatcaggagctatggtatgggttacctggacaacgtggccacttcaagctctgcctctacgactccatcgatggcgaatggagccaggagacccttcgtctcgaccagctgcgcaatccgcaggacaaagacaccgttttccattacacggagaaggtgattactctgcacgatgaacaggtagtggccttcgttgatctgtggcgaggcatggtcatctgcaatgtcaacgatggcacctgcaacaacgtcgagctcctgccgaagctgaacggtctccctgccatggataagctgcggatagctcgtcctatgctcagcttgatggattcgcatgtcgtttacatcatgggcaaggtcaatctctccggcgagaaggcggtggtgctcactgttgacatggccaacaagaggctgcaaggggtatctctgcgtgacgctgaaaggatcgtctacgatgataacggttgcagctacaaacagtataccatctcccaatatttcactacatctgcaggtgattgattaatccctggcctgtttttttttcctacttattgcttttcttttggagaaatcttgtgtcgaactgacgagacctcacctgctttcaagaactcggctcgttcgtcatcaacctccctctcctccaagaatttcttcaccaattccatctccttagcctcaacttcctgcgaatctttcacagcaaacaaaccgcatgaaccagagcgcaaaatcacaaaaatgtccgtacgcgaagtttgtgtgtgtgtggtggggggtgctccgttgccggcgctggatcaggacgagttcgtcgtcgaagcgagggcgcgtcgatcggccaccggcaatccgattctatccaaaccatcttccgccgatccgatttacttctcccctccgactccaacttgcattgctgacatcgattcggatctcgatcttctccgactccgaatactccacgctgctctactttaagcccggccggacgatcgccggcgggaggagaggccgcagccatggctaccgccttcccctacagctttacaagaaccaaacacctcactctctgcccgcccagcagccacggtggggatgcggccgatcacgggccccttccatggatcctcctcgacgtccgcgcctacatcgccgaccgccggaactccaccaccgccaccatcgtcttcagcaacggccgcaaaatccagatcacattctgcatcgcgccgccgccgctcgtctcctacatctgcgcctggtcccctgccaccgaccccgccgtgttcttcgccaaggagcccgccgtcgggttcgtcaacgacaacctcgtcttcctccgcgtccatagcgatcaaatctacgatctcatctaccatgccagctctcgcccatctctcaagctcatccacaacccctacagcccctacaacccatacgactaccttcgtcgtatcgacaacgttgtcatcctccctgaccgccgccatgccgccggcgctgatgatgatgacaacaacagcggtcacttctatgttagctcgctcgatcgggatcaccgcttcgatattggccacttcaagctctgcctctacgacgaagacgattccatggactgcaaatggagcaacaacatccttcttcttgaccaactccgcaatgcgccagacaaagatatcgtgctccatttaacagagaaggtacttatcctggatgatgaacaaccactagtggccttcgttgatccctggcggggcatggtcatctgcaacgtgctcgacaacagcagcacacctgggggaagcagctacatgccgatgccatccgagatcttcaacatccacaacacctacacttcatccatttcccgtgacattgctatcgtcaatggccgtctcaccgttgtcaggctgtgcctttacctcgattcagatgatgattcagacgatgatgatgacgacgattgctgcgcttgggatctgaccacatggagcaagccagtcacctgtttggatgatgagtggcgtgaggacttgaagatcaagtccagtgacgtctcgattgacgacagcactcggaacgcctgcctcctgcccaagctggatgatggttgcccaacaacggagacgctccagttagctcatccaacactcagcttggtggacgctcacattgtttacatcatgggtaaggttgacgtctccgatgagaaggcgctggtgctcaccgttgacatggcaaacaagaggctacaagaggtatctatgtatgacgccgaaagaattgtaaacgattttgattatgcctacacgcactctaccatctcccagtatttcactacagcagctgcaggtgattgattaattcctagccttgttttttttttctacttttgccttttcttttggggaaaccttgtgatgaatatgatagtaaacctaattcaaagtagtgataggggaaactattttgatccctcgaggggatatcaatatctttgtcgtttgcatgttactcaaatggttattaaaaaatgtgaaaaaatttgagaagatgtattaacgtgtgatatatcacgccacaaacattcaagttaaaattcaatttttacatctcgcaaggaaaaaaaataaattaaactatacaactagttaatgtatattcacagacaaatttatttttttcgttgcgagatgtagaagctgaatttgaacttgtatgtttgtggagtgatatatcacatgttaatacatcttctcaattttttttaatttttttaaaacaatttgattaatatgcaaataatgaggggatatcctctcaaggatcaaaatccactcccgttgaccgttgtgatagctgatatattgtgtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccacctcatcctccctctcttaagaagctagttggccccgcatgtaagctgctccctcttccttcgtctcctggccgcagagatgcctgtgccgcctccaggctccagggacccgcaccgccgccgccaggcacctgcgccgccgcactcatcttgaagcccgcctccttcagtcggtcgtcgtcgccgttgctcccatccaaccgctggagagagagcgagagaggaggggaggggaggggagaggagagagagagagagagagagagagagagagagagagagagaggagaaaagagatgacaaccggcggcggcgacaccctccagggcaggcgggtaaagcgacagactccttcacttcggccaaggacccccgccgcccgagttccgtcggagtggccccgtctccaccaccgccgacgccgaggtccagacttcgctcccccctgctacgccgtcgccagaggatggatgctgcttcaccgcctcgatttcctccgccgatcccatcgtcaggaggccaccactgaccgcgccagcaccggtctccatcgccgctaggccgccgcttcaccacgaccgccaccgctctgcctggctgccgatggcctctcctctcccttgtgccacatctccgtttttctctctgcctcccatccgcgcccgccgccgctcgccgccgaccgttcccctccccgactcgcccgctgccggccggagccgcgcccgctgccgctctcccagccgctcccgtcaacgctaacagcatcaacatagaggatgggagggcgccttccacctccgccaccggctgcccgggcgagctccgcctccgcctcagccgcccgccgctcggggagctagctctgcctccaccggcggccgcccgctctgcctccgcctccgaactcgaaaaccgaggagctccgcctcagccgcccgccgcccgaggagctccgtctccgccgccggtcgccccctccgccttcgtttcagccaccgtactagtgagatggtgaggggagggaggagagagagaggggtggggatctgacagtgggtcccactaattttttttaagagagggaggatgaggtggaggttgagcaggatgttattttgaccggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaatgaatcaaatgataggaaaagaattagtaattacttaaattttttaataaaacgaacggtcaaacatatttaaaaaaattaacggcgataaatatttagaaacggagggagtaatacgtaggctatttgcgctgacacatggggacttttgttttgctgggtgcaggtgtaaagggaagcctgaagagacctttgaagtttcatattcaatatcctcacaagcggttgggtgaaacaatcaataggagcgatcctatggacttgcatgagccattgcaactggatgctggatctgacatgggaactacagacggaactgaaggcagcgataatcctatggacttggaatagccatgccttttgagtgaaactaaatgggcataaattaattagagctgttgagaatcatgtccgggcataaattattatagattaatttgagctgttgaaaatcatgcccgggcataaattaagggtgtgtttagttcacgaaatgaaaatttttgtgtgtcacatcggatgtttgaccggatgtcggaaggggttttcggaaaaaaactaatttcataactcgcctggaaaccgcgagacgaatttattaagcctaattaatccgtcattagcacatgtgggttattgtagcacttatggctaatcatggactaattaggctcaaaagattcgtctcgtgatttccgtgcaaactgtgcaattagtttttttatctatatttaatgctccatatatgtgtcaaaaaattcgatgtgacgtttttaggcaaaattttttagtgtagctatatttatggcgccatatttttcatcgaaaaatagtcggcatgtatttacattttaagtccctaaattacatatgtaattttagtgtatttacaatgtaagtctcaaaattacatatgtaagtactaaaattacatatgtaaattcgaaaattacatactaattacatatgcaagtggggtgtaaatgaggtgtaactacggtgtaagtggctaaaaaaaaatcgactgtaacatatggcgccatatttctagcaactctgaaattttttggaactaaacaaggcctaattagagctgttgaaattttgaaaatcatgcatgccccgttatgtattttggttgttgtgcatgactgcatgtctacattttagatttgccttgaatggatatgtttatgctcttgttggactgtatttgatcgttcagatcgagagttgtctttggagcgtggtgttaacatattgatttcatctataattctgtttcagaaatattttttcgtactctacaattcagaaatagcaggggaagcccactgctttccattttcttgaaaccagaaaatagagtttgagggtggtcgttcgccacgacttgacctccttcgccaacgaaatgtaatcgccaattatgcataacccataggctgatctgatcaggaaagaagattattgctagtggcctttgccagaaatcaggctatcgtcaagcacaagccactaccggcgataatacaaccatagcaattcaagataagcagatccgattttaagcacctccgatcgatgaaatcgatttacttctccccctccgattccaacttgcatcgctgacatcgatttggatctcgatcttctccgactccgactcgggatcctccacgctgctctactttaagcccggccggacgatcgtcggcggaggagaggccgcagccatggctaccgccttcccctacagctttacaagaacca

SEQ ID NO: 64243 - DNA, 2398 bp, Oryza sativa
cttcttcttgaccaacttcgcaacgcgccagacaaagataccgttctccatttaacggagaaggtgttcatcctggatgatgaacaaccactagtggcctttgttgatctctggcggggcatcgtcatctgcaacgtgctcgacaacagcacaccagtgggaggcagctacatgccgctgccaccggagctcatcgatgcccgcaggacctacaattcatctgtttgccgtaacattgctatcgtcaatggtcgtctcaccgttgtcagactgagtctttacctcctcgattcagatgatgacgattcggacgatgacgattactgcacttgggatctgaccacatggagcaagccagtcagttcttgtttggacgatgaatggcgtgaggacttcatgatcgagtccagtgacgtctcgattgacaacagcactcggaacgcctgcctcctgcccaagctggatgatggttgcccgacaacggatacgctccagttagctcatccaacactcagcttgatggacgcccacattgtttacatcatgggcaaggttgacgtctccgatgagaaggcactggtgctcaccgttgacatggcaaacaagaggctacaagaggtatctgtgtatgacgccgaaagaattgtcaacgattttgattacgcctacacgcactctaccatttcccaatatttcactacagcagctgcaggtgattgattctcttttttttttttcgggaatacgccagtgacgcatttttcacattatgagaaataaaagttatttacaatcaaagaaagatcagcacgggacaaagttattgattcattcctggcctgtttttttttctttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattgcgatacaaccaaccgcatacgaattgtctgtattcaacaacaaatggtagtgcaccagagcaccaatataatcagatgagcgtgcttagtgattttctcaaatggaattgcagtttttctactagaactgagccactgaataagctaaaacccatcttattactagagtcatacatggcttgaacaataggattgagctgttgaggtggataatttacatggcatgtatgagagcaacttttaacaccacttcccagaggcctgcagccttagttttcagttcccacaggttgaaactatctccaaagtcttgctgataccagcaaggaactcgaacattcagacttcaaacattcaggaaatcaaattacaatgacaaatggataagactgattgctaattctgggtaatgaattataaaagaactagattggctgtcgatattcctactcaatttgaaatatcacactccaaaatgtgaacaaggtggtcaggcacatatagttaccgaatttctcattccagtgatgtaaacttatagatgaaggtcacttaaaacatgtccatactcctgaatttcgtattggattattggccttgctataagttaacaatgctaacctacctgcttgggtaaaagggttaacgtctcacactaacagatacattatttaagaaactgcatgttccatactggagtatgattgataggaagaaacctcagaaccaacatctgattgtgtaactcagtatacatttagtgcatcaataacaatgttctaaaacaaggtctacaaggccgcacaaaggaatggatcttaaccttgtactgcttaagccacacaataggccagctatgccatgtaaggcaggcgacaacacataacccttgacatcttttagaatcttgataaaaaatgatcaaaggaattgaatttcctagtactacctgttctgcagtctacaggtcgtatggctcaactcaacagaaaagggaatcaaggcaaaatgtccagggtctccaaaaatcaaattttgtggtgactgcaaaattgacagccataacttattgatctattatctctttatccatttagactagtcaggggtaaactcatcatagacatcaagaaaatttaagtttcaaaatctctacatattaaaatactacacattttgtctcacttgtaatcagcgat

SEQ ID NO: 64244 - DNA, 3101 bp, Oryza sativa
ctgcgaatcattcacagcgtacagaattcacaaaccgcatgaaccagagcgcgaaatcaatcgacctcaactcgacgatgacgctgaggtggatgcgcgggccatgccatgctcgagtgacccgacgcggcggaagatcgtgcggatcgtcggtcgccggcaatccgttcctatccaaatcatgtttcgtcctccgattccaacttgcctgtgattgctgagatcgatttgcatgtcgtctccgactccgactcctctactctgctctactaagctaagcccagctgggcggacgacgatcgccggcgggaggagaagcctcagccatggctaccgtcgaccgctatatgtggaataaaaccgaacacctcactctgcgcccgccctgccatggcggggaccctctggatgcacaccagcctctaccatggatcctcctcgacgtccgcgcctacatcgccgaccgccggaacgccaccaccgccgcggccgatctcggcaatggccatcgaatcgagatcaccatcttcaccgccccaccgccgcaggtctcctacatctgcgcctggtgcccgaccggcgaccccgcccggatcttcgccaatgagcccctcgtaggctgcgtcaacgccgacctcgtcttcctccgcctctacagcgaggtagtctacgacctcgtctaccgcgccggtggccgcccttcgctcacgctcatccgggaccccgtcgacgtcgacgccgccagcttacagagggattacctgcgttcgctccacaacattgccctcctccgtcgtgctctctggatctggacctccatcgagtcacaccatctacggcagcttacaaactctgcctctacgagtccaccatccatggcgatggcaagtggagcctggagagcctccttctaccccagctgcgtcaaatgatcgtctataatacgagcagggtaattactctggatgatgatggacagggagtagtggccttcattgatctcaagcggggaatccacatctgcaacgtgctcgcccatggctgtcctggaagttacctgccactgccgccagagctcaccagctctcgaatgagcttctttgccgggacattgccatcgttaatggtcttctcaccattgtcggactgcgtactttctttgattcagacactgattgctggtcctgggatctgtccacatggagcaaaccggtggctcatctggacaacagcaaggactggcaaaagggcttcatggtagattctagtgacatcacggtcgacgccacttgttgcaacgtcgagctcctgcctaagctggagggtcgcccggccatggcaaagctgcaggtagctcttcctacgctcagcttgacggatgctaatgttgtgtacgtcatgggcaaggttgacgcctctgacgagaaggcggtggtgttgatggttgacatggccaacaaaaggcttcaaatggtgtctgtgtatgatgctgagaggatcatcaacgactttgattactcctacacgcagtctaccatctcccaatatttcactacagctgcaggtgattacttaattcttgcgctgttctttctacttattgctttttttttcggtaactttgtgttgcatacgacagtaaacctgattcaaagttgtgattgctgatgtattttaaacctgtgtggctgctgctatagtgctagttggacttgttagtttaggctggaattattttgaacctcgctagactctttacctctctaattatggaagcctttggtgagattctagacaagttatagagtacagttccagacaagatgtagagagcacatgacatgcaagctatgtggaacacaaacccagtcaaatgcaactgcattttggattctagattgccttcatatgaaaattttcttgtcagtgcacgctatatcaagaacatacacataaacaaagtgagcctttaaaagaaattgtcagaaatgaaaacagaacaatttttctgcccccaacaaagtggagagagagaagaccattttaggtgctcttgcattttttaaacattcttgaactaaattggttgatgctctcgtaggttttctttttgtcatactctcatagggcttgggatgaagggttaggtacatttgtgtgtaggctatatgcactaattcatgggccctttgttttgctgttttactgggtgcaggtgtaaagggaaacctgaagagacctttgaaatttcatatgcaatatcctcacaagcggctgggtgaaacaatcagcaggagcgataatcctattgacttgcatgagccattgcaactggatactggatctggtatgggaactaaagacgaaactgaagacagcgttattcctatggacttggaatagccatgcatgcactaaacgggcataaattaattagagctgttatgaatcatgcccgggcataaattattataaattaagttgagctgttgaaaataatgcccgggcataaattaattagagctagctgttgaaaagcatgcccgttatgtattttggttattgtgcatgactgcatgtctacattttagatttgccttgaatggatatgttcatgctcttgttggactctgtttgatcgttcagagagttgtctttggagcctggtgttaacatattgatttaatttataattctgtttcagaaatatttttttcctactctacaattcagaaatagcaggggaagcccgctgctccattttcatgaaaccagataatagagtttgttgcggagagtggtcgttcgccacgacttgacctcctccgccaacgaaatgtattcgccaatacgcatactccctcctattctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaa

SEQ ID NO: 64245 - DNA, 24001 bp, Oryza sativa
tagcaccaatataatcagacgagcgtgcctagtgatcttctcaaatgtgactagaattgaaccacagaatatgctgaaaacccagctcattgctagagtcatacagcacgaacaatgggattgaaccactgaggtggataatttacatggtgtgtaggacagcagctcttatcatcacttcccagacgctatttgttttcagttcccatagtttgaactttgaaataagtccagagtcatgcggataccagcaaggaactcctgcaaatgcaaaatggagttcagacttcaaaggtttcaggaaaccaaattacaatgacaaatggacaacactgattgttaattcaggggtaattaattgataaaaaggatgaacaagactaattgttgatgctcctacttgatttgaaataggacactccaaaatgtaaatgaggtgatcaggcacatatagttaccaaatctcattccagtaatgtaaactgcttactgatgaaggtcacttaaatatgtccatgctcttggacgtcatattggattgttggccttgctataaattaacgatgctaacctaccggcttgggtgaaagagttaatatcgtttcacactctgacagatacattatttaagagactgcatattcatccaccaaaactagaaagaaactgcatgttgcatactagagtatgattgaatattgataggaagaaatctcagaaccaacatatgattgtaacttagtatctttagtacatcaataccaatgttaacataaggtctacaaggtcgcacacaaggaaagggatcctagttcctaaccttgtactgcttgagccacaatatgccagctatgcccacattatgccagctatgccagtgatgtaaactgcttattgacgaaggtcacttaaatatgtccatgctcgccttactagaaactattgggaacttatatatgaaggtcacttatagattattagccttgccagaaattaccaatggtaacctactggcctgtgtagaagggttactctgacagatacactacctaagaaactgcatgttcatccaccaaaaaccagaaagaaactgcctgttccatactctgtatgattgataggaagaaacttcagaaccaacatctggctgtaactcagtaccctcagtgcatcaataacaatgttctaaaacaagatttacagggccgcacaaggaacgggatcctaaccttgtactgcttaagccacacaataggccagctatgccatgtaaggctgtaagcactgcaatgcaggtgacaacacaatagcccttgccaccttttagaatcttgataattgaatgtcctgcctactctagtaccacttgttctacagtctacaggtcgtatgactcaactaacagaaaaggaagccaagacaaaatgttcagggtctccaaattttctggtgactgcaaaattgacagccataactttattgatctataatctctttctccatttagactagttggattaaactcatcatagacatcaataaaattaaagtttcaaaatccctacctatgaaattactgtatttttccttactagtgatcagcaactatttcttacctcctcaccatttctttactacaacaagcattgcggaggaaaacaggttcagtcattaactgtagtagggttttagctcgagctcggtcactcaaagagttaagaactagtatctgtgattttgtctgtgtgcttcttctcgaaagcgtggagccaagccaagccaagccaaccaagggattggattccctgcccatcccttccaagttattaactgtaaaactatgctgtgtctttaatctcatagttctaaatgtatctacgacgaattaacaatctcacctgatttatctgcttctcctgtgcctacttctcgacgaatgattcgacagtcttcaaccaccggagaagctccatcttttccttgttcgccatgtagtcgtgcaagaactcggcaagctcgtcatccacctccctctcctgcaagaatttcctcaccgactccctctccctagcctccagcttgctgcgaatcattcacagaagaggaacatcatcacagaccacataaaccagagagcaaaatcacaaaagcttccgtacacgaagtcgcggcctccgctgctggtgctggagccatcggcgtcccggagagtgaggacgtggcggacgacgagttcgtcgtgccaggcggagcagatgaagccgaggacgcggtccgcccgggagacctcgacgatgaggctgaggtggaggcgcgggccgcgctcgagcgactcgacgcggcggaagaggggcgcgtctgggggcggggcggcggcgccgtcgaacatggtggcgtcgaccttgacctcctcgtcctgggcgccgcgggtggcgcggaggcgcacccactgctcccccgggcggtcctccaccccgaacgatttgaaggccttcggcggctgcaacgcattcgtttctcggcgaatcagagaagacacacacacacagagagagagagagagagagagagctaagatgggggataggcacgttaggatgagaggataccgggtagggagggcggcgttcggagatgtagttgatctcggagcgcaggaggcggaggaggcggtcgtccatcggggagcgcagcggcgcgacgacggtggagaaggatggtttcgccggggaggaggccgcggcggcgagggagagagcccggcggactagggcgcgcgccatgtgttcgagcttttgcctctgcgaagcgtctgcctagaggcgagggttggttgaaggaaggatacgacgacgcggcggcggcggcgacctgacctgggctgcctaacattgcggcccgattctcctttgtggaatagaataagttcactagaggtcccttgatttgtcccagggtctgacagtcatctctgaaccgaaattctccactagctcatcctcaacttaccacatcatgttgagggaattttaagttcctgaggtatctaaatttttcataactcctctgaaaattgcgaaacgtatttattaaacctaattaattcgccattagcacatataggttactatagcacttatggctaatcacatgtgggttattatagtacttatgactaattatagactaattaagttcaaaagattcgtctcgcgatttatgtaaactgtgcaattagtttttttaatctatatttaatgctccatgcatatgtccaaagattcgaagtgacgtttttttggcaaatttatttgaaaactaaacaaggccttaggcttaacactatgaacaacggcgtgctattaggaaaacttccggattcggacctattttcgaaaatggaatctgtcggtcggaattttttcgaaaacggaaacgaattcggaaatattttcttggaaactgaatcggaaatgataagggcagtttccgtcggaactcggaatcggtccgaaactttccgaaaattttctcagaagtactagaaattttgtgactaaaataccctggattctttttttaagcactaaatagtgaataccatggtgtttggctgttatttttataaaaaatatgtgttatgcaaatctaaaattacataagaatattttttgtcctacattggaatttatcaacaacattactctttcaattggatttatcactttgatgggttttttatttcgataaattttcgttaccgtattcgcgccggttcattttcgctccgttttcggtttcgataatattcgattccgttttcgtatccggggtttccgatttcgactctgaaaaaaaatatgaaaacgaaaacgataaagatggtttccgtccgtttccgtaccgttttcactcctacgtgctatgccgcatatgggaggcagtctggtcaccttgcgcccaacagcccgccagctgttcgacgcaatgccccaaccccaacctcttcacctgcaacgtccatctctcgctactcatccctctccgtgtccttgctggacgatgatcgaatatttggcgcagaagcagaacgcactggatgttttcaggagaatgagagcacagcagcattggtcaatacaagaacatactcagttcacatatttttcatgttccaggagaagaacaataagagtacatcaatttgtggatgctttcttggtagaggagtggccaaccatgtaggagccgaacccccatacggtgatgagcagagacaggatcttgaagccgctcatggggtcatggaaccagatcaccgccgcgatgctcgtcaccggcaccctcacggcgttgagcacgccggcgaggacggtcgacgccaggaacagcacgccggtgccccccagcaccccgagctggaacgtcaccgccgaccacaccatcaccatcgcgtacgacgcctcgccgtgcctgaacgccgccgcctcccgccgcatcgccgggaagccgccgccgctcacggcgagcccgacggtggtgaacgcgaaggcgcagagcgacaccatcgcctgctgctccagcacgacgtggaacgacctccggccgaggacccggacgaacaccagctccgacagcgcgaagatgaggccgtggagcgccgacccgagcacgtcccagacgagccccagcgcgtactgcctgcccgtgatcccggggtacctgtccgacccggagtccagcgcgatgatcaccacgccggcggttatgacgacgacggcgttcagcgacgacagccgcagcctgttcttcgcgatggcgcagccgaacagcgccgagaacgctagcgacgacgcggcgacgagcgacgccgtggacgccgggaggtaggcgtaggcccaggcgtacatgaggttgtcggcggcgctcaggaggccgagcagcgcgtaccaggcgcacagcttcggcgacagcggcgtcggcgccgccttgccggcgaggtagcacggcagcaggaggagcgccggcagcggccagccggcgacggcggaccacgacaggatccacttgctctgcccgccgttgttgtagtacagccgcgacaggaggctcgacgccgggaacgctgtgagcatcgcgccggcgctgaggacgagcagcagccagaaggacatgggcttgctccggtacgtctccatggaggaggcaaccatcgctgctgccttctgacgcagagagcgatctgctgcctctgatgaggtctcctccattgctgcaacttctactgctgttcatgacagggacaaatattcagaagatttcatcattatctgaataaaattcagaagatttcggattctgtctacagctccagcttggtgaagaggagtattttctgaacaataacgttgtgttaacatttgaaaacatggttagattggtagtaactccagaaataaaacagagtgaatggttgagtgcctagagatttctgcaatactagtatgatccaacaaaataaatttcattattgctaaataacaatgatgttgtttggatcccacaaatccaaaattattttaaaaaaacaaaatataatattacaattgtaccatacttattaatgttttcccaccatatttattaattcttcatgacaattgtaccatgcataataacattattgtataaccaaacaaaccttcttttgtgtttgtttccaggtctgcaaaacttttgaatttttttttggaaataatacgattttaatgaaaaatcgtaaaaaatatatgtcgattaggtgaaatcgagcaccctatcgaacaaccgtagttcgataggacacctatcagttcgacaggtaataaaataatttaaaaaaagagaaaaaaacattgtagcatcactgtagcatcatccctgtcgaacactgcctgttcgatatgtcctcctatcgttctttgcttgcttgatatgtctctgcgtactttttaaatttttttttcttgaccaactaccttgttaaattgccacagttcgacaaatacccgtcgatatgcagatgttcgataggttctcctgtcgaatcgtggttgttcaacagggtactaaacttgcgatttcgcctaaccgacctatatttttgcaattttccattaaaatcgtattatgtaaaaaaaaatccaaaactttcggcatgcaggagacaaataagaaaaaaaaatacgcgaaaatctgctacaggaaaaacacgcacacaattgtcatggccccgcaacaacctcaacaattctcatggcacatcagagtctccaaaatcaagaaacaaaaatagaagagttgaattaggactgcgacatcaactttgcaaagggagtcagcttcaagtgaaaaaaaagaagccttttttttgaagggttgttaatttttacagtagctaccaagctcaagaagcagtaatactctactcccaaataactcagaaaatccttcccaattgaaggtacacacaaaacgtagtgccatggccttcttttgtcctaaaactacgcagatgagcacgaattattcacaccgacgatgagaattggtagaatcaagggaggaagctcactaggttttgctcggcaattaggaaaaaaaacagagaagaaaagaagaaggacagacctgacgctgggacctggacgacatgatgatggcgtccctcaccgtcgccgtcgccgtcgcggtgctggttcctctccatctgccgccgccgccgtcggtcgcggagtcgcggacagctagggaggaagctacactctccgggtctcccagagaagacgacgatatgattattgatgacttgctggaacagccaagccaacagacagcctcctggtgatacgtctacgaaaaccaacctgaactctggtctggttcgtgcacgtcgctcgctcgctcggacgaattttgtttatctataaataatctggtggtcgtagtggcacaaatttttcatcaaagtacggaagtatatttaattatggaaggagaattagtactttattacccccgtttccactgaagtgttgaccgatacggcgcgtttcagcgtgaagaaagggagcgcttttttttgggcgtgtgtggtgtccgggttgggaagctgcccactccacaaagaacacgcgaaacaactgaaaaaaatgttacatctctgaatctcacaaaaagcgatttaaaaccaagtagtactagttaactaattaaggtcataccacctacaactttaattatcatcatcttatataaggaatatcacgttctttgtgtgacgcctggtaaacaaaataatataatataattacaagctgcaactcacaaaggcttcattgcttctggaggtgcgttgttttcgtttcattgagctggttaatgatcaggagttggcaggtgacgaagctttggaaaaactggagtaaacagtcatattatttgggaaatcaaacattaattaaaaacagtcaggcaacaagcccactatataaaatcatatcagaaacaggatggacaaaacagcaacaacaaaattaggatttcccaacaaatatggagagaatgaagtatttgacagatgtactgtatctagagagcacaggacacagacagacaaccataatagtgtaaaatcgctttgcctcttctcaaaatgaatagtatccgacttcagagtggatatgatacatggtttctagcattctcttcaatacacagctcagctaatgatgctgcgaatgtgcaaataaacacctcaactagcatccctctcttatctctaaactgactgaaaaagaatcacttgggtaatgtaataaattgtgcctgtctatttgtcaaaaatgtacactatacaatgtaaataggaaatttaagacagtttggagatcttgtgttgcctggcatcatcctgccatataaatactagattcttgtgaagcagcaaattatcacgacctgtggatctcacccatatatgtgaaaataggaattggtgtatttgtatctgactctgggggataaatatatgttgatatatgtcatctagcaagaggttcaagctggacctccatcacaccagaaggacttgattctgaattcctgtctgtactgtcaggatgcaaaagatcaactgaatcgtcttcctcggtgttacctaacacccagtgccctctagagcttgtgtcgccgctcctccgtttgacctctttatactccaagtaaagtgttataactatagcagaaagcacccacagcatcaaggcccaagtgagctcctctacattctcgctatcatacctatggcctaaatgcttcattccagtgaaaagtgccacaattccgactatgattgccgacctgcctgtgataacatgaaggtattcccagaggacacgattccaggatgaagcctccccattagctggtctcttgggccggaagtaggcatttagtggctgaagacctgccaacagcagagccgtgacaccaaatttaacatgcactgagctgacataaaaacctctgagttcagctgcagcgaaaaggacaccaaggaacattatagcaattcctgagtattgcagatagacatgtatttggtaccacccgtcacctttcaagttcttcaaataccgggcagccagtattccaccaggaagcaagatgccccaggcaacaaacatcataaacccatgaacagccagaacaggacgcaagtcctgttctgcctcagcagaacctctcaacaaaagcacacgtatggggcgactgcttgtgatagaatgcatgttactatctgtaagactgttacctgaccagcttgcacccatagcccaaacgaccttaaggggcgtggttggatcaataatgttcttacactctacccttccactacaggaaggcctaagaggacgagtaaactcaaatgtaataatgccattttctgacctacacctgacgtaggttaagttctcagatgttgggtggatgcccgctgcactctttccatcaatccagtaactcttgactcgcccaactccatcattgccaacccagccaacataagcataactgttcagcatgccactcccgaacccaacagcaaggtacccacttttcttctcacctcgagctgctatagatatagaatcatgggacagagtccagaacagagtaacctgctgatcatccaaaaggacgctgctattatacatgtcactaaggcctccatcaacaacttgaactttccaacccatcttcggttcatacaatgactggtagtagactagatcaggtgtattccgatcaggcagccaaagcagctctgtaggagttgctggtacaccatgagcatcccggctgccagcatatatgacctctgttttattccgcagtgtagcattccccccaattggatccgacgtgatgtaaagtgcaacatcatgcccagcctgcactgagaacttcactggcacacctctctcaaccttcagcagaggagcctccttcttgttgatgtaaatcaccttgtcagggtttggtgggtttgggtagcggacggctggagcagatgtcaccaccaggggtgtctttgcatccgcgatgatcctctcctgatcctccttgttgtcagcatccaatggtccgttgcagctgtccaccgtttccgacaaattcacccttgcaaacccataggttgtgtccctcggccccccatggttctgcgggaggtagtgtggcctcagagtatccggcggccgcagcttcccaatggcccagacaaccgccatctcctccgtggcactcaccagcacatcatacttggtatccccagtgtcaagcttcctctgatacctcacgaaagacactccatcccgccggtgaccgtacaccagcaatgaatcattcttcccctcatcataaaccttgtcagggcacacaccagataccggcgattcatcggtccccagcgtgcactcgctgtagtcggttatgtagtagtcctcggcgaatggcataccttcctcggtgaatccggcgacggcaacatcggaatggatcatggcgggagaattggccttgggatcagcccacccgaacgccatgtagtactcggagcccacggcggcctcgaggccgatctcgactgtgccggcggaggcattgagcgtccaacggagacggtacttgttctcggcgagagggaggcagttgtcgaacatggtgggaacaggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccagaagcgcgcggagggggagcccgcgaggaggtcgaagcgggtgaggcgcagcgcgcaggagtcgtcgtcggcgaggcggaccgtgccgcggagctggtgctgcagcatggtgaagtccgcggcgaagggcgcggtgtggttggcgtgcgggcacacggcggccgacgacgacgccaccagggccccgatcgcgaccgcgagtacggcgaggcggagggggcggcggccatggccgcggccgcgggggagggatcgagatctggagaggaggcggcaacgcgtggagtggagggatctggaagcggagggggttgggttggttggatgagttgagttgagttgggctcgctcgcttgctcgcggctgcggctgcggcggagtggggcgaggcgaggcgagcgggcggggtggaggtggggtggccgagatccactttgggtggtggactgatggaggccgtgcgccgcgtgggaatgtgcgatgcttcgtagggaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgtatgaaataaaaatatccctaaaacaatgtaatgtgtctcaatcatggtatcatgaacccatcattcaaattttcactcgagatcgcgatatatgaatggagggggaaaaacctggtaggctcatttggcagctcgggttaccggcccattccccggatgaaaggcccacgggctaaattacacgcgcgtttggaagcccacaacagtcgcgtccacgcctgcgtcacgccgcagccgccgcgagatgccgccgccggccgggccgccggagtaactccggtaaactcaatcgattgctttggagcaaaacttgggactgactacgtgaaagattgtctgctcaattgaaaaccggtaaactctcacccggatctccatgaattggattttattttttcaggaagtaggaacttctgtttttagattggcaaattatgtttgttcacatttattagtttttatattaatattatattttcaagatgataatgaacagattccatgtagacaagttatattgctcctttttttttttgactacagacatcctatgcttggttagagtaaatcctctgatagccctgttttgggctgggacttaatatgtgaaaattttgccaaagctacatgttacatgtatatttctgtaggccattaaaaccaactggtttgagtcagagtttcatatactggaagcaatactggatttacttgataaccaatcactggaaacaatactaaaatgcatgaatatagaaggaaaatcctaaatttgcttaatattttttttctaaaactaatatctggtaactatccaggaattgaattgaatctgtgctgtggaaaactatagtcactgcaatcacatcaatactattataaatagtgtaattgctaggttatcatggcaagtttatttggttgttttacatcaatgaaaaagcagtgcaagtttttaggtcttctctttgtgacaatatatcagtaacatcagaaattgagacattaatcaggtgaacttgttttattttttttttgcagtcaccactaaaatgtaatatcagtgccgcatagaagtgatcatgcatataataagaaattgaagaagagagctatggaacaagtagatcttgtcaactagaatcgctaggtggtggttctttttaattgtttccccttgatagctaacctgtcaatgttgaagtaacattttgtatgatcgttcgtatatgtaggcctatagccagctccaatacctttttttttgcactatatgtggtgcatttcagcttcatgccctgaccattaacatgatctggttgtatgcccctcctgattgaagctagtgctataccaatcaactcccaaggattaattcctattgccactcgttggttccagtccttgcttgttatggtgcatagagcaaggtaatcagtctcataccatctgcttggtatagaactgatcatcatgcggagttcgttcttcgattcaccacttgcgctgagtaacatggactctgaaaatcatgtcaccaaattgggttattttcaggcatgaaatctgtcgtcaatagatattagaaggctgcatgtatgtattgtttgcagtaatcctgttagaacagaaattcttgatcatgtactttagtccgcatgttacatgtgcagtatagaaaactattttttttcttctttcagctagtacaataatggaactgtctgagttgaacattcaaacaattgaagttgatggctaaaatgttgtatcagaaatgtgagatgttgagaggacttacaggcttgcattgcatatttaccaatgataaatgataactcaaatatttattcatattcttatactgcctttctttccaactgaacatttagaacccaaacatgtacatgatgtacattttgcgtgaaggttaacaagcagccatatatatagctccaactgcgaggatataacaaaatcttttcacccaaagaagttaacactgcatttattttttacatgtatatttatttataacatgtaaaaactaggtcctagagacacttgtaacttgttgcacatgtatgttcatttacatgtgaatgagtttattcagcgccgtgttttctaccgaattttgtctgaatttggcatttgtacaccgtgacaagctttatagtgggacaaaggtcgctagctggcaagggcaggattcgatggattttttgttctccaatcgatgaaagattttaaaggcattctttgcttgtccaggagataaagatagaattatgccgtgttcactacattgctgatttcaacccaacaaaacttgataatttggtgttatcaaaatttaatagtttaacaaactacacaagccttaccgttatcaacctatcataattttgtaacttcgaaagttttcgctcacagaaattctgagaatgattgacgtcggtcgcccggcgcgggggagccggatcgggcgctcccccctcgcacccctccccccacgtgtgggcccgcccacttctttctcatttttccacaaaagatgtttcattcagtgtatttataatgtttcactatttatagatctaatgttgcagtgaattaaaatactttttttaaaaaaagaaacccacatattttggaaattctccattaaaggaatttggtttattttttgttccaccaaaaatgtttcacccagtgtattaacaatgtttcactatgtatagatctaatgttgcagtgaacaaaacattccattgcaacaaaaaaaacctacatattttggaaaccccctattaagggaatttagtttatttttttttccaccgaaaaatgttgcacctagtgtactcataatgtttcacttatgtatagatctaatgttacagtgaactgaaacattctttcgctatttactgaaacattatttttatatagggtgaaataacacccgatttaaatgagtgaaacattttcgatctacttagtgaaacaattctgatatatttgttggaacatcatgcaacatttaaaaataattcaataataagctaaaaaaattcatcggaatatattcatgtgtggtcttattttgaagatttaattgcaacgaatttaatggtgcaatcggatcatgatttggataagtaatttaagagaaatcagtttaaagtagtttttgcacgtaaatcgggcgctgatgtcagcgcccgatttttctcaaattcgatcgggcaaccgatcggtaggagtgccccaaaaattccaccgaaatttaaggctacgttcgttccccagggtttccaactccccaccctcattttcgtgcgtacgcttttcaaactactaaacggtgtgtttttttgcaaaaagtttctatacaaaagttgtttaaaaaatcatattaatctattctttaaaaaatagctaatatttaattaatcacacgttaatgcgaacatcgttttacgtgccggatagcgaacagagccttagctctaaaccaacttatccaatgctaccaaaatttagtatcatatcaaaatttgatattgccgaatttcggtgtggttgatttttcaataaaatagaaaagtccttaatttagacccagaagcttcacacaatctaccgtttgaatatttgcatttaccaaagttttcaaaaaaagaaaatttgaatttaccagcatcggctgcctcgccgggtcaaacgacgccgcccgcatgtgcagagccacgtggtcaaacgacgaagccgacactgtaaacataattacacgaaacttgaaggtccaaaacgcaaaaaaaataaacttctatccgataaaaaccccgggaaagatccacccgacgccccaagctttcttcctcctccgcgcgcgggtcgtcgccgtcgccgccgcccccgccgcatcgccgccgccgcgctcagatccagacccctgagacatggtctctcgccgagcgatgcgagcgccggagatgctccggtggctcgccgcggcggcggcgctcgtggctctgctcgccgccgcgccggccgccgggttctacctgcccggcgtcgcccccaccgacttcgggaaggttcgaatcgctgctctgatcccatccccctcttcgtcgagctaggaattgctgcgcgcgtgctcgggtttggatctgggtcgttggtcaacggggtgggggttcggttccatggctgggatgggatgggatctcgtagatctggctttgggtgttaggtactcctgattcgattattggtggtgggatatatatctgagcttgggattcacacggttgcaccaacaattcgcttgttccaaatacttccatttggtccatttggagtgtgtaggttgcatgcatcatcaaactcttgtagtaatggtggatttaagccaaaaatagctagtttggttgattttgtataaactttgacatcagattttggttgttctgagtagtaacattaaactacctctcgttaaacgtgtgtgtttccaacaagtattgtattggaataggtgattctgagaaaatccattggtttgaaccaaagttaagctcaataaacggatgtgcactggccatccgagccaagcagaagttccgtctcggaaaaaactcaactcacagtaattgcataccacaagatcatcttctgaagggttactcattaaaaatccattgccattacactaaaagaaggccatcgcttaaatgatctgaactgtaattctttgcttgccttcttttcctctggtgtatctaggtccagtggttattccagcttatctgattttgcctatggaattagatgatcacaaagttaacatagaacaatgcatgggcactggtttctgaaattgggttggtgagtcacccaataatgcattggttcactgcttcatcgatcataattataactattgttctgcttagttcttttccaaagaagattcatttgttagatcagactggtttggctcatcttcctgtttctttgcacttgtagtttcatgtgtacacatgccatgccgcatcttgatatgttaagtccaaataaatgttacctttaacaaggaatagtttagggcatcataacattttatttgtggccaggatttcccttataattgcctttcctgtttatctacagggtgattcacttcccgtgaaggtgaataagctgacatcagtaaaaactcaactaccctatgcatattactcccttcctttctgcaagccagaaactatcgttgacagtgctgaaaatctcggtgaggttcttcgtggtgatcgcattgagaactctccatatgtggttagtaccgggtaactcatattttgaagtttatgtccttgaagtaatatgccttaatctctgtttgccatcattctttttgtttgagctacagtttcaaatgagagagcccaagatgtgccagattgtctgcaaattaactgttggtgagaaagaagcaaaggagctcaaggaaaagatagaggatgaatatcgtgtgaacatgtaagggatatataggtaatgttgcacttcaagtcacagtatcttccaaagtgacatgatttgttttgcaggattcttgacaatctcccgctagttgtttctgtgttaaggcaagataagaacattgcttaccaaggtggctatcatgttggtgtcaagggccagtacaccggagtaagttgtgcactcaattgatgcttgcttgaccttctatttattcatatatgctctggattaacaaactgtgatatataaatgtattcacagagcaaggaagagaagtacttcattcacaaccatttgtcatttttagtgaagtaccacaaggacgatgattcagaactttctagaatagtgggatttgaggtcaagccatacaggttttctttctactttgtgctttgatgttttacttgcatatgctctatataaatgagcctaatgcatgtgttatttatatactgttatggcagcattaagcatcagcttgatgataaatgggatggcgtgaacactcgcctgagcacatgtgaccctcatgctaacaagcttgtaacaagttctgactctcctcaggaggtcgaagctggcaaagaaatcatattcacctatgatgttcactttgaggtactagttttgcatgttttgtttggattctgtttcccccttcatgtgatagttgcctattctcttaatgttaaatttattgcaatgatttccattgaatctttttccctcattgcaggagagtgacatcaagtgggcttcccgttgggacacctatctgttgatgactgatgatcagattcactggttttctattgtcaactctctcatgatcgtgcttttcctgtctggtatggtcgcaatgataatgcttcgcactctatatagagatatctctagatacaaccaacttgaaactcaagaagaagcgcaagaggaaactggctggaagcttgttcatggagatgtgttccgccccccaaccaactctgatttactctgcgtttatgttggtactggtgtccaattcttcggcatgctgctggttacgatgatttttgcagttctgggtttcctttctccatcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagttaaaaccaacaagattccaaggcagatccccgagcaagcttggtacatgaatccaatcttcactattctaattggtggcattctaccatttggtgctgttttcattgagctattcttcatcctcacctctatctggcttcaccaattctactatatctttggcttcctcttcctcgtctttgttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtactttgggtacatgttgcttgcttcattagcgttctttgtgcttactggtactatcggtttctgcgcttgtttctggttcacgaggttgatttactcatctgtgaagattgattagttgcaacactacagagcacagcatatgtttttaagccttctgagtcatgggaattgtatgttcgaagtggggatcaatcccctgggtttttttaaagaaattttcagtgaagttacattttaggttttagtttatgaacaatttatgtttgttatggctaaacgatacatcttactgtagtaatttggagtacaagactacaaggatagaacacattgtgatggagttgttttttggtgaaatttttttaatggactggtataagaattcaattgattatgaactgcttgtactctaatcaatggtattattgactctggcaccagtatgaaatcaatatgatgtaccagtaacaatttaatcactgttatattattagaatgaaatgtcccttttgctttcaagtactatccaacctgggtgttggtggtgtgctctgggtgtgtgacatttctcccatttttaattttgcttgtggttggaactttggaggcatcggtatgaaattgctccgcattctgtggcatgatttctcagaccgtcgggagacatggaatcaatatcaacttgccatgatcaatgtctttttcagtcttgtcgtctgagttgccctgccatgtgggcgtccgcatgttttcacgttccacggcgtgtagacggcggcgacaagctggggccagggcggcgtgtttgccgccggcgtcgagggcggtggcgcgtgatgattcaaatttcgcccaatttgcactaatccatggtaccttgttcaggccaaaggctgaacaaaaaagggtccagatttctgacacgaacggcacataaatcaaatcaaatcgcccgtgcttctctctcccctcctcttacccttccattggctccctgggttgagctcggcggcggcgcaatggcgtgccacctgctgctcgtcgccgtcgtcgccggcttcgccgtgagcctcgccggtgcgacggaccatatcgtcggcgctaaccacggctggaacccaaacatcgactactccctctggtccggcaaccagaccttctacgtcggcgacctcatctgtaagcctcctctctccatctcctcctttctttcgctccagcagcaatgatttccgacgacgagatgcttgtgcttgtgccggcgttgcagcgttcaggtaccagaaggggacgcacaacgtgttcgaggtgaaccagacggggtacgacaactgcaccatggccggggtcgccggcaactggacctccggcaaggacttcatcccgctcaacgactcacgccgctactacttcatctgcggcaacggcttctgccaggccggcatgaaggtcgccatcaccgtccacccgctgaagcacaatgccaccggcgacggcgccaagaaccacggcggcgacggagccgcacaggaggccgccgctgccgccatgccgggcgccgccgtgtggatggcagtgctcgccgtggccgccgcagctgtcgccatattgccatgattaattaatctctgcacttgtgcttggaagaactcaagaacattggcacattgtgtgttttgctcgcatttttatcagggacttgattaatgtagcaccaaaatcagatttatattcaagtattaattcagcaagaatattggttcatgatagagcatcaggattcaggaaaaaatttccaggcggagaaagcagcgacaggatggagcattggaaaattcatgcatttcacacaacccagttcgattaagcaacatggcatgtattacaggttgtggtgcaagaaaaagatgctagttgaaagaaagaacaaaccctatagtgactgtagaatagaatcccttttcttatatacaccacttactatcctttttgtctatcaccggttggaactccatggttcggtctcggcctgctacttgtttggatcgcttgggccatcatcaagctcgctgttcacaaaggtaagggctcaaattctgaaaggggaactcaggcttttacaatgcgagatttcgtgatctggaatatggtttaggtgcgacggttaaaggaagctcactttggtcgcatctcttctgaagagacagattgatttgtgcttgaagtagcagctgacttgcttggcttcttgaacttgactatgatcactgtcatattatcacagccatcaccaccggatacaggtgccaagcaatggtcaagcaacttctcgcagacagcagataggctatcctcctgtagttgttttcccagtaaattaggaaaccataacataagcatattgcaaaacacaacactatgaactatatatttttagtgcataatgtaaattctgtgaatatcagttgcttacagtgttcatttctttgtgaacaaagtccaccacttcttgacttgacatgcaatccctgtcataagataaatttacgtctcagataaactatccagtgaaactacaaagaatacagaataatccatagaagagttgacaaaagatctagcaccatttcaaaataactgcaggtataaaaaatcagcttcacatctagtatacaaagttatctggatgtttatgtatctgggatccattataaaagaagttacatatcagcatctgcacgccacacagtgcactagtacacatcatctaaaaagaattgtgaattactatctccaagggctgtccaaatggtttaccaatagaagatgatgtcatttctttggacttaccctaattacaactattgtttctttttactaaaaaaatcaaatctgctaataaactaaaactgttgttggaaaattgagttgtcaaaaatcagcagcagctacaccagatggtaaaaatagctaaaattgttatctcaataagatattcaagagagaatgattggtgcaaaggacataccatatgccatcacatgctaaaacgatgaactcatcatcctcagaaagtttaacctgagcaagccgaataaattccatgttacaaaaaatgttgtccaaagcaaatacagtgacagaaattgtcaacaaaacccactgtgtttaattcaggttcagcagtgacaatctgtctctcggctgggagaaattcattctgcttcaattccatatcccctggtggaaaagcacaaaaggataaataaaaattatgcgtgtagctaaggaattgtttttcgatgagaagagagggtgctacctattgcccttgccaagttcaaacttccattgacccgcccagcaacaatgaaaccaccagcattcagtatcctctccttttctgcatcaagatctggcttgtgatcttttgacaggtcataagcctatgcagaagactgagtcaggacacatattctaacattttcttcacaaataaaaccagagatatagaggtctgactgacgtactcgacccttccttgagagcacacaccgggaatcaccagcatttgcaacaatgagttcatcatttcttatgatagccacacaagcagtgcttccagatgttggcccaggaaaatgagaatgaggaccctggttaagtaacttagttagagcagtttagttgaactctacattcactagaatttcacaagaacagtttctttttaggaaacaaggtcatgtataaaaatatagaactctggagctgatgtttcgtaagttacatatatgctcagtgctaacgaatggtgcatattccctttgttttccttatttgtacaaacatattttgtaataatgtatttcaccaaatgaattttagatcacatgttatcatgcttaaaaataactggacatcaccttctaatataaactagtgttgacctaagtttcagatgcaacgatcataggcactcctgactcaagagcacttctcatattttcaagataactactagagagacatcccttaaggatttaaatgggtattttaagaaagacatccctctctgcagaaaccctaatcacataacaagcaggaccaagcccccttcaccaatccacatacttaagagcagcaccactcaagacaagcctctttaaatatgaattcagaattactagcatcgaatcagtttttagtattttatcccgtcaaatgcttgttctaccaaggaataactctgaagcatcatgacatcaaagatggcccctcaattccatcatccagcaaaaatggttggtaatgaaggaacttttagaatagcagttttacctcctcagtccaagtgtcctcaggtttatctgactctccaggtttcggggaccatattatgccttctaacatgccagtaaacttttgtcccttgtcccccaattcagccagttccctccaccccctttgccctttcatcatctcatccattctgaaagggtaaaaagcggtgcagactcattaaaaccaccaagcatacgatagtttcactgaaaagcacttcatgttcaaaagaggtacatgctacatacctgaaaaatgactttaagacagaagtagccaaatcaccagatgaataagcctcatttttcagtacttgcaagtgtagatgtttcgcacaaaacttagatactgccttccctggaattacaaaggacagtttgtcaagtcacaacataaagagttttgtccatgatgtggataaaaggacaacatagaagcgcattaagttttggtttcaaaaaaaatatatgaaaaagatgaatcaatttaaacctactcaatgcacttctaccttttacaacgatcaaaaagggaatgtgaaa

SEQ ID NO: 64246 - DNA, 2527 bp, Oryza sativa
gggaggggaggaggaggtgggcgagtatttgtagggggcggaagcgacgggaagaggagaggagagccggagaggaggagtcggaggcggaggcggaagggaaggagggagatgaggaggggtgggggattcggggaagattgcgtatctcctttttctattcaccgccaccctcccttctctctctcgctcgccgccctgttgcaatgccctctcctcctccggtagatcaccgatccaccgttttggtggttatcaacagatacatatactcctgcctcagaatttatctctagccttttctttcttttgaaatagagaatttatctctagtaaagaaataatttcttgttttgatttgtgcttctttgttaaaatatatctgcagttattacatcacgatcgtattatcatcgaataactcttgtgagaataatctaatgtttttaacatgagcatatagttgtaagaattaatctagtgattgaatagtttgctttatttacttttccttttcttatatcgaagtttacttttacggtatacctataaatgattattgttaattgcaattagatttgagccattactgagtatatatgatgaaataatagtattctcaaccacatccatagtagaggctttactacattcgaattagattgcagccgataattatagttaatattttggttttttattacaattcaaaggcacatataaaatgaattaaatataaaaaaataaagatggattttgaaaagtatctaagaaatttctatatataatgtttcttaaaaaatctatttagttgcttaggaaacgtgcacataataattcagaagctaagaatataggttaaatcgtggcacatttatcatggcaactactagtttcttttggcaacttcttaggtgtactagtttctcgtacaatactcacacgtttattttgttccataaaaacgaaacattatgtactttatgcagcttaattaatagcttaaaacatgaatgacattgatccaaaactaccttccatcatcaaattgcaatgctacaaatgtgagtatctaccttccattgtcaccttgtgcaaaaagctttatctattcacgtggcacggaaaattacttctcatattggatgaacggaaaagtattcattattaacctgtggatacacttctgaacgaactctgttcatactcgcaaggatcaaacggagtttgacaggatatatagtgattatctcaccgtttgatttgtcaccatcaaactttcaagccccaggtggctaaacaccacacatcaagatagattttttcttttctactttctaactgatgtctcaaaagtattggcttcagtgtatgaacaaaaatttacagctgggatgtcaagctctctgaacatctgtcaccctttgtttgattgatttcttggaggataaaattagataagctaattgtagttgttaagcaaaagcgattagatggtcacacatgtcggcatgtcaaggctacacagcctttttaatggcggcaaaaaatgcaattatgcaaacatcacaatgctttgctatcccactgtacttaacctccataatatataattaaggagaccttaagacagccacacgtcagctaatctccaacagtattctactagtatacattattcttaaagggttaattaaagtcggtacgctactaatcatgccaggaggatactctgtacgtagtatgctcctgtagcttatcataatctcttcagattcagagttcgtttttctctttcagaacaagaagattacggatcaaactcacatagctaagaacttcattaattatgttcctgaatcttcaccagaatcacagtacaatccttcatatatgcacacatccagccagccaattagagtaaagagatctcgccatttttcaggaatatttttctcctgatcatctgtcgcttttccagccattttttcagagttgagactttcagtttcagggtagttttaggttgtttcgtgtgtgcttctgcaggcagagctgggatcctggcatgtgttgccgtgttggccactaactcctgggagcctatggattaattgagccgataacattataataataatcttaattcttaatcttaatcacgcagctcacgttgggtttgatggtacaagacgaggatcattcccaatgcaaacctgtctgtcagatttgttgtccctggatctcgtaatcttgtaatatatccgcgatcaaagcttttttagtgttcacgaaaaaaaaaatgatctgtacgtgggcactttattggacttagaatttgacattgttatcgcagattgatttgcatttgaggttgctaaatacggtaaactgtgcgattagcatgctaattaagtagtcatatgatctagctggcatgggattagtacgggtagatgttaatgcgatgcttttggttagtttacagccaattggggctcctggtttgctaggctggtcccccagg

SEQ ID NO: 64247 - DNA, 911 bp, Oryza sativa
aatcacttgatcctgtcacttgtgtcctctgttatctgcgctttctgaacgacatcttcatactgatgtcgaatcatagatggatattataaaatacatgaagagaatgcttgtttctggtgctgaatgttcgtgcccatgtgatattcagtgattctgttagattgtgaacgcctgatgaatagattgtgtgtagctgctcatgaagtttctttaatgtttcatttctgattgcaacgattctgtctgccctgctgtgagagagatgcccctgaccttccctgtccacttgactatgctgatcaggttgtgtatgtgcattatattcaagggtacataaactgtcgcatccgattctctgtttcgttttcttaataatgcagtcatccttaattgggttggacgttcttaattgggttagacgtcatcgttgaccaatacatttgctgtattatataaagatacaactcgttgaagagatatgaggtggatcaaagtatgtgattttagttctgaattgatataaaatgtcacgttcttggggatgtctgaaactctgaattgttgttgtatgtcgatccatcggtgcggcatccagaggctggcatgcaggtcggtatatcaacgattgatctgcatatctttttcataaaattgcatgtctcagactcagcatgctactctaccatatggaggcatggagccttcgtttctggaactgaaacggcagaaaaactcattagtcgtcagaggtgagaagaattcacgggctgcaggttctgggagctatgaacagcgtacttatgaattttgacagcaatcacataggctgtgttaagatccaaagtttggatccaaacttcagtccttttccatcacatcaacctgtcatacacacacaacttttcagt

SEQ ID NO: 64248 - DNA, 707 bp, Oryza sativa
tggtgtcatagatcaaattttccttcttggaagtagattagtcatattcatcctttgatttcgtcctacaagtgttagccaaaacaggagattgatcttttataacatttcttatttttctgctgtcccacttttcaggctgaagggctctacagagcagtctttaacatctgctctaacaagtattatggatgccctgaagagtagtgattggactacaaggaaagcagcttcaatagctctatctagtattgctctcagttctggatatctggttgcctcctttagaacttcctgccttcgctcccttgaacgttctaaatttgacaaggtcagcatactaaacattcatgctgtaatattttcttgcatatgctacacttatttttctgacttctgtcacaggtcaaaccagtgcgtgatgcaattacccaagccattcagttgtggaaggttattccagggtctgatactcccgagccatcagaagctggatcatccacaaaaggtattacaatccttataagtagatttttggcctggtgtgatcttctgacttctgcaaattaaaagaagagattggatactactttctgaagcttgttgacaatactaatccctttgttttttttagcaatttgtactctcataatactttttagtttcttgagaactagtgcattgaccccaaaagataacgggtttat

SEQ ID NO: 64249 - DNA, 1928 bp, Oryza sativa
tggataactcatattcatgccaaataatgccttacacacagtaccaataatttataatcctggtgcaagtctaaattgtgatatcactctgactactactcctacagtcattttaccaaccttctcttttgtcacaatccctgcatttttattgagtattggaagctgaaactagtagtaccagtgtactaaaaaacattcggacttatcagagctttacagcttttattcaaagtttatgccactcatgaatttgttccatgggcctgtgaagacgcaatgaatgtaaagtcagcaattaggcgtctgaaattacatgtctgctttgtctgacagtcacaattatacgctcattattttccaaaacactgtgcacacatcttccaactctcattcagtcattctgtttccatgaaggcgtccagtctcttgataatgtctccatgaaaggcttcctatgctgctatcatgagtgcctcgacaccatcagacatcagtgctgcctatctgatcatgtttcattactgactgtacactgaacatgcagtgtttcactggtaccagctggtattgtcaaattcttttttcttccctgaagaaacagtatcgtcaaattcttttgcatctccttaactgaagtccctctatccaaaaaaaaaaaaagcttcttggaatgaatccggacaagtgaagatggttttttttgacggagagagtacgttctcccgaacatgagcagcaacatgactgcatcctatagtttcagtgagagaaatgtctggttaagtgccgtgttactatttcatggctcctcaaagctggcagtgaatgggaaacgtgtggttaaacatggagcagacagcagcagagtggtcggcaggtcggcaagtgtccctctactgctgctgctgctgctgcttgctcatcatcaagattcaagaggagcttgacctggacgtctcctctgctccatgtttgtggattgatcagtgggcaccactcaaccatcataatcctaggtaggatttggaggatgagtacactcttttgtgctcaccactgacttggatggcatattctccatgcaactttaaagtcctttccgttagggcaatgcatatggttttgaaaatgtggtcatcagttgattcatcatccttcatctagagaatttgccaatttgtatgcttgggctgtatagtaactatgacatgatctaagattttgcagatatcacacatagataaaggccgtgtttagttcacctccaacttccaactttccatcacatcacatcatatccaaaattttcctacactcttaactttttttttccaaactaccaactttccctaaacttttaactttttttcaggaactaaacacagccaaaaagagagagaagagtttaaatagtggagcaatcaagtgggcattgtttatgcccttgctaattgctagtagtacaaactaaaatagccaatatctgataatctgaacatgagaacggctgccccgttgtgtttcaaagaagagagttggagtacatgaaaaatcttagtactatactaagtacaaatgaactgtacctgtctctagtgtataagttttgatgggattagtacactgtacagtaatcacatcgtaccacaagccaaccctactgattttaaatccacaagggtaggagtgcatgatcagactcaaaaactctggtgagcagtgagctaaataaattgcactttttttttaacattaaataaattgcacttgtgcacagttctgcacttaatatgcaagcatcagataactgcaactagtcttgcatatacggtgatgatagtagcagtacgccagtaccatatgcttgactttctctataattattgacttccacttaactgccgtaggccgtagatgttgcaaga

SEQ ID NO: 64250 - DNA, 5172 bp, Oryza sativa
ttctttattcagattcatggtacttccttttgggttattattatttttttttaacggagaagaggcagtactcggtgcagttgagtgcagcgcaggctggagttgggagttggctgcctgcgatgcgagggcaaagaaaaggaaaaaagatgccgctgcaggcggctgccgccacccaccaaccgcggacaagtggaagccccaaaccccaaccgaaagcgacggcgcgcgcctttggtggatggccgttggcgccgaggcaagcgaggcgcctgtattttcttacatttcagcccttccctaaaaacttattttacgaatgaaccttttaaaaaaactcttataaatgaacccttagaaacttattttacttttgcacctaggtccaacgctatgctgaagtcaatggcgtcgagggagttgacaccttgtcactttgtgtgagcacgcggaccggcattttggcgattgttaagatctctagccttgatcctcggtatggtgaagtgagctatggttgcgtggacacggtcagtcagcagttgtagttgtttcatgacagtccatctggttgtggccgctgccgtgccgaatcagtgaccaggatttattagcaccaaagactccggcgctgtgacgttggacctcatctttcccaaagtctaaacttgaaataaagctttgctgatggtgtctatatatgtaaaataagtttatagaaagggggtaaaacagaagaaatccagggcgaggcgtggtcagtggtcaccaaccgcgggcgccgcgactgcctgccttgctgtctcgtgcctgccgtggaaaacgagggaacgggaacccaacccaggcgcgggccccgccggccaccgcgcgcagtcgcagcaacagccagtactctctctgcgcggcggcagcgcatttcccactcggccactccagccccccgcagcatccgcccgatccgccgcgcggctgcttggctgttggctcccaccacaccttggcgtggccgtggcgcgggtgttggatccgtccggtcagcgctggcgtcaccctccactccctctccttccgcccttgcctcctcctccgcctaatgcgatccgacgcgcgccaccaccacctcctcctccgatcccgcatgcgcccggtccaccgcgcctcgcctcgctgacccacgggggccacctgctgctggtggtggtggacggacggagttgtccgcgacggtctcccactttccgcctcttccccaccaccatcgttctccttctcttctccctctcccacctttctccccccgcgcgcccgatccttcccttcccccaactccctctcgcatttcccagctcggatcctcttctgacttctctctctctctccgtctgtctctctcctctttcgaggtcttcagtcttcagtgttcttgacgaccttgctgcttcttgcctctgtttcgcctcctacttgccgtcttcttcttcttcttgctgctgctgctgctgctgctgaatttttcttcggtcagttagtcggtcaggccggtgccggtctgggagcgattccgccggacgcacgcatcaacagtggagggaggggaggggaggagcttcccctttttgatctagcaagtcgtcgtctccaaaaatacacttttttttgttgggtctttggaacaaaagggtctcctccttttgatctttctgtctcatcactaaattagcaaagctttgtgcttcgcggcgatctcttttcagctaattcagtctctgttgatagcttcgttgcccaagagagatcccccatgtcagaggcgagcggatgacaccgcaattcgggtccggttcttccgcctgagctgcagaattttaagcttcctccgtggtgccgccatggatgcccttcctgacgccgccgacgcggcgcagttggcggcggcggcggcgccgccgcagaagcgcgacgagtggagcgagagcggcattgtgcggctgctggaggcgtacgaggccaagtggctgctgcggaaccgcgccaagctcaagtggagcgactgggtcgacattgcccacgaggtgtccgcccactgcgccatggagaacgccgccgccacggggaagcccgggagcagcacggccaagacgcccaaccagtgcaagaacaagatcgagtccatgaagaagcggtacagggcggagtccgccgcggcggcgcgcgccggccccgccgccgccggtgctggcccgtcgtggcggttcttcgcccgcatggacggcttgctcaaaggccccgccggctccggccagccgcaggcggagttgagcaacagcatagacctgcgagctcctcctcctgcaaaggttgaggtcgatgtcgatgcagatttcgtcagtcagttagctgatgcagggccgggtgcactttctgaattggtgagtgcatatgcaaacggctcgattcaagagaaattggacaaggttgagaacagtgggcatgttgaggggagagctgcagagagtgatgtcaatgtgagctctccgaggatcaaggaggcgaacgaggatgccgaggaggtggacaaggtatgggacatgtccaagaagaggaagaacacggagtttgatatcgcgaagagcatcgagttgctggcaagctcattcttgaagattgagcgcgcaagaatggacctgtacagggaaacagagaggatgagggttgaggctgagattaagaagggtgagatggagctcaagaggacagagattatggcaaagacgcacttgcagatcgctaagcttttcgcaaagagattgaaggagtgcagcagcaagactggtggtagctcatctgtaacagctgaagtggacaaccatgccaagaaaggagaaaatggttagtatcaacatgacaatttgcgaataaactggttgtagttaactaacttaataggggtatatgttgttctttacattccatagctatcaaacattccatgcaatttgaagttaagtactcctacttggcatttgctatatctggagttcactaatagattaggaagttccagcctgttgagttttgtctagtgtaattatgcgctacatagtctttgagttccaaatttttggagttcggtacaactatatcgatagaagctgatattttctgagtgcatgttctgaaatacagaacggcttgattgcatgtgtggtatagtgcaaacacatgatgtttcgttagtacaagattttgattgtaggagtgcatagactaaattgcgatctgcaaaaagtacaattacgtgcgacctcagcagagcgatcttccatgttgcaaacacatgttacctgaattacctaaatgatcagaccttacattaaaaagattgtatacaaccgctaagtaataaaattgtaatgaaaatataatcaactgtgctgatggcatgctataaaaatactcctactgggttaagccatgaatagacaaaattttgctatgttctcctactctccttcaaaagcgaatccaaaattcgtataaccctagaggtgtccaattcataaaaatgaaagagcaattgcatgcttgttgaaagtgattctgactgtataatgctaccataatctatacaaattgaacttacaaatattctggagaaaaaaaatactggatcagcctatggatgtgtttaagtgcatctgtgcatatatttatctgatttgattgaatacgctaatattccatatcttatcaaaatggaccatgtaagccttttcatgcataagaggaaattagattatgagaaaatcgacacaggttgctaaatctgttcagcttagcatatattcagaatcaatcatcaagtgatcatgtaccagtactatcagggctaagtattggtttgtgctagtgcaattatgtttactttgtattgataaaaggcaaggttagcacaccaaacaattcaaggattagcatttatgccctcaagttgaaaccgatctgaatttctgaacttttaaatgcttccatcttcaaatacatctcaaaaattatcttttttgatcttcttttaagttgcttggaagtgccaactgaaagcgcggttttcattgtaatcaaacatgttgaatgatgtttacactttctatttcatcttgtttcgctgtgagcagttcttctgacttttgggcttatgaatttcaggttcagggtgattgaaacaccaaccgatcgtccagaatccagaaagcaggcttgtagtttttggtgttcttgtgcaccaaatgtatgtctttgattgatccgacttcaccatgtacgaagagatagttagctgtaaaagtaaaatgcaataaatgatatgattgtccccattcagtgggggattatagaagcagttttagaatcagtaactagcctgaagaaagttgttgagttccttttgttaatattttttgactgacagccatcgtatgtatcattctactttttttagataatggattttcattaatccggcctctagatccacaaatgatatacacagccaaatccacgaattatatacacagccaaatgtatcattattctactatctcattgttgcgaagtgttttctgaagcaacatccaacgataagattcttgcgggatattttattgcgttgataatatggctttggccgtgttaattgcaggattaaaatggttggaacttacactgtcgtttacttttatgctgtaatgtggtattccaagatctcatccgactttgtttgatccagcatacttatcactttatcagatagtgaaaccagatcccatttaattgccctctaatgactccacatccctgaatttatctacacggtcgagattttttttatatatattcatgtattacgatgttgatataaataaaaggtaaaatttatttttagctagaaacaaaaacgttaaaaacgatactaccatttttattttattattttcgtgaatttatcgtgattcgaacccctactgatacctctctctccgtttccaccggtaaaaaatagggaaaaaacagaaaaggctgttcagatttgctagaaaactttcataagtttttttacccctaaaactttcatatttgtgactatagaatcgtgttgagaactcaagattt

SEQ ID NO: 64251 - DNA, 5428 bp, Oryza sativa
  unsure (1)..(5428): unsure at all n locations
attcctgcagcccagcaggaggaggacttgccatggtgttgatttggggcgggaagaagcatcgggctcgccgtctgctcctctgatcggcctcctcagttgacacagcaagatttggtccggggggaaggggagcagccgccatgtttgggtcccgagtccaggatgaggtggagatgcagaggaggactaccaacaggtgcgtgctgccagcttgtgattctttaatcctgtagcttccttttcgtctcttgatgcagaagaggaattcttttcggttctttcaagcatatgtaaggaggaaagtttcaatttatacggcagatttagtttgccccttttaatgtagtagcttgatccgcagttgcgaacaggtggacacaggaggcgatatgttgtcaatatgcaattctggtctaattgttaccctttctgattggaaccacccaatatttgcacaaaagataatacacattcagagataacatttttgcagtttatttttccttactgggttgtttctatgtgtaggatctttcctgatgagagacaggaccagtttaagctaccgtttcaagctgcacgggctgacagatttggggtaaacaggatagatgcaaagactactgagaagattaaagtgataagtgaaggcaacataccatggcaccgccgcattctagaccctgggagtagcatggtgctaatgtggaacagggtgttcctagggtcctgtttgtttgctcttttcattgatcctttcttctactacctgccgctagttcatgtactagatgaaagtaccaaccgttcatgcattgccaaggaccggcgattgagcataactatcactgttcttaggacatttgcgacttgttttacatgctgaacatcatggtcaagttccatactgcatatgtagatccaaagtccagagtacttgggaagggagagcttgtcttggacttaaagaagattcaacggagatatctcagaacagatttctttattgacctacatgagcgatccctcttcatcaggtaaatagcgcagaagtaatgcttttttggaattcttattgcatctgttgatggtagatacccccagtgatccatgcgccagactagagttgttcaaagagtatctatggtgcaaatgtttgtaattgtgcactttattttcaccctccactacatcttttgttgctaaaagttttgtatgccacaaccatccctcaaagtacttttaataatgcccttttgcaatttactagtatttccattctttctttctgtttagaataaattcattagttttcatgactaaaaactaaatcacttcccctgagtgagtttaaagacaatttattttattatttccatgtttacttggaatattttcatgatatagttactgctacttcgatttataattatccatgttgtctttgccaacattgttctaaaccatttttactttgcactgctagaactacatgattggcatgttattttcccccaatttccagtgtgtggttgatccgctttcccacaactgaataccgataatgtaatcaattgaaacttttgaattctacagtcatagcctgaatctcctggtggtactttctcttgcaggttaccgtgtggattattatgccttcaataaaaaactcagattacaacatccggaacaccacatttgctctggttattatgattcagtatatattcagaatgtatctcattgtaccattaagcaatcaaattatcaaagcagctggagtagttgccaagtcagcctggctaggagcagcatacaatcttctgtactacatgcttgcaagtcatgtatgaccaccttccatcttcaacttagtgttcatcatttttgtgccatgttaatttgtttaaatactaagtgttgtgcaatgtaatctacaattgaaacccaacttaaattttgcagttttttccctgatacctcattcacagtaggaattggacaaacaaaatgagcctgtctgtaatcacagcatgtagatatgttaatttggcctctctaaaaaaggaaatacatgcatatgtgcaaactcaaattggaggacaataattttaatatcacagctcttagctgcacttttttttttgaactaatacttcaataatgttcctcctggttctgcagattactggagcaatatactatcttctctccattgaacggcaaattacatgttggaatcagcagtgcctaaatgagtcttgtagttttaacttcataagctgtgacaatactggttctagcagttatcttacttggggaaagaacacaagtatatttgacaattgtgatcccaatcgtaattcaagtgctaaccccccaccatttaattatggaatgttttcaaccgcactgagtaaaggtgctgtttctgctccatttcttgagaagtacttcttttgtctgtggtggggcttgctgcagcttaggtataattaatttttaatatacatccccatcttgaatattaaactttctgtacatctgttgttgatatcttgcctgtgaactattaatctgattatatactttacttggggttcttccatgatttatccattttattcatggttctgtgtgattcaaatacaattgctcatgtttagttttctgctgctgtatgtgctctccttttcagttctagtggaaatcctcttcagacaagtgcatacatcgcagagaacacatttgccatagcaattggtgctcttagtctcgtactctttgctcagctgattggcaatatgcaggtattgtcatatcttttgttctgaactaggggagaaaatgctccaaggacaataattttcttgttactgtttcagtttactgtaaatgtagtaatgcaagattgttacgttctataatatgtgcacataagtggatgtcctatttctgtgatcaatggatgcttcaagtcagaaatttccattttcattgttttaaaatctgatgacaggaacataaaactatcactttgctcataagccattttccacatttgcaaccaattgaggttgttggttcagagatgttgcttacttcctttttgtttgtcatcttgtagacatacttgcagtccatcagtaaaaggcttgaagagtggaggctccggcaaagagatatggaggagtggatgagacatcatcagctccctgatgaacttcaagatcgtgtccggcgattcgttcaggttaaatggcttgcaacacgaggagtagaagaggaatccatcttacaagctttgcctgctgatatacgccgggatgtacagcgccatctttgtttggaccttgttcgacgtgtaagttgtggttatttacttacatttcaactgaattagtagaatgttttagtttctgaaaggttttagatgttaaattttctagtggcattctgtcgtttggatggaaaaatcagtgacaaaagtaccacagtgctacttcatagtctagcatgttttcttatcccccttccctaaaatgcaggnntcccatttttctcggagatggattaccaacttctagacgccatctgcgagcccctgccgtctttcctgtgccctgagcgcacatacatttctcgtgagggtgatcctgtgaatgagatgctcttcgtcatacgcggtaagctagagagctccacaaccaacggaggccgcagcaacttcttcaactccatcatcctgcgccctggtgatttcgctggcgaggagctgctcacatgggctttacttccaaagaccaatgtccatttcccgctttcgacgaggacagtgcagagccttacagaggttgaggcctttgccctgagagccgaggacctcaagttcgtcgcgaaccagttcagaagactacacagcaagaagctccagcacacgttccggttctactcccaccattggaggacatgggctgcctgcttcatccaggctgcttggcggcagcaccagaggagaaagctggcagagagcctgagccggtgggaatcatactcatggtggccagaagaacatccaccagctgacaagcctaaacaggagggcacttcaagcagtaccaagactattgctgagagtgccattgctcaaatgcacaagttcgcctccgcttccagaaggttccgtgccgacgataccgccatccggaggctgcagaagcctgatgagcctgacttctctgcagatcatttcgattgaggctgatgtttcctgctttaaaaaaactgttgtaaaaccactactgtgcactgcattgtattcaatagccatatagtaatccatgtgtatctcaaagatgaaaccaaactggtcctttgtgtaattcaaatatacgcattttaggagctgtgaatcgtgtgcattttgtttgcagttgaaccaacctcgagaattttgaagaaatgaacagtttagtagttttatatattgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcaactcgtgt

SEQ ID NO: 64252 - DNA, 10121 bp, Oryza sativa
cttttgtttataaccagattgagccacaaaataagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtatcggggtcgacaaccgcacaacgggtacgggggacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgatgacggggctgcagcggcacacttgacggacgcggacgagacggacgagaacggcctgacggagggacgaacgccacgacgaccgggaacgacgagaggacgacgacgacgacgacgacgaccggggccggcgaggaggcgatgagggctgccggcagcggctgcacggaggcgaggatggcgcggaccacgccgctgcgatgccgacgacggaggcggcgccgcgagacgacgagccgggcgaccgatgggacgtcgacgacgagaacgatcggagacgacgctgatggaccgcggaggggtttggatggaggggaaacgatgccgaggacgaccttgccgctgcgatgccggaggtggtggaggtgtggccgaccggtgcacgggcgaggagggacgggcggccgaacaactccggcgaggcggatggagaggtttgcggcgatgtgcggcggcttccgggcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcggccaccaaatccaggtcaccatctgcgtcgcgccgccgccgctcgtctcctacatctgcgcctggtcccccaccacccaccccgccgagctcttcgacacggagcccaccgtcgaggccgtcgacgccgacctcctcctcctccgcatccacgtctcgctcaaccatgtccacgacctcgtctaccaggcatccatgttgccatcgctgacgctcatgcccagccaagatccttacctgcacgagcccaactgcatcgcgctcatcccccgctcctcccatggcttctacatctccacgctcgacacggatctccgcagtgggattgggcgatacaacctctgcctcttcgactccaccaactccaaatggagccatgaatcgctctctctggatcagctgcgcaatccgcctgacaaaaacgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaacttgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggccacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgtgggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccactgcaccactcgtaagagtggcaaatagttaattgttcttctttttcccttttaacacgagcactgctacacgtactaattttttcttactaaatctttactaacaatcatctcaaccgtttgatttaggtagatggaagttattaaaaatctagatgcactcatagcatgacacatcactgttagtaagaatttagtaagaaaaagttagtacgtatagccttttccttttaacactatctccattttttaatatatgacgttgttgattcctttacacatgtttgatcatccttcttatttaaaatttttatataagcataagaaaatataattcatgcttaaagaacttttagtgttaaataaatagagagagtaggttcaccttgaaaaaggaaaatctcctgatcatctcgtctcatctctcatgtcatctgacacattgcagcatgcaagcaaagaagttcagcagcctgtctgatgctgcagctactacgaaaggggcgatttcgcatgcttaatcactgctagaggtgctcaagtgaactggggctgtgtttagattcaaagtttggatccaaatttcagttcttttccatcacatcaacctgttatacacacacacacaacttttcaatcacatcatttttcatttcaaccaaaatttaaactttacgctgaactaaacacagtctagagtaatcagtaactagctacaaatcgatctacactactgatccatcagcgatcagtcgtcgtcaacatctattgatgcaaagcagctggctatctatcaataatctggactgcagagattaattgaattcaaccatgcgtgcatgaccgatcgattctcctcgtcatccgtgggtacggattaattggactcttgctccgaatgggtgatacactcgggtggcagctagggcacacagctagctaactctgatcctctctcgtgtttgtgttagctcacatgactgcgtatactcatcatgttaagagatcttgatcactgacttgttcagcaggaagaagctaccttaccttagcttaattagcttttgcttagcttaggaaatagccactaacacacgccattaaatcgtcttgtcatctaactacacctaaatacgtgtatctagctagctcaatcaattaatttcagctgcagatagacgaaccattttcatatagttacaatagctagctagttgggtcgatcggttgcttgcatttcttgcatcttgtgtatatatgcatgggcaagagatcgccaacagaaaggaattttttttaaaggagttcgagaacaactgttcttcaataaacagataatgcgtttttaattgcagttgcagacaatgcaaacttcatttcccctgggcagctagctgatcttgttccataaattaactggacgatgtcctgacaagctgcgaccgacgtacgagcaaatttaattacttgtcgtgatcacaagttaatcaactatgcttatcattgacgacattatgcgcaggttcgtcgtcgcagaacaagttaagtcaaatcgattctactccagcagctgcatccatagatcgatcgatcagtctgatcacacactaaaaagcatctttgaaaaaacgtcatatcatcgcaacagtggtttaatcatgttccccagttaagttgcagtttacagctgatcataccggatgcgtgcagcaggaggactttgtgtcgaaagagtaattgtgtgtcaacaaagcatacatgcactatgacgctctgtggttgggtttgttgttgggtcagtaaacatctaatcaatcaattaattcatcttgctgcatgctgatttaatcttgagctcatacttacgtgttgatatatcgatgattctaatgaatcagcagtatagctagctagcagctggtagctaattaattaattgccgttagcagtaattaggagtagaaggtaaagactcttgcagcagataaagcaatttccaagttaaattaaactggaaagaacctcatttcaagtatgcaagatcccaaggaaaaaggatatatacattgttactgaacagtacttacagctgcactcaaacagcatgcagcttggtcaccttactaacttttttggactgatcaccttactatgatgatattattctatcaccttactatattactgattattattattattattttgtttgtgattgattggtcatttgagatagatcgttgttaattggtgggaatgggcagatagctagattcatgcatgtactagtttctactagctgctaatactaattttaaacaagaaaaaaatgggggaaaaccctgatgctttaagagttgtaactaagtaaaggattaaaaaaccatgagacgcacgaaatgtcgagataaattcggcttgatcgtgatatatgttttagtgcatatagtaaagcttctggtcattctcttagaacaataaaaagaggcaaattctccttgctaggatgaaaaggaagaaacactcaaacacatgatgaacacagcttgatccaatacaagaacacaaagacatactatgcaaaggattaatccacacacaatttatatattctctggggtacctaattaagcataggctcatccaaacatgtatacagatcgatcaaggagatcaattacgtactgaattaatgagatgtatattattgaactatatatatctctctctcaaagatcagggctatatatatgaattagccgatcaaacaattgcactagaaatcaatcaatcgcggttccagagacgcaacaagtactcgatccaacgctagctacctacgacatatgcatggattcatcacgatttgattaattaattaattaattaattaattaattaattaagccgtcatatacgtaatcaggttaattagctcagagcttcagcgacaagtcgatctcctccccattccggccgtagcgcccgccgccgcagccgccgtcggccggtggcggcgctggcggcgccacgtcgtgatcctcctccgccgcctcagccgccgcggcgtggccgtacggcggcgccgtccagaagaagcccccggcgacgccgtcgaagccgtggactgcccgggacgacgacgacgacgacggcgacggcgacacggcggcggtcatgacgatgtcacggctgcgcttggcgagcgtgcgctcgagcttgtgcgcgttctggtggcctcccagcgcctgcgagctgaagaacttgcggtggcagtagttgcaggagaaggcctcccgtgggtcgacggcggcgg

SEQ ID NO: 64253 - DNA, 1000 bp, Oryza sativa
attaatggactcatgtccatgcgtgagaggtataattaagcaaattcccatttcctttttgctcttttcgcagcatggtcacatgatcagatgatctgcaagggcagctactgtagctagcaagagctgtcacatctgaaatatctaccatgcaattatgaaatgcatgcgagaattggatgaaatggccgacacgatttcacatagtgcagataggttgctactccacatatggtgagtacttcatccgtttcataatgtaactcattctaccattttccacatccatatagatattaatgaatctagatatatatatatgtgtttagattcactaactttcatatggatgtggaaaatgctaaaataatttacattatgaaacggaggaagtatataactaatatatacacatgcatatatatatatatatatatatatatatatatatatatatatatgatctgatcgatcgaattggtgaataatgctgatgcatcatttcatcgtcactagctagtaggttgtgagtttgtgacaactatagctgggagcagctgctgcatgcatgagcactgtcacgcaagcatggtgacacaagcgatgacgtgaaataaccgtgtgcattgcattcatatttattctactttcaagtgtcaactttgctactgatcgatatcgatgcaccggctcgatcgatatccatctctgggcctagctaattacacagtaacacgcatgtataaatgtcaccgacgcatgcaagctagtgatcgattaatggataagcatgattaagcatttatcgcttgtataacaaatcggcaggtccaagctacttcccccgtttcataatgtaagactttctagcattgctcatatttatatggatattaatgaatctagacacatatgaatatttagattcattcatatctttataaatatgggcaatgctagaaaatcttacattgtgaaacggagggagcaggagagatga

SEQ ID NO: 64254 - DNA, 17536 bp, Oryza sativa
gcaaagcaactatagatggtcgaccacctaaaagaatgaagcaaacaaacgtatgaatctcggtaactaaagattcacaaagaccaaatctaaagaatgcagtacatcagtaacagaggttgaaacaaaacagaaagccaacctcttatgctttttatcctgaaatgatatgctcaaggaaatctgagttatttgctaagaacctgcacaaattcagaaatacatgatagtgagaacctgcaaggctgcaacacacatacaaagggagaaagagaaagcatgacaaaaaaggaaaggagtggtggtaagaggcaagcaggcagccatctgaaacattgtctgtgccgctgcccactggtcaccgtcacatatgagaacgacttcataacggcggcaacgacagcaagggactcagatacacatgaatcctgtatggctttggcagtggagaggcacatggagacgaccttttttggccgcatacaatgctactcttgcttgatgccgtcgccgccggtcggagcggcttcaagcttccgtgcagcaccgtattactcatctcgccaaatctagcatggtgttggaatactcagagtagcgtgcaaccagacagagagaaccgtcgctggatcgacgaactcatcattgaccgcccaacacgccaaatcgagctgtgcggcaccggatagagcacctggtcatggagctccagcgcaaccgccgaatcaaggtactcgtcgttcgctgactgagcgtctcaccattgagctcaagccagcaacaccgatgacacgaaatgtctgagattggtgccacatcgccgccgccaagatcaacagatccagtggctctggatctatcgccgtctctagatcaaagagagagagagagggagggggagggggggaggaaggagagcaacaagaaagatgagggtggggagcagagatttccccatggagcttaccgcgacactgccgatgagcctcatgtgctagccctgcccttgcctccgggtgaccggatccgccggcaaggaggtcgtggctacccgaatccggcgagcacggtctaccctccgccggaactggcctcgcggtggcaagggggaggtgcggcgatttggctgggtgcaagaagagtggtcggaggcggaggcggatgcggcggtgtggtctagggagagcgagcgagaagagagaggtgacggaacggcggcggctagggtttcgtggggtgagggaccgggatagggatgcaagttgttgcagaaaacccccttagtttctatgttttcgagcgcagtcctattttctgttttttgcttctttgattagaatatttcttttttagaggtcctatacgtaataacgtagaacgtagaaactgtataccagagatctaaaaccaaattatcaattagtttaagggcttttttgcaaaatgatcagcgtcgggcaggcatggacgcacgatgggcatccaacgacggaggaagcaagcaacgcgcagcctccaaattcagctccggagaagggccggacgacgtgtcacgccccggcaagggccacgccagcggcaaacgctgatttgaggctcaattcttggcagctttgtatataagcgatttgtaaacggacccttagtctgctatatagagacagatatatacggagtactagtacatacaagatcgatacggttgatgcaggcatatagcaactgcaccttaaggcattggatcgagcaaataaaaggagatatctgtgcccacagtggaaacaaacagtaattgccacggtacatgtttgcagtgttggctactttcatgagcagtacaagcaagatctgcaccatacaaccaagatccaacggtggctaaagcaaccgctaaaagtcgcagttgctagttgctacagccactgtactttgatcctgatgattcacatatcatgcattcatgctggcctgggatgctacagtgggtaaacttgtggcatctttcaccgctgccatggtcttcgtgtctatgcaagatgacttcataacgaaacggcaacagaagcgtgtgatggcctacagcaattaaggcctcacatgacgctgcgttttgtacttgagctcccagcgctggccatcttgatctggccgtttaatccactcgctactggtaaacggtagtaggagaatgattccatattagtgtatcaaatgatgatcaatccaacccggtgatgaacgatcgatcgtttggtgattttgttgcggttgaagtgctctcggaggttcagagttcaatgcgtaaagccaaaattgttttcgatcctctcaagaaatcatgacgatgatgcgacgcgtttaactagggatcgcactgccggaaaccatccgaaactgactgattggcaccttgtaccatgggatggcactttatcagaagttggttggcacaacgaacgatctagaaacactttatcgaaagcgaaaatttatggacgataggcaatgacctgattcctattctgggctgtgtttagttgcttctaaagttagaagtttgagttgaaattggtacgatgtgattgaaaaattatgtgtgtatgacatgttgatgtgatgaaaaaaagttaaaagtttggatctaaacacagccctgatatctgaacatctgttccttttttttcttgaataacagctacctcgcccaaattcgacagaaacataagctgtgaattatccgcatccccgtaggcaagcaaatctagcttgctgccgtacaaattcactggaaattgccttttgtcctgatcgcgagcagcgcggccaccgcccgtgtcccacttgcaatttaatccgcatccgcgggcggcgagatggaccgaggaagaagtgaagacgaaccaaaaaaaaaaaacacgcatttcctgccttgtaatccaaccatcccatcgacgacgcaacgcctttgatcgtcgattgcttcctttctttccttgtttttctattgaattgcttgctttggctgagtttatttcctaactttttctttaaacatttaacctttttatcgcatcaaaatttttctacacacataaaaacttctaactttttttttaaattttcaattttagtcaaactttcaattttaacgtgaaactaaacacagcctttgtcgcagacgagatatcggagcggtcgacggcggtagttgcatatatactcaagctctattatctcctgcatttcagttaaggccgagtttagtttcaaatttttttcttcaaactttcaacttttgcatcacattaaaacttttctacacacataaacttctaatttttttcgtcacatcattttaatttcaaccaaacttttaattttagcgtgaactaaacacaccctaagggacgaggctactggctacgtacaaatgcacaggcagcacagtacaggtcactagcggcaataaccggtgacggtgacgcgtaatgcttttcttggcctgtcattcactcaggttgccggtgtgttcctcgacatgtagtcatgttgccgatctgtctaagagaaaagcagggagaatagaagaaggcaactcagagaccagagtacagcacggtgaaattcagagttaagaaggcgatctgtctaagaaaggggaacggaagatggagattcagaatttcagaagttattgaagtgttaagcagcatggtgaaatccagagttaagaagagatggcagttgtggaattcgaccaatgtagggtcacaaaagtcataactagtcgtaggtcaagtgaacatcagaataacatttatgctcacagttcatgttcatgctaacttcggagtagtagtactctactttggccctgtttagttcacaccaaacttctaattttccatcacatcacgtcacatctaaaatttttctacacatataaattctcaaactttttttttccaaactatcaacttttcctaaacttctctccaattttagaaactaaacacagcctttgttgtagatatactcatatctactcctactagtaatgtggctatgttttggtgtaaccgaaagatgatcaaaatttattgccctttttaccagctttgtgccaatggatgaggtggtgggcctggggattttcatgctcttcctttaagcttactcctctctggtctgcggtgtatgcatcggccgggcagccggctggatggcacgatggaattttagttgccactgccctgactgccagcacgggcggcaccgctgaattttgtttgtctcccgtgaaagcttgtacgtaatctttgctctacggccaccgtgtggcgtcacccagtcgtcagcccgtcacacacagcgtctgcagttctgcagtttgcgctagtaacgattggcccatttctcgggttacctgattcacgttttcagcaaggttaaaaatcaaataaattaaacttaaaatattaattacttttaaattattcagtttaaaaacactagaacctgatatatggattagtcttaatttttttaataaagttaaatattcattttttaatatcataatagaaaaatactgttaaagatatgttttgagcaccgtgttattgatcaaaccatcaagattatgaaatcagaaaagtaagttttagttgtagagttcaaaataatttactagttttagttgaagtgctccctctgtcctaaaatttagcaatcttgtactggatgggacacatactagatttgttgtactagaatgtgcccctatctagtacaaggttattatatttttgggacggagggagtagaaccgttaagtacgggttgacatgcacccatcgtcaacaccctatgacaactcaaagactcgtatcttttttgaagtaattgtacatcaatactcttttaaaattatacaaagaaaaatcacttccttaaaatagacccctttttgaaatatatgcagtcaaatagcaaaatataactccctaccactccctccgttccatgttacaagtcgtttgactttttctcagtcaaaatgtgttaagtttgatcaactctatagaaaaaattaacatctaaaatatgaaactagttttttttattaaatctaccattgaatatgttttaataatatatttattttgtgttgaaagcaccactatactctattaagtatttatctacaaactcagttaaacttaaacatatttaactataaaaagtcaaacgaattttaatatgaacgttgcaatgtgggctacaacatggagtgatcaattttgttcctgcatactgcaagtagtgtttaggggatttcatgatttaccgcactttagtcattgactcagaggggtctcatcaccgcgaaaatgtcacgtggagtagccatcaacaatctactacctccatttttttaatagataacggccgttgactttttcttacatgtttgaccattcgtcttattcaaaaatttatgtaattataatttattttgttatgagttattttatcactcatactttaagtgtgatttatatcttatacatttgtataaaaatctattatattattaaaggaatagaaaaaagagcctccacgttcgctctcatgtcctacaaattcttacattaatcggagaaaaagaaaaaacatagttcatatagaaatacaatttagaaatagctgaaattcggaattaaaaaataagtaatattagaataggagactagagtccatatagaaatacaatttagaaatagttgaaattcggaattaaaaaataaggaatattagaagaggagactagagtccatatagaaatacaattatgaaataactgaaattcggaattaaaaataaggaatattagaagaggagactagagttcatatatatagaaatacaattatgaaataactgaaattcggaattaaaaataaggaatattagaagtagagtatagagtctgacggagcgtggggctcctcaccgggagaccgcgcaggcccccctttgccggttcggccgggggcgctaagtgaggttcttcgctctcgatctgaggaacgtcagcgggagaggaagtgcacaagacacgggcgacgtagacaagttcgggccgctgagaagcgtaacaccctactcctgtgttctggtggatctgtatgtgaaggaatacaaagaaccggagagcgagagtgagttcaggctctagaaccccttccccagagtcccaaaacccccctttctcctaggcctgggcctcctttttatctggtcaggggtcaccacatgggcctctctctgcctaagaagggaaacatgctttttacaatgagggctagtctacagccggaagtgacctctgacaagcagagcacacgcctcctgccctgctcgcctgcttttccggtggacgcccctttcaaccttcatttaatggccagcgacttcattgccatacttgcgctgaagtctggaatggatctgaccgggactaacataccaactccaggagttagcacgccggctccggctagggacgagagccaggaaactctcatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcacgctcgtccaacctgctataaatgcggttagtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccttcgggcccgacccccccgagggggtcaggccacgtgggtgaccgcggctacccaagcctctagtcacgatacccccggccccatgtcaccgacagagtccatatagaaatacaattaggaaataatagaaattcagaattaaaaataaggaatattagaagtagagtatagagttcatatagaaatacaattaagaaaaaaaatagaaattcggaattaaaaaaaaaggaatattagaagtagagtctagagtccatataggaatttaaaactaactaaaattcagaataaacataataaaatgaaaagtagtgtttagagtccatataaaaatacattttacaaataactaaaattcaaaattaagaaaaacatgggaagaagagtttaaaaacaatataggaatacaatttagaagtaactgaaatttgaaattaaaaattaaagaatattgaaaaatgagtttacagtccacataggaatacaattagaaataataaaaattcagaattaaaaaatatattaaaagacgagtctagagtccatatagaaatatatataatttacaaataactaaaatttgatattaaaaataattaataactaacacgtatataaaatacaatatgaatattaaacattaatagtttcgtaaagttattgtaaaatttaaaattatgttatcattgtaatatattttaataatataatgagaaaacatatatgctattatatgagagaaaatataatgatgctagccgtgcaatctgcgtgggccatcatgctagttttgaataagacgaatgattaaatatataagaaaaaatcaacggcgtcatctattaaaaaacggagggagtatttggcttgataacacaacacagatagcagcacgaaatggaaacatactgtacaaagcaagaaaaggaaaattttgtgtgaaaagggtgcatcactcacacgacacatgttactgtcagttacttcccgaagtatactacagtacacttggagaaaaatacatgttatgcacggatgaaggaaaaaaaaatacagaaacaaaaaataacccgaagacacacttgggagaaaaaggtttcaaagacccagatgtatctcccacccgccaattaatgctccctcctcgggaccagcgtcatcacttcaatacaaggaaccaaaaaagagaagaagaagtaaaaaaaaaaaccttggaagaaaggcacagcagtacagcagccagcagcctcagctccctcgccaagcagagagcgcgaggaagaagaaggaagaaggcgcggaccgggatccccccgtcgggccccacatggccgcgccttgagccccgccccgtcccgcccactccggacccagggcaccgagatgccgccgcggcgagcggcgctgctcctcctcgctctcgccgtgtatggtatgttccttcaagattgtgtgtttcttttcttttttttttctttctacccgctgttcttcttgcccggccgggcgggcgatttcttcggggtttgaggttgcaatgcggagtggaattgttgtctggtttgtttcgttgcaatgggatcgccggcctggaagaagagcggtcatggctggctggcttgcgtggcacgttccccaggggttgtggaaagatggtttcgcctttgcttcatggagctgttcctcctgtgattcgtccgagcgcatcggcatctgaatccagtaggcgtggacatggcgtagattcccgtcaattttctccttttgattctcctctctttccctttcttgaatcaacccatgccgagtctgagaaagtttggaatttttatgcaaatctgttgttaaaaatttgctgcattggcgctgcccgcagcgattttcggtgggcttttactacgcttgatttgccggcttaaacccaccgcgtttcagtactgcaccagctgtagtggttggtgtgcatttgcctttctgttgtattgaaccgaaaaagttaacaagcttttggtgcaatgctcgattagtggtcaaggtttttggcgaggttcctgctgttctgttctcgtcttgcaatcttgcagacacatagttttcgttgcactctgcattgctcatctatagtaattttcttgtttttaatcaaactgtaattttgtagtaattcgcactcattcgtcctgcattatctgtaatatttggctgtagtttcttcaaaacaaaggccggaatgaattccattatctaaaaaaaatatatacagtggcgtgcaaaaccgtgtgagttactgcattagtattccagtttccactccatgaaacatatgttcattgtagttatgctgaagtaatagttaagagtatacagatgttatgtatcatatgaacagcattttttttgggtcaatatccttgcagtgccactgggaacggcaagctcaacaactatcgcgtcgtacttacttgggttatggagtagagcacatcggcattctcttcctgcccctgctccagctccagctccagctccagcccctgaaactcaccgtaagtagaaatactgttgaaatttgtacacttaaatagtaattcaggtgtaacatgttctgcaaacttaaatatttatttcatcagtattcttacattcaatgattttcttgttgtcttgaaccgtcttgtaattttgtcgatcattttggttctcaggacctggtattagacacccagtgcctaggcatcacaggaaaaggcctcatgttgccccaccactaccaccaccatcatcatcagaaagacaaggttctacttttctctactgaccaattgagattgcaaatcttagtattgttagcactgaaggacacaacaataatagacgcgtttgtgcctgcaatgtaacagattgcagtgggatttcctgtactgctccactcacatctactccaatcggctccccctgtggctgcgtatatcccatgcaaattcaacttgatcttgtagtagcaccatatcagttgtttccaagaattgatgagttagaaattgagattgcagcaggaacatttctgaaacagagtcaagttcggataatgggtgctgggagtagtcttcaagatcctgaaaaaactactgtcaccgttgatttggtgccactaggtcagaagtttgataggacttcagccttactgactagcaacagatttttgcaaaagaaggtgccaataaactcgtccatatttggtgattataacgtaatatatgttcattatcctggtgagtgacatatttttttgttgacatcaacttcaatagtataattcccagtattgctgtatgtaatcatagaaattttgcaggcctgccttctttggtccctagtgttccaggatccttgggcccaataagcagtagccaatacccctttagtgcaaatgtacacaatagaagacatcagaagattaactctaaaagtgttgccataattgcattatcagctgttgtgcttgtattaatgagctttggcatttgcatcatatggaaatataaaggatttgaaaagtctcgtggcactggtcgtgtttcgaattcgtcagccacaagaaaaacaggtaacttttggcagtcctggtacatatgctaccgttataatatgtcctgttatatccattttgcatttagacaccctctgttctcgaataactaatactgttgaactgttgactattggcatctcactttgatcacaaattacttttaaactatgagattacgatgaatgaaatttgtatgtttatacttgtgatgccacacactttgacaatataacatattttcaagtatttattttattttattttattttttgctaaaggaagaagtggtcaaagtttgaaaataaatagttccagtatcagttattcgagaatgcagataatgttaatttgcaagttcaattttggccctttttttgtgtgattcaacatgaatagtaaaaccttactttttgactgtgtaattcccttgctgtttgtataacatcttgtttctgtttcaggtatgaggtcatcattctccagtatgaccagctcgacggcatcttttgtttcaacaattgcaacatgcccacctacagttaagacattctctatttctgagcttgaaaaggccacagaaaacttcagcttcaacaaaataataggtgaaggagggtatggccgtgtttatcgaggtacaattgatgatgaagttgatgttgcagtcaaattgcttacaagaaaacatcaaaacagagatcgtgagtttattgccgaggttgagatgctaagtcgtttgcatcatcgtaatcttgtcaagctgatcggtatatgcattgaacggagcacaaggtgcttggtgtttgagcttgttccaaacggaagtgtggagtctcatctgcacggtatgtacacttatttagtctacaccattggcatataagaatctttggtacattttcagcactttcctatgcttcattatacattgttgtgatctgcatatttacttctgttttgatgtttcaggttctgataaaatatacggcccacttgattttgatactagaatgaaaatagcccttggtgcagcaaggggtctggcctacctacatgaggatgccaatccccatgttatacaccgtgatttcaaggccagcaacgttcttttggaaaatgatttcactcccaaggttgcggatttcgggttggcaaaggaagcctcagaaggaatggaccatatttctactcaggtcatggggacttttgggtaagtcgcattcttaccatattcacctgtggctattatatcaccccaaaacacactaaatttgtaaggagaaaaagaagaagataatttagtcatacactagtacaccacagtagattatcaatcttgtaggatcgaatcacaagaactaagccaaccagagggggggcgggggtgaatggttggtataccccaaaacccaaacttttagcggaaataaaagttaccctcaaattcgatgtagatcggactgaacgaggttgatccgccggtctgaccgcgcttgtgccgctggtctgaccagtgttgatcgcccggttcaaaagcctgaagatcgcctgccgcgcctgaagtcgtagcaggtctgactgcctctcctccgtcggtctgaccgtcgctatgtcgtcggttagaccgccgaacctgatgaaacacaaatcgaagaactcttaaaatagatgacaactttattgcttccctctgtgtttacaaagtgcaccaacaacactccttacaaaaatttcgactaaactcgaaaccctaactaaactatcaactcaattgctctcaacagcgataccgggaaacctcacactccctctctatttatacccaaggtaggcagcctaaagccacgaaccaaattcatactagaagtcctaatcaccttaggaaaccctctagtacaagaaacaaactttacataaccaatcataccaaatttggactcctttcaaattcgactccgcatcccatacgcacacaatacctccatcgtatgccatatggaatctttaccaaccacgtgcattgaactctagccttagtatctcgcatgatatctgaccaccacggacatcgccttaccaccaagtcgactcccggtccaacttgactctctcgaggcatcgagtcacctacacatgaaacaaacaaagaaaccatattccgagaccaagctatccccaacttgactcattagtagcaaacaacagtattacatacgcatagtatccttctagaagccataaccatgaaacaatcacggatatccaaacaaacaaactaaaaccgacacagtgtcggccggccagactgcgggctagccggtctgactgctcaatcatcaccggtccgaccggcacacactgcccggtctgaccggacccaaaacacagcagatcacctgtgaaatccaatcatcttcaaaaccacttcgtaaataaatttcaaatatcaaaaccaataaacgtcaatgccaattgttcatcacagaataacaatcaaaaacacatttgattttacaaatcttgattgtagtgataaattaaatatttcaataaataaattaataattaataaagctgtgatctaaacaatacaatagacgaaagctttctgagaaatcgtattagcaaataattaacggcgatgatattgtgaataataagctgaaaagaaagtttaacttttgatcgatttctttttgtcatggtcttcaggtacgttgccccggagtatgcgatgaccgggcatctcctggtgaaaagcgacgtgtacagctacggtgtcgtgctgctggagctcctctcggggaggaagccggtggacatgacgcagccgccggggtcggagaacctcgtcacctgggcgcgccccctcctcaccgaccgggacggcctccagcagctggtcgacccgtcgatgccggcggcgagctacggcttcgagaagctggccaaggcggcggccatcgcgtccatgtgcgtgcacgtcgaggcgtcgcaccggccgttcatgggcgaggtcgtgcaggccctgaagctcatctacaacggcaacaacgacgacacctgcaccagcggctcgttcggcggcggcggcggcgaggagtacgaggacgaggaggcgtcgtcgccgtggaacaaccgctcgtggagccacgacttcgccgcgacgccgccgccggcgtcgcgcaggctggcgttcccgcgggctccggcccgcccgacgacgatggactacagctcggacccggccgacggggcggcggggacgtcgtcggcgtcggcgcggcggcagcggtcgacgtcgagcctggtgctggacaagatcgagtcgctggcggcgtacgactggtccggcccgctgagggccagcagggggaggaacttctacaggctgaggggaagcatgagcgagcatggcggccatccttccgaagattgctccatggagggctactggatgtagtagctaaagctgagtgatgatgatgatgatcagatgttgtctgcagaattgcagattgccttccatttcttgtcatgttcttcagttaactgtatagttttctgctcatttgatgatgataggattttgatatgattgatgccatgctctgaacaacaatcaccacaccacccctggtctggccctcattttttccatgtagtggatgaacgcactaatcatcatatcattatggcattttgcaacattcattgcactagaatttagcattagtctaggcagtatcaaacaagacattagagcatgttgccatgtacatgaacaaatggatagcacaacaaaaaaaagtgccttaactactcaactagctagtttgttttcgtctcaatccatctgttcggcagcggaagattgagatgaaaacacactgatttttggtcgttcgttttatttaaatcatttttatgattaatatttttgttgttattaaatgataaaatatgaataatatttttatggtgacttatgttttttttattttttaaaagatttttaaacaagacggatgaaaagttggatatagaaactcatgattacgtttaaaatgggacgtagtagtattctcctatattctcttaaacactctttaggtttgtttaggaacacatgcctctgtacacgaaaaacggagtagctattattttaaaaaaggttcaatataatttttttaagtaatagtttgaaaaaacgtgcgcgtgagggagagggttgggaacctgagaaaagacgggccacagggtgctggggcccactggtcagagaccgggcactcgaaccatctagtgcagacgtggtaactggcgcgcctttctcccctctttatcaacaccacacgcaggtcgacctcgactggaagcgcctcctcgaatcgaagaagtgtcatggctttcgctgctcccgcgacatgcgcgtgccgcatggcgccgccgccgccgctcgcggccgcctccgtctccgggcgtgggcgctcgccgtcgtcggcgtcgagctatagggcggcggcgcggtggtggccgggcgcgaggagggggaggcggaggaggtgggcggggttgagggcgaggtgcgccgggcagtccgtcgtgaagcccgggtcggagagcgccgccggggagggtttggtcggggaggacccgccgcggccgccgttcgatctcaacctcgccgtcgtgctcgccgggttcgcgttcgaggcctacaccagcccacccgtgagcccctcctgcttcacccgttcacctcaccctcatccttaaggttagcttcattagtccttgtaaattcgcgagtcatttggagaattgttcttcgtgtttggcaggaggatgtgggctggcgcgagattgatgcggctgaatgtcagacggtgttcctatctgagtgagttgtgcgcttatccttcttttttttattattaatttgttaattttgatagaaatatctccctagccgctgtggtgctaaactggaaagggaatggaattctgaacgcattgatatggtcatcactgtaaattttgtgaattgtaccgtgcctatgtattgcagttcatttctccgtgaagtatatgatggccaattggttgtgaggctgaagaaaggcgtaaatcttcccgtgatggatccttgggtacggtgatgtatttgttggcgaaaaaccatttattatcctacttaagttattaccgacttcttgttgatctataggtgaaacaaaataaatctctgcaggtcatacttatatgagttaaatttaccttttcttagatgagagttaaatgtacttcaattaagggatatctgaacttatctaaaaacccattgcttctcataataatcccggattatgaatgtagcccaaacaggcaaacacccaatgatttaacctgcatgttgcaatatagggtcgagcttgcccaatctaactactgttaagcagacctcttcctccagtttattaacaacttcgttttctctaaccatttcaattgcagggcacaagtgacccttacgtagttctacaactgaatggtcaaactgcaaaaagcaatattaaatgggcgtgagtaaccttttcccttttctatgtatgctggggtcttggcggaggaggatattgctgtttttttttcacacattttggaatattttgccaactaatggtttaatttctctaagcaatatttgatatgcttgaagatgttatttttctccatcattgatgcagattgtgatttcagtaattgatcaacgtaggacgaaggaaccaacatggaatgaagaattcacatttaacattagtttatctcgagaaaatctactacaggtatgagcaagctcattttcgtacaagtataataataaacactagagattagagtcttagggtgtatcattctacataccatgtcttcataacttgttgtcctaggctcctagccctattattatggcctctctcagcaaaccaactgaagggacacactacatatcttatatgctcatatttgattattattcttgttttataattcgtagaactctgcatcttggaagtggctattgctcttcgagaatcttgttcattaggagtggatcactgagattactattttaaataaaaccatttgagaaatttggcatgtcaacctctgaaaaaagcttaagctgaatgaacaatattaatgccagacatcttgacaaatcgaaataaacatatatgactcaatatggttctagaggacacggcaagtagttttatttagttaacaggacatacataagcaaactagacgtatcattctagcaagttatggtaagctgcctcgcaaatcatagtaataatagcatgcaattctgtgcagcattactcttccttttttatcaactttattacatattggtacatacagtatcagtaaatgattatttgtttaatcattttcctcaacaggttgctgcttgggatgcaaaccttgttaccccacacaaacgcatgggaaatgctggattgtgccttgaatcgctttgtgatggtaactatttttattgacgtaaaaaataaaaatgcacgctgtttgacatttccttttgttatagaaagagcttggaacctatttctgtgatggcatggatgctggtttcttttaattctgagcaggaaattctccataaagaatcatggccaaaatacatatggaacattctggaattggtcagaaaccataggagctaatcacttttatatatgatggcatatgagaaatgagcacttctcttttcattagtgatgctttcagagtactgattaatcaaaaactaacagaacgatgttctagaacaaacttgatttagcaaaacgaattttgaatatgtaacatgcccccagcatttctgatatcaagcggttcatatcttatttgttggggacttggtgtcaactcacagttgcgcacttactccctccgtcccataatataaaggattttgg

SEQ ID NO: 64255 - DNA, 1138 bp, Oryza sativa
agggagtacatgtttctcagttgcatgtaattttgccgatttaaagtacttgtgatttatgaaccttcctgtgggaaaaaaaattacactgactagtttactcatttctcctcccacctttgtattaaaactagttccatgtattaacaatgactatttactcatatccacgtcatttctggtgtcatagttcatttcttattatgaagaactcgcatgtgagaattattgatattagcagtcaggctttatcttttcagataatatttaatatgaatttattttatgacttgcccttgggagaaacttacaatgccctcccaaccttttccaggatctttaatatgattcattttaaggcttactcttgggagaaacttacaatgttcttccaactttataggaagtaatcacaacgttacggttgaattagaaggcctaggtggtggtgggactattgatgtggaggtaaatccttacctcttcttttttttttggcaccagtatactctagcaaaggtgcatgtagtgaactaattgtgacctctcagagagaaaaactaagtacctttctaatgacaagaatcttactccctttgcacagcacagcaagttgtacatatatggagtagttagcatcttccccttgcacaatcttaataagtgggaaatcctttgtgctatagttgtaagtaaaatgaccatgttgctcacatgtgatgctatgcaatatatgtcgcggtttccctagcaaaaaacagttctgatgatatattgacagccacctgttatgttgcatcaatatcaatggtttcatgctttgacgaaactgtaggctttattttgttataattgttaatctaagctctaagtataacatatcaggtcaggtataagagttatgatgacattgagcgtgaaaaacaatggtggagaataccttttgtgtctgactttcttgtgaagagcagcctaggatctgctcttagaacggtccttggatctgaaagtataaatgcaagtcagtttgtgcaatctgcatttgggcaactaagttctttcacttacacatatcttccaaagccaccatctttggatattagagctgaggcccctaaaagggctgaacaatctgtag

SEQ ID NO: 64256 - DNA, 8205 bp, Oryza sativa
acatcatggcatcccttgtgttttgtgaataaaaattcattgtttgatatgtctcctttgttatttactttacttttctatttgttgtttcagtcaaaatggaaggatttgctaactgaccttatgctagtgcctgctgggtaggactcgatagtcaacattatgttctctttcattcatttacagtttgccaaatgcctggtttcaaagagtgctagcattgtggtacattttgatttatgttatgtttacctgaatatttccaaattgaatgcagactaaatcctgagaggttgggtggtgacttcaaacaagaaattcaagttagtcatctatatctttattcacttgcttctgtatttcacctcactttatgctatctggtatccaacttcttgacatattacatttcaggttcacagcggattcttgagtgcatatgactctgttaggaatagaatcatcgctcttgttaaatatgccgtaggataccagtaagtatttctataatgaaacagtttctaccacaaacatatatctcctgccaagtattaagtaatctttctttgtttctattcatttttccactgcagggatgaagaagacggagaaaacatacctaagtggcatgtctatgtgactggacatagtttaggtggagcactagcaacccttcttgctcttgaactttcatcaagtctaatggccaagtaagaagctctgaatctgatatctgatcttatttgctggatatgagaggaaagactctcatattgaaatttattaagacaggggtgaggctcgaacccaacccaggtcggctagcccacaccttgtggtgctagccggaagacccttgggcctttatcatatctgaccttatttcatacagaccttatcataccattaagttcaggcttaatgtgggaataggtttcagttaaacatttaacgactcataagaaactctttggttgtgaaagatcagatgaacttggcaggtctctgacccaatttaattgtcacgctctagcaaacctttgcaggaaggaagattatatgtgctttgacccagttcaattgtcgttctctagcacaacttccattttagtatgaatagtggcatttaatagaattgaatgaacttattttgaaagatactccattgttgtaataacaataacaataatccattattgttgttgttgttgttgttgttgaaagctcccagttttatatgattgtgctataaagcaacaaatatatgtttgtatagctcttcttctgcaattgacaatctgtaaaattgcattaaagacagcttctatttccctacatccttttctacgatcattcgttcatatttatccgttcaccttttataggagtggggtcatatttgtgacaatgtacaactttggctctcctagagttggaaatagaaggttcgctgaagtctacaatgcggtaactaagaatttcaaattgaaataggcttgcattcattgattttgcatatcactctgtcgttcaaagttcaaaccggttttccttaaatcagtatctaatcatttcatcatatggacaaggttgatagtgcaaataccatctctcataatttgaaacaaaaattgaaagcagtctgcaataccacaatctgccttttgaaaccattgtgattttggactaatttctgcagaaagtgaaagacagctggagagttgtcaatcaccgtgatatcattcctacagtaccacgtcttatgggctattgccatgtggaagcaccagtttatcttaaatttggagatctaaaagatgcactggtgattagtattcttatcctatttcaatcaactttgttgtaggaatgttttttagttccattcaaagttccgtgtttttatccataagattctaaagttctcaactgaaaccattgtatgtattttgatataggtagatgaggagactatagatgatgaaggtgattccataggggagtacacccctgatgttcttgtcagtgaatttgtgagtgtcttgtgaacttaatacatttgtctgtagactcttgactagctagattctcttgattctgatgataagatgaggattctagttttctaaaaataaaaagagacacttagttgttttaattagtttcttcacaatgttctgttgaactcataataccgatgtaagttgaagaggataaatgattcttgaataaacaaatgattttgctcaaattgcaattgaaatcaggtgtattaaatccctgcagatgaaaggagaaaagcaacttgtggaaaaactacttcagacagaaataaatttgctccgatcaatcagggatggttcagctcttatgcagcacatggaagacttttactacgtcacactgctagaggtttcttaccttgcttatttttattttcaaacacacagtttgtattaaagaggaagaaaggggcagaaccatgagcacacaaacaaacctgcacacttaccttgcctaattacttgtccttgataaatattctgtttttcacatcatctctgcttttcatttcacttgttatatatcgaaagcttcctccaagtaaatttaaccaacaaaatacacttaaacttttgcagagagtgaggtcaaggtaccaaacaggtgacggtgcaaatgaagactaccatcagttaaccgcctgatcttagtacatgcttgaaactcccaaacctgggttgcctgtaagtaccactcttctaagcgcacacagcttgtacttgtcttatggatatatttggagttgttggacggtactgtagtttaggggataattcggacaaagaagaaagtttttttgggggtgtttgaggggggattggagtttgccctactgttatatgcgtaaacaaataggcggtgcttgcccaacattcttttactagcaacctagcaattatccaaaaacttcagtggcactagtgcattacccttacttggtgattggtgatcgccacaaagttggttaaccccaaaatcatttgttctgactctgtgtctgatgtccgttttgagttttcagggctactgccgttcagcttctttggctgatagatatcaagaaacattgcaaacaatggaacctgtgcaggaccagtttaggggttatggtcgaactcggaagtaagaggacgcattgcccttggtagtcagtttgtatgataaagcttcaagtaatcaggacagttatctgaggatcctcatctgcgcaaattgcaaatggacttagaatgcaaagaccttcattccccggccgtaagtggtgtgattgacacgcacatccttcctcgtgtgtggtaaattcgtgtaatcaaacataaggcttggaaaatgcccttttatcctcaagtgctttgaactgtaaattatataagctctatgatccttaggctaagcagttagtaaacgtggcaaaaaaaagtgtggaggtataccaaaagatgtaccaaaaagggtgaaataaggggaataaatgcatattttgggtcactgttttggaatcttgatcaacaaaaggatttgttcagttgtttcatctgggccaatatgcacgcaagtctcaaacgaggacaacacacaattttcaaggtacaagagcaaatatgtttatgaccagaggcatctcgattcatatcaacatctaaataaagttttctacaattgctgctgtttgttaaaaaaaaaaaaaaactaagatgagaatagcaacgttccgtttgctcattagctctggcacactgcaaagcacgaaaaaattcatcggacaaatctacagagataaaagtcttgcccataatgaaggtctgatgtatggaattattgattaccgtagtgaagtagttggtatatagatgacagatcaaacagcagcacggaaatgcttctgaacatgatgtgttgcacgcgtggctgaatcaacagtcactccccctttatttgagagaaactagataacatgtctgacctagaatttgctaattccacaattaattcaagtgctgcatgaaataaatatagagttagaccaacacacaaactgaggggttcaaactgacggtgcatgttcctgttagaaagaaccgaacctgtttcaaaggacatctgggccgatcgtagttttggagataccagtgctccaaaggttgatagtgcttttgatcttgccttctgaacctaaggtgcaaaatatcaagaaaaagttcggtaaaattttgaagtccaagaatatagtactacctccgttttaggttataaaattttctagcatttcccacattcatatagatattaatgaatctagacacacatatatgtttagattcattaacatatatatgaatgtgggcaatgctagaaagttttataacctgaaacggaggaagtagcacatagtaagaaactagttggtcaatggggggaagattggtcaaatgaactagtcaatgcacaaagaaaactctggctttgttggcatttacaaattagaatagtgactgctctacttttgttgttataagagacaccatcaattatgctctaatgttttcttccctagatgaagcaatatagcttggtaggtggacaactccaatttataacggttacaaaacgttttacaaaaaagagctataatgtatatatgcgagttccagtcttctatccttcatcatgtatataatgtaggcttcatattaaacttacatggctactagtgtccacactagtagcagactctgccggagttgcatctgaatcatggctgccatcttcttaacacgagaagatacgatgtgagcaaggagaactaagaaatattactaattatggattgtggaatgctaatacctggcgttgctgctgaccctcggtaccttaattttggcttagtagtatctcgcacaccgacagcgtcattggagttggatttttcttgcaagcaccactttgacaggataaaatgtgggtttggctctgaaacatgatcttagattagttcatgacgtgcaacatggaactaccagaatacttagatatacaagacaaaaaagataacacgagggcttctggagaaaacaatgatgtttgcaaatacgttttgacattgctagcaaggattaatagagagatgtttcacctgatgactgcgagtctgcagaatcaaccacttgcagcttgctagctgcagattgctctttgtgatcgaagagtgtactcgaaacacgtgatgtacccatcgagtgacgggcacttgccagatcaagccacccctagagacaaaacaaaaccattgttcatgctaatctgtgaactctgctactgttcagtaaatcagacaaagactaaacagcaataaaggacctcactctttcctaatcagtacatgaacaaggcagccaaaagagttcagttactgaaaattatcgagctaaagtgttaggagctctaatgggccatgtcatccattctccaaagcaagcccaagccagcccaagcaacagtaaagaaagtgaaggctgctgctcctgcagcacacatcgattgatcaattggattggcggagctgaagctcccggcggcggcggcgacttgggcggccggtgggcacccttgtcgatctctttcccctacctctcctcctacctccaaccttctctctctcagttctagaagcttctagaacttgtaatccctagtttcttcttctcttttcaccccaaaacacttgttgcttgtatggtggatgtttgctattgagttggaagaagtgggttcttaacataaaggtaaaaatcagcatccacacaagtttcagggcacttcactcggtggttgttggtgcaatacgagcaaaataatctgaacaagcattcttctccagaacaggattaggagctgattctaagtgacatgcagttggctagaattcaaagatcacgaactcgtttcttttcccctcccgatagttaactgcatgctactcctgtaataactatcgcttcatctggagttaaaactacatcgcagagcaaaggaaatccaagaaaaaaaacacgaatcacaacaaaccaagaaagaggtcgggggtggatgagcggagagcgggagccgtaccgggcggagaacggaggacagtgaatccatgaggaggaggtagccgtccacagagtccatgaaccgcaggatctcgtcgtcgtcgcctcgcccaagtcgtcccccctctgtggcctcgtcgacctcttccacttccccgactccagggacgacggatcccgtgattcgcagctgctcctccgtcgccgccgccatcgtacccggggatcccgtgcaaaccctcgctgtcgaagctcactggtgagtggcggaggccgagccgccgcggcggccggggaggatgcgcgtgggtctcgagtcctctgctcgtgcgatgcgggtgtgtgcgcttgccccgactcgtgagcgctaatacacggccggatctcgggcctacggcggcacgcttttgttgattgatcgtttcggtgtgataccgaaacaggagataaaatttaggaaaagtttatacttactaaagttttatttcggttttactatactatagtacttgcgatagttttttagtcgtaaaaactttcaaatcatgaacttcacatcaagattcatcagataataaaaattctcgcaaaacctgcggaagcgaggagtcgaacctacactgaacggagctaaatttattttatcttgctgaaactcttattaaattttattttagtgaactcttattaagaataagtgtcatgctttgagtacatacagaaaattgacgcgccaataggcgcacccatgacttcttatatctgcactataaaaattaaatatttgatagaacctattaatagcatttttaggtagtactccctccttccaaaaatctgagtcatatttctttttcatcaagaccaagaagcaattaatttattcaccatgtgacaaaaccaataaatatgcaaccaataagtattaaaatggcttcaacaatttaatttaacacataatgactacaaataggacttagacttttggaaaaaccaaagaatgaaatatgtcttagacttttgaaaggaggtatttattacttcatttgttccaaaatatatataataatttttagcttttataatttgttccaaaatataacaaattctccgcatactattctgaaaataaatttcaagaaagcatacgatcataacctacgaacatcctattcctaaccattcacaaccctttacaattctttttttacctacctccactttccatccaatcacattcttccccatttaattctaccaaatttcttaataaccatgttcaactataaaatttcttctattctaggttgaaggtagtaaaagatttacagtgccatatatttctataaatgtaaaagttttgaatgaaacaaaacttttatatgttttcacggttttatccatatttgtattatatttccatgttcttatttgaagtattgtatttgtctttcccgaatatagtaacataaatatttaagcacattaaatatttgacttattttgtttttctcatcaactaaaatacagacaagtaattatttatttgataaaatcatcctatgagtatataattgcatataattggttggaggtactattatgaaccttaaaagaattacaaggatcattctataaatatgaagtggagatgcagttaggcatgcacatagaccgttttctctcacgcttttctcgtctcacgtccgcgcaccgttttcccccttcttcacagttcacactctcctccaagaatgttcgtgttttttttccctaatcacatatgaacccagcccaaccaaagtgcaaccgtttagactcaaggaatcaaggcctagctgcctggagtgcacacgtgggcgatggccgaggggctgctgccattccattgcacgtgaggggcaatccgtgaatcacgccgcgtcacttggtagagctctctgcccgagaacgtgcacgaaattcgtattatagagatagattttctaaaatttttatctagttaaattaaacggttaatcggttaatatcattatttgtagggtttgtt

SEQ ID NO: 64257 - DNA, 8957 bp, Oryza sativa
tacattgtgaaacggaggaagtacaatattactaaaaaatgtataagccatgtgtcatctagttccctaggcatagaaattattatatgacagaatcgtgcttaatagttctgcttgtcagttaaacgattgctgctccagcttataccaagctttagtatgagaatggcattatgtataatccacattttagaacaccatgtttaacctaaaagccaaggtgcatcatcgaaattctgatcataaaatgtacaagctaatttgcgttctggatagactataaagaacttaaatatgagcatctactactctgggtaggccatgtatatattactgcacaaaggaaaggaaacagtacaggtaggacgtaagtttcatcgtaacacgtaaaggttattatttcacccttagagcaagtttaatagtatagcccactattagctccaatttatctatagtcaatctaatagccaattcatacaatagttgcttactatactactaatatatggtcccacctattatatacacattgcgtcttagagtccgtgctgtagctggctacaaatatgtttacagctggctaatagcctgctattgtacctgctataggctctctacaagacatccatgtcagcatattttcctacttggaagatattaaatgaagagagagagcaaaactatctactaacctagaaatagtctatagagaaaaacaatgcaatggattagagagttatatatacccatatagacataccattgaagtggtttactattaatctagcctattgctgagatgtacatgttttatagatagcaccttactttactattgcgggtgctctcagtaagaagatgaacttacttccgaaggtggcttggcccttcctctttacataacttgaattcaggaggtttccaataatttgcagcacatagttcaaaaaggaatgatcttgctgttttgtgtaccatgtcacctaccaagatgattgacagtgttaaggcatttcctctaaaattaaacaatcaaaactgtgaagtgtgaacccagtatttggtaaacacatagtttaaaatgatgttagtacaacgacacggttgccaatctcgtacattttagcacataaagttaaaaagagataacatatattatgtgtccacttgtgcggttgtgcccaacagaacaaaattaagttatttttcgcgtacacgcaacaaaattaagtcaaatgtacactacaaagttgaatggaatatgtaattgcttagtttgagctacaccacaatattgtaactgtaaatctgaatatgtaggtaactgtttagacttccaccaggtttcaaattttctaatggtagcactttaaagtaagaaattttagcataccatgatacacctttttattgcttttctctgttgcttcactaggcagacgaccactctgtgttgccaacttgggttgattgttccttccattattgacatcatgtttgccagaccctgctataatttgattgtggaatttagaactcctagtgaaagatgtttctgtattttgaaaaggtatgttctcttcatgtatatgtggactcttcatttttacagatatgtcagcctcaacatcgattggatcttcattatatcctatcagttctgattccctcttcctggcaacaatcaaaatctcctcaagggacttgtttctgtgcttataaccgtaattctgcataatttacaaaaggaccagtaagctggttgtggcatgcattttaagaaacagggtatttgaatggacagattaacacaaacaacaaagagatattgtgtaaatttggcaagttggactggaaagcaatgaacacaatgaatagtttctttccaatctattaaatcaatgatctttcacattcatgtcaacaattaagcaaaataaaatagatcgttgtaatggctgaggttctgatactcacattctaataataaaataaatagtgttcccgcaaaaaagtaaagcaaatggaaaaatcacaaaaaatatatcttctgtatagactacagagagtgcttcgtgcagctaactgaaagcaaagcattcgtgttgcatggtaattgcagaagaaaatgctaagggaacaaaattgtaccttcagtttagaaagtgtttcttgtgcagcaaactttctagcggcttttgaattccgatttgctgcagtacaaatgataattttgctctttatgttaacttctactttgacatggtactctccatcagctttcataggtttcggaaggcctaactcaaatccatgacactgacaaagctctcgaagttctctcatcggattagtgtgcatgttggcgaaggtcaatactggctttagaagcataagcattaccttccaaacatagttcaggttgaagcctgaatctaaaagcactgcgccaatacaagattcaacaatatcaccaagagcctgtattgttgtagataaaacttataagcttttgccataaaaaaaatcaatcaatcaattacatataactaattgcttacagaaaagatcacaatcatggtaatgagctatgattaataattctctaatacacttgcaattattgataacacttttgctcattttgtagaacttataaatctcccctatcatattgaatattaaacagtatccttgaggagtactccttccgtcccataaaaagccaacctagtattggatattgacacatcctagtactaggaatctagacagagacatgtccagatttgtagtactatgatgcatcaacatcaagtactaggttgagttttgtgggacagagggagcaaccacaagaccatggtctttcttcctctcggctaaaaaagggttactacaaaggtgcagatggaaaaaaatctctgcattaacgtcaataccttgggacatgctggttcttcaagcaagtctttctctgaattggagagcttcacatacatctcaaatttacttattgctgacgtgagatggtttgaatcctttataagatgcttatggatagatttctcaaccgccgcataagcaagcgaatcattaccaacagctaacgatcttagatctgttatttgaccaggttttatatccggataagtagagtagaggtacgaagttatcacatactccaaaacagcgtctccaagaaactccagtctctgaccagaaatgaaaagaacatagcaggtgagcaactatcaagaatcacagcacctgtgcaatcagagagagagagagagagagagagagagaggggcaactctgacctggtagcagcctccagaatgttgactaaatgaagggtgtacgaatgcttggagaagtagacccttatgtttgaacttgtaacctatcaattcttcaagcccggcaatgtcagtgtagtccataagagataaattgatggagcttgaatctaataccctatagagagctggattattaaaatcaacgtctattccaatccaatgcaggaaagcaaatgcagctttgaatccaccctcaacaagaaatgctccaataagcgattcgacaacatctgcaatcactttcctatgcagccaatgatgtgaccttgtacatctcaggttacagttttctctgttatctggatgaatatccatctggtgtagtctcacttccacgtcagtattgcaaacaactttacaaggccttcctggagcaaagaactgagtcggttcaaactgttgatcccgtatgtatacctaaatttcacgagaaagcattgctgattaagaattttgcaataaatacttgacaggaaagttgtatcttctacagcgataaaaggaatccatctaaaaataaacggaaagggaaccgttgtataaataagcagacaaaattaatagatcacaagtgtcacaaaatgtttgtcaatattgctactacctccgccccaaaatataagcatgtctagctctgaatctggacactagattcagagccagaaatgcttatattttggtaccgaggtagtagatcataatgaaagagccagatagtgcagaatatgatgattctggtagaattgtagatcatacaacttagcaataaaaaaatgggttcaaggttaactaacctgcaatttttttctgatcgataactcatataaatgtgaattgttcactacatcagaacgtctcctggtcaattgcccttcatcaagtccttcatatgtaataaacttgtgacgtccaactacgtacttcaagaaagcatcgcctaggacttcaaatcgctccaaagatatcctctccaaacatttctcagtagtaagcgcttcaagtatctgaaatgaacccgtctaagatcacaactattttcggcatggataagcaaattcaaactagatgttcaggatcaaaggtacaaaagatggtgcaacttacaccagaagcactaatttgagatgcctctggaaaagaagataacatcacatccttcaactcaatagccaccagcaaattctccaaacgatacattaaagaaggtaacaaggacagggaactgcccatatcttttgaaaacccaatgaccttcaaagagcataattctggaggtaactccacgaagtgctctagtaattcacggccctccgattcttaaaaataataataacaaaagatgtaacaacattagaagtactatacctggatcagaaccatgcaaagattcacagcagagtaagatattcaaaataggattcagtaatgcattgggtcccaagattataaatgtactactagtctactatagtaatcccagtatacaaaagccggagaaggaaataggaaaaataacagatccaactgattcccaagcagtttccaaactctaaagcaatccacaagcagttcaataattttgaaacaataaataatagaagtttacaaagcaacttctccgcgacatatatgtagttatataaaatttattatgctctttctgagctgtggtctaatggatgacaaaacattcttggtagcataatgatatactgattacattttttatcatgtcataataatcagaagtaatgaataaggtgtcttgttacggtgggacaacggaataacctgtggtctccggtaaccgattatgaagcaaatttcgcaggttgaagatctgtttagccttcaaaagtggctgttcaggatgtgatagctcaatacgaaacctaattaatgcataagttcatcaggacatgtataaagctcttaaacttgattgtgttgctatatctaccttaaagaatgctcaatagaggtattgcaatgttgtactttatttagtaaaatcccattaaaaaaacatgtaaaccaggaaggtgagcacggataataattgacttattacctttccttgaagtgttctgcataagttgcaccactgtgctcgctccaagcatttatttcgtccagaatgccatcaacaaagaaaaagatattgttgtggggactaaagactacactgccaactacatcggttttactgaagattccatcaagaagtctcagagactcatttgatgaatatgaggcatgcacagacacatctatagggtctttaaaaatcggtgatgataaacagcgctcaactgctggccagtcaatcataaatctatcaccataacacttttgcttgatgggaagcagaaggtaaaatgttgaattgatttctaatgtaacatcattgcccaatttaacatggggtgaagtaaactcagatctgtccaggagaatcttcagacacatctcttgaaacttgtgtgcaagcatcatctgaaaataaaagaatattaaataatatccaacaaacaatcatgtgttatcaattgaacagatgagcaggatgatgccttctctttctcaaatgctattttccccaaatgcttaattcctgctttcacaatcctgccacgagcaagatgcaaatcaacttgcaatgtttcagcttccacaggaaggggattgatcacaaagagaccaaacatctgatatcgcctatcttctggtatgggaataaatttaacatagtagaaatgcaagttcgataaagaatccaactttaatcccgaaggtttgagaactgcaggaattaacatctcatgaagctcttctcttagactatcatctgaaacaaggaaacaagagttaagccagagccagcattatgcgcttatggtactgtatgaacaagtgaaaataccttcaactttgttgtttgatgaattatttgttactgatactttattctttcttgaacctggacccggcagaagaaaatctgtcaaagcacccaatttatgaagttttacgcatgcctttaagcatgcatctctcttagcttcatcttttgacagacatggttgaccatctgcttgacggaaagcagcatttggtggaagaattagtctgcagattattccctcgatgccatcaatgtagaagaacactggggaaggagtaaaaaaccttcataaaaaggagttatattagcatcgcaaagaactaatcaataaatcattgtcatggcgagttggtgacagactgaagagcaaaaaaaaaaaatcttgacatacatatccctaggaaggttgtcgcagtagcaatgtagtagagatacactacaagcagtgctaatggaagcaccggtgttatccacttgataaatgttctcctcgaggcaatcaaacatatcatttgaagttcttgagtctatctcttcattcataatgctttcaccagcaatataaccattaagcaacttttcatgagactgattttctctggcatgtatcaaaatgagttaggtcttggaccataattaaggactaaaatacagttgaatcttacaatatgaataacacttatacgtaggggaaaaaaatcacctctctaggagaacaacgtatttagatttagtcatccgggcacgcccccttgattggataaaactagcaacagtttctggaagatcaaatcgcacaacaagacaacacgtctgaatatcaagtccctcttcacctacgcttgtagcaaccaaaagattcacctgcaaacatcagacgaattttgatgcaagaaatacaatatatgaacagcataatttagattcaagtggtcaccacaattactttaccagtatatttcttaaacatatgaaatataaaatgcagaactaaagaccttaggcccacacattcaaatgaaggattatttgtacactaactatgctatgaaatcaacgaccttaggcctgcttgaataaaatcaacgaccaaaacaaccttatgtaattattagtaaactaactatgctatgaaagtcaataatccatcccttttgctttgagacaataaggatgataacttaaactcagtaagaaaaaaaaatgaattaatgcaggctgtcacatattcaaaatacatagccaaagaagtgttagaagaaattgttaaaagaaaacaaaaaaagaggaaatatcatgaaaggaatggttattaattatacctcaccagaagaaaacctttgaacaatagcatccatcttattccttgacatgttctttgatcctgagtggcagcccacaagaaactcacatttccaaaattcaagacacttcaagttttggagaatgtttgatattgctcttgcaacagttattcttttcacaaaaacaatgcatttcatgttttcctgcaacctgtttacggaagtggtcaacgcagaagaaccagcatgatcagaaaagacacagaccaaaagtttctggaagctataagctaaaattgagatgaacaaactgtttggttctccctaacacttcaagtggaaacagctaaatcaatggaaaacctaaaaaataatggcattggtaggagaaggtatgttcaagaaagatatgataccaaacataattacacttacccgtatctcgaaagaacattgataagaacagaaaatttatttgagaagaaaggttcttcaagcttctcaaggtcaaatgaaccagcgtgggaacctaagaagcacttcttgtcagattcaatcattttttataaaaacaaatgtatatcagctgacaattatttcatcacaagtcctctgaagaaacaaaaaagaccatatccttacaattccaatactgaatgttgtttaaaaaattgagcagccctaaaagcagaccctgccaattctggtttttttcagatgaaatttcgcactttttccatacaactctcactctgattttcaacccccaaccacagtgtcaggtgctatctccaacgatagattctatgcgtccaaggcctggtgtaggcactctattacaatagaatgagcgatgccatgctgactgtagcaccatgacaattagttcccttggagataaatagattagtactatctatttccatatgatattaaatagtagtttggtacctaagtgtcagttaagaagtttatgggtacagttaggaagttagagatatggtttgttagggaagtttagattatattcttaaagggtaacgttactgttgatagaattttttttccagggaacaaactaaatatttgcatatcattgcattaagggaaagaatgttaggttacaacccctgcccagctgaaacagccagcaacaaccacaagacaatcacatgctgactcctcgcaaaagaatgagcgacctaaactcgctaagaacagtaggcaacctgatggaccaatctagatccagagacggaaacattacatgaggcactgtagcagcatccatgttatgtaacccaattaacattaagcaaagagatcaagagttgaactaaacccagtctctaccacatcagggagaagccctgccattag

SEQ ID NO: 64258 - DNA, 17048 bp, Oryza sativa
acaaaaaggtcctcgcagcctgtgctacaatgaaacaaataagggataactgatgtgcagcctaccttaactgacatgcgacatctgtctgtttaaaaggggcgaaacagaataggatactaaattcaagaatcacatgaacgagaacaaatattatctacgaagaaatatccagaatgacctttcatcaatgtacacttagcctacaaaaaatgcccagcaatttgaaggcttggtaacctaatcagcataatgacactgacagaaaataaggaaaggaaatcttttttcacaagcacatgcaacacagacacagatagacacacatagagatattcatagtgggtcaatgatcctaacttttctcctaaattaagttaatcatcacatttcaacaggacatgtgatgccaaccaaaatcgtacatgatgaaatagtggggagccacttccactttatcattaaacacatgttttcgctgctgcagccatagtttgcaactttgcaagaaattgagtgattcgggttatacaggggtgtgttgacgcaaaattgtctagtggtttcatatcaacatgttgccaggtgaaaaaagcactacagcttatttaggcaaaatgagagcaagatccaggaagaaatatcctcaaaaacaaacaaacattgagcatcgagctaagtaaacatgtaagttgctcccacatagattaaactcacttgcagagctccgaaagaaccaagttcttgcaaacagaaaataatattttcatgcaacctccataaggacttcagtttcttctgagaatccttgaaatcgcataggctcgctcttagcatgcgctcgctctgtattaagcccaataaaaataatgagaagggaaaaaaggaaacagaacacataaggttttgtcaattggagtaatgacaatttcagcataatggtggaacaaaactttacctgaagctttaagctatcaagctctttgatgcatattgtggtaaggttagagtgattaactgggccataaaagtacacctccatatcaggagatgcaaccacactttcaagttcttcattatcaactgaacaaacctatccaacatgagagtgaaaagttttacagagaagaatatcactgagtaatttcccccaatccctagaaatcttgccatgagcaccagcaatatgtacctttgcatgaagtaattcctcaagactgttgatacatttcgtgtagttaagtttattagacccacctgccatataaaacatatgtacattaatcgaccagacatgcttaatataaaagataatcgaagcaaccaaaaataattttagggtaagactacttctattcttagcggtccaaaaggcaaggctgaaaaagagaaaaaccccaaaattaactctaaaattaagttctaaaaggaattcaacgggccaacctaatttattaagattggagcagaagaaaactcaaaggtgctcaacaacagggttgttgaaggtacatatgctacaattacaaccgcaggcaggcgaccacacatttagcactaggtagccacagaacaacagaaagctctacactccagcatcaggagggtcaaggaacttctagaattcaaatgctggctgaggcttataaaccaacgcgcagctaatatttcaaagtgttacataagttactccagcaaacatttttttgagccctgaccataacattttagcattaaatttcaaaagatatctcaggtaatcatgttttaacttataatgtactaatggtgtaaatcacaaacatttgttcataactcatccagctttgaccttttggaagaaaaaatattagaggctgacaaggagaccttcctcctttttctgtaaagctgtgtgaaggcatgacacctgggatggtgaagatggttacagaagcacccacgcaaacatgacatgcacatgagttgaatactcaatatatgcagaatttcaatgcgtaaagcaaaacttcagtgcgtcaagaatttattttatgtgtttttggtccaattttcctctttgctttggtactatgaggcttcaagtgcaatttctgaccaactgtagtggagcagagacattttatatttgagcacatttccgttcggtttttagaactaggagttgatataatgataaatactctttgatcccaatttcttgttcaattatgagtttcagaaaacctttggtgtttctcttccaatggatcatattttttttcaaccactgacaacataaagatttaaggatttaaaatgatcccaaaaaatttagtggcatttaccctgtgttgtaaatttaaaagcataccaagaaatagaatagtatccaagaattgattgtatgtaatgaggcaaggttatgtcctaactcttagataaataaagaagataatatacgtcaggagcatattgactgtacaaaatgcattacagaagaaaagtggtatgcagtactggtagaaagaatcattacctttcccaataattggtgaagcagtcatgccaaaaacccgagggaatttctcaacactgttactattatagaattcctgaaacattgtcataaatatttttaatccagaaaaattgcagttcattgaattaactacaggtactatttaatataagaagctgtcctacaatcctataggtttacttatgtatgaacaatttgctcacctattgatacaacaggagcaacaagcaactggacccaaaagcctactcctaccatgtggatatagtttataagaaacaatttaaatgaaaagagtatcaatgatgtactgcagcatgaggtttaatgggttaaaaactaaacaactaagtattccaatagatgtagattaccaagaattcaaaagttgtaataaagcaagaaaatcatgaacttgccttcataatttgcgcatatggatgccgtttttgcggttgtgcatgatggcactcatcaagtatcagaagtgcaattgagttcatcttgatgaagcaatgacgcaaactttgcaataatatttggggagtcattacaaggacctgacgtggcagaggaagtacaaaagttacgcaaagaactaatgtacagagtagaagaaaagatgaattcaaatggattatatttgaaaaaaatgaatacaataatgatatatgtgctgtctacatgttctcggagtcagacctctagtttcagaataaattaggcaggattaagcaggaccttttagctgaagattcttctccatcgtgtgcatcttaaattagtttatgataagtcaactagttatctacaaagcttctctttcgtttacaaatacttttcatgctggaataataatttgactggtctgcagaggtaatgtactgcaaagtgtacctcaaactccctcatgtcgttctcccattcctgatgatctctcgagtttttaccattcccataataacattgaactttgaaatcggtggaacttgcgatcaccacagcttgctgtataatataataaagaatacttacttttttagtgagcaagagcacagattaaccatggtttttcttttttgataatacactgattaaccatgtaaagttttatttgattctgaaaggtggagctataaccattcataagcaaattgagatgcacacttctagtgagaaattaagaacccatgttcccaattcaaatcggttaccctgacatattgcaaattggaaacttaatggtaacaaatgattgggagcagctgcaagttgatgtaaacctacagtgcggaccaggaaaggaggatatctacctggcgtacaagggggatggttggggcaaggaagatgcagacctcgcggcttggcttgcggatgagatgaccaagctcataaatcagcagcacggcaatgtgcgtcttaccgcatcctgtcccaaggtacactatgatgttctcctccacagccctcttgcagagatccaattgatacctaaatacacaaaattaaaacaatcttcaatgctattctataaattacgccctcacaaaaaaaaacataaattacacatagttgaacaaagcggaggaatggattaaaaaagctaaagaaatgcaacaaaacaagatagttcgccaggtgctgcaccattctgaactcgatgaaagggtgccgtgtcctgccagagtatgggtgcaagggagctaaaatgggtgcaaatgccacagaatcttttctcttctctttttttttttttgacaaagagaggcagatctctcccgcttccattgcagaaacgaggcaaatggcacacaatctggtataataaagggaatgtagttcatttatgcatggagatgatattactactacagattatctggcacactgcattgccaccgagtaacggcgcagtctacataaacacaggctttgaatgcgcatcaacagccatcaatatgtgaagagtagtaccaattattagcagatatgcaaccgcttcccctgagaaagcatctgacagtatcgaatcgtaggcaataaaaacggggattgctttgcaaattacgagtagtaaaaccttaaaattaactaatagaaaaacattttacggactcactgtctccttaagattgatccgctgacctatgcttgaatcagatcggtctaccagacagcagagaatagagcatgaaaatgctccacacaaaaaaaaaaacgctccataaaacccacctaaaacctcccaatactcccgagtaacaaaaaccacgaatcaatcacgaaacgcgaaggtatcgtcgtttcgagggaacaaacagcagcgatttcacttcgtcccacccaccaccatccacgacgcatcaaaaatcccccacaaaataaccaaaaaaaaaaactaacgaggaagacgcggacgcggtagtagtaggaggaggaggaggacgggcggtactcacttgcgcgcgatcgtcctcggatccttcggctccccccgcgtgctgctcggccccgccgccgcggctgccggggcggcggcggcggcgtcgcccatggctggcggcggaagcttcgagccgaagcaacccgcttccccttccccctcccgaagtcaccccccacacacttgggcgctggacacgagacgtaactgtgctccgcgaccgccgctgcggcggaaagcgtgggagggagagagcaagggaggaggggggcccgtggccgaggaggagaggggaagaggaggaagagcgtgcgccgttgcgtgcgtaaaagagcatgtataataacaggctatagcatgtacaatagctgggctattagctagctactaaatgtaattcattctagcatttttcacatttatattaatattaataaatctagacatatatatctatctagatttattaacatcaatataaatatgggaaatactggatgacttacattgtaaaacggagggagtataaacatattttaataagataaaagatgagagagaaaagcagcaggctacagatctatagccagctgcagcacggagtctaagacgtaatgtgtgtataacaggtgggaccggctacagatatgtagctagctgcagtacagactctaagacgtaatgtgtgtataacatgtgggaccaggtattaatagtatagtaagcaactattgtatgaattggctattacattgtctatagatgatttgaagttagtagtgagattagagcaggtacaatagcagactattagccagctacaaatatattttaatgagataaaagataagggagaagagcagcgggctacagatatgtagtcagctacagcacggactccaagacgcaatatgtatatgacaatgggaccatatactaatagtatagtaagcaactattgtataaattggctattagattagttataaataaattggagctagtaattggctatattattaacctttgctcttatcaatcaattaaacttgctctaaacgaggcaagcgaagcgaggagcgggtcgagtcgcgtcaggagtcaggacggcgtttgtttccggcgcacgagagcggcggcagcgttgggagagtcggagagagagagagagggggacccacctggcgtcactgcagaggtggggcccactcgtgcggtagggggacggactgtcctctcctccgggcttttggtctggtcgttttcgtctatactgtgcgcgagcggagcgtgtggtgcggtttgggttgggacttggggtacgacgaggtgacgaagtattgagagatgactctagccggtgtagtactgctggtgtgtggcgtgtgtggcgacgaggaatctgagcccgcgtgggcgtcatcagtgtgcacgacgtgccttgggcagttgggctcggtggatgggagcgcggtaagaactgcaacgtgtacccagcgtggttttcccaggtgttacatacaccgtctgtaaaaaaaattaatttgaacatgaacttgtccatgcgtattgcttagaattggatttttttttccggatagagtataggtcggtatgtgggccgtaaattccaatacttgtttggtttacatctaatctcatctaaattatacgtctttcatttggtttataaaaatactcctttgatagctagccagacaagaggatagccaaattttcccaaaaaaaaagagtagcaacaaccaacttcatatcactctgagaaagagatggttgcaccacgtgatataccagtgcattttatataataaacaaatgtaatggtataatgagatgattggttaccgaataggaaaaggtagcatatctcgttttcaccataggtcgaggacaacggtggtggtagtcacacataggttggctacaaatcaagagacttctatttataatggttgtaaaccatagtacacaaaattatcagatgagttggaacttgtaaaacgtaaggcaagcaatggatggttaatagaggttttattgaactacttgatttgttgacgggtctatttctaggggaacacactaccaaagacaacttatgaagaaaaaaatgtatcatgtccactgaggctagggtacagagaattcacgcatacccaattgactgtatattgtaatacaaggataatgtcggcttagaagcatgtccttcgtgcaaagctacttgatacgagagaaaaggtactagcatagaagacaagaatgaattcgaagaagagtgtctaacaaatcttttatactatttgcctataaaaattcatttgaggccatcatatatgggccggtatgtgctagtgtcataagtttacattacatcaacaagaactcagcaacaactaaccaatgaacaatgatatagtggtaggttatttttgtaattcctacgttggtggcatgtatcatcttgtaaataacatgtactcaataagttactattactcttacttctgttgtgtacacaaataatagtgtggttgggttaaaccaaatattggctaaattacatgcattggatccagggtgaatcaaatggcttggtgatcagcccgagcaaccactcggctcgtaagtaatgacactatgatgacatatattttcagtgttcaataatatctatcattgtccgcgcatgtatatgtctagcatatctaaattcctctacctttttagataatggatataaaacccgatatttgcttcaattgaagctacaaccacttattacaaagttattggcacgaagcctaaacacactagaaataacacaatggtagatgaaaagacgacacaaccacaccaaccaaaggaaaatagcttatcaaagttcataaattcctccactggtagggataaggcgcactcaacctagcgattttcctttgataacctagttcataaatatatctaaaaactaaaagaaataaaaacaatttaagagatgttcaacactataacatctaccacgacaaaaaaaaagatactcaatatactatgtatgtagggagggaaaaaaaagataaatctcaggtgaataataaggtgatatgtttgaacactacgtactagagcacaattttttttcttgtatatgaatccggacatctaaactaggcataaatccaagccgccccttaatttgctgcgaccaacccgtggcagcaagaaaacctcgctcctcgctcagtaatcgcctcatcgatcgggctagtccgttcgacgacgggtgtgtacgtgggtgcaataaagaacaagaaaatcgcgcacagattccttccctcccttgccctccataccagaagctctctctgatcccacccccaaagtgcgcttggagcctctccacctccaggtgacgctactggctgcgcgtccctttttgtttctctttctcctagcaacaagctatagatcacctagctagtgatgccccagccttttaactagcttcggactcgatcgtatagtagctgcgagctcgtcggacagtacagcctcgatcatggggacgacgtcgagtccggacaccatggcggcggcggccggccccagcctgtccatcaccgtcgagaagaacccgccggaggcgcgcttgcttcagctcggcatcaagtcgtggcccaagtatgtacatgcataagcctggctcttccttaattaatctcctcgttatttggttgttaatttccatccggtgtgatttgatttgtaaaactaagttagtttaattttggatgtgattggttatataagatgggggtgtccgccggggaagttcccgctcaagttcgacgcgaggctgacgtgctacctcctcaagggcagggtgagggcctccgtgaagggcaccgggaggtgcgtcgagttcggcgccggcgacctcgtcgtcttccccaagggcctcagctgcacatgggacgtcgtcgtcggcatcgacaagcactacaacttcgactcctagtcagttaaacaccaagctagacatgcatgcatcattcatgcttcgctcgatcgtctcttcttaattaatttgtagcgttacatctttgttaatcatctcctcacttcacagtttagtgacacgctaagcttgcagcaagtgttttgttcttggcaaagtcggtaaatactaaatacctccatttgtgtatgatttttatgctcttttcttttgtaaaatacgacgatgccacatggtgatctagctaggtagcaagattttgtgtcagccgttattagttttcagaactcacatgagtggaaacaaacaaaaattcactggctgctaagttcagaagccctcacatgccatctgttaacgaatatcaaaactgcaaagatgtttttggatgctttatttgaccgtcacggctctcatcaatcatcatcgtcataggaccaaaaagcaattaagcaaagcagcagcactgtctctagttcagtgcacctgtgaggttcctgcactagcaagctttgagcttaatgatgatcattggccgtttttaccggctgcttttggcgatgcgcctctcttttttttccacctccttttgattcagtggtctcgaacccagctttggaccgggcggccgggtggtgactggtgagtgcaccgggcggaaatgcgcgtgcaatgttgctgtcactgatggagctagcgaaagggatggtccacgacgcagtcctcggcgtggtggtggtgatgaattggcttcacacataacgctctcatcacgcagaaaagaccaatcttgtgttagatttaattgggtaattaatccatttaaatcaattaaatcaaataaattccaaggctcattatgctaggaattcatgtgaattcattcttctatgggatatcaatgggatgaagagttttgagaattaatccatttgattcaggaattgataacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatttcgaacactggagacaaggagaaggagactcccgtcaacaccaacggaggcaatactgcctcaaactccagcggaggaacattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacatcttggtgacctgtgggcgttaaatttccagattctttgaattttgataacactgtttggggtgtctaatctttaaatcaaatcattttctaaaaaagctaaatcaaatacccagtgtggtgccaggctagctttgaagctgaatatatacagaaacacgtatatctatatgcatgctctaatcttctttcttttcccctttatgacacaagtctgaaattgattcctgccgagcattgcatgatccgtcattggtttgtagcttggcccagcaaagatgaaacaccgccgctgcccgcacgagccggtgatggatgatcagcggatgcaggccggttcatcggagatgggtcgttctgtcgaaaatgtcgggaataagttcactccgactccgggttcaatctaatccatatcttgacccctaaactataaaaaccagtgtaaaatgactctcttggtggtcttaagcgtggtttttgatgaggtggctcaataatgtaacctaatcggctgagtcagtatgtaggacccatatgtcagcatgaagattttcttttttctttccttgtcctctcgtcgttgaacaggctctccttcccgtccagtctcctcgtgtatgacagcccgagccgcgaccgcacgctgcaaaggtcgctagtgctggagtcgagccccatgaactcccccatcacggcggtgagcggtggcccgatgagcggtctgtcgagggatattgtggttgagggatattgtcgctattgtggttgagggatatgatcagattggcatatttaagggagtgaaagtaaacttattctaaaatgtcggcctagacaggagtccgagacagccggcccggcctaccaaataacacgtaagacggcagaattgggccgttggattagggggcctataggccttgcatgcagccctgcacgaagtctttcaccgcgaggcggtagaactaagaaaacggaatacacgcttccttccagtaaataaaataaaacaaaatgaaggaaaataaagaaaaaacataatagaacgtgataaccgttgaggtgtggtgtagtatatgcgctgacgtcacccccaacgtcataccgtccgcttgctcgcaaaaaaaaaatggaagtaattttcagagagagaaaaatgtagtgctacgtattaccactagtcagtcagagttgctgcagtgtaggttagcacaaaatattgcggcgtggtgagctgattaactctgataatccaatcctcttagatccagaaagcgagttcatcacgcattcacgcgacagccgacggcgccagttcgcgaaaagaaaatttttaggtgtcatgtcggatgtttactagatgttgaaaggggttttcgaacactaatgaaaatactaattttataactcacctggaaatcgcgagacgaatcttttgagactaattaatccatcattagcatatgtgggttactgtaacacttatgactaatcattgactaattaggctcaaaagattcgtctcgcgatttctcccttaactgtgtaattagtttttcttttaatctatatttaatgattcatgcatatgttaaagattcggtgtgatatttttgagggaaaaaattgggcaactattcaaacttctaacttttttcatcacatcaaaactttcctacatacagattaggaaagttttgatgtgatagaaaaattgaaagtttgaagaaaaagttgtgaactaaaccaagcatgagtatgaacatttaaaccctgtggaggaaaaaaagaccgcaccttctgcaagtctcaaccactagtatcaggattcaagatcccctatttttgaccaggaaatatcaaagccataaatgaatgggtgatacgttcattcacgctctaatcttgagcctctatctccccccaaaaaaaggtcagctctgactttaagatgcaggaagattaaatgcaatggctccgaccgtacgacggtagcagtagcagcagcagcaggacatcgacatctggtcgacacggaggaaactctggttatgcaagtgagacacgcaggaatcaatgaggatctctatcagataaatcaccctcgttgacacattggacagctagatctgcacggaaatggaaattaacacctgtaatgtccgagaaaaagagtgaattaacatcagaagaaagaacatagtcttgagtgacattgagtgctgggtgctgttgatgttcttccattcgatcaattctgtgattgatcctgtttacttgtacaatacgatgacaaaaatcactttctagaatacaatcgagcattgactagtactttgtaagaacttgtctcctgggaaaataaatcattgatcgagaggggaactttgctaagcatctttcagcatgtcatcagtttttgacagcacaacgtcagaccagctaggatacttgtgcgtacttgtgtagagaaacgctgactttgcatcttatggagtatatactactgatttctgtcccttttaactgaatcttaattagtatttcaacagctcggctcgaaatggaagccattgttcttccaaaaagaaatggaagtcattagttgtccagaaggccgagagcgacatttgattattaattagctcaaccatgattttttttacaaggaatctaatacaattatttggccaaatgaactgtatctgaatcaacagacgtaaacatttgagtatttggcagaagagaggttagctaccatttcctctactcctctttggtgcattgactatgtgacattccctgtgataccttaggtaggtatctgtatccctggttatctcataaactatactatgttccgaagaatctccaccaatcatgcattcagtgcctaatcgatcaattaccttcattctaatgaaacattcaacttcccgcacggtgtcgagcttccaacttggagatttagacagtcttggataattataaatggggagctagcgagcaacagcaaccagacaactcataaatcattttgttacattgcctaaaaataaccctctagtctatcttagaataaacaagaaagcgacaacgcattcaggaatcaagaacatgcgtacaacagaaacccctttgaagtagatgcaatgcaatccgtcatcaaagtgcaccttatcaatttataacgactaagctgcctttaaagcttgtaacatttatcttcagtctgtatagataagatttcagagccaaagcaccacagatatatcttcaggacactctcagaattcagaaagaaacaccatgagtgaggtataaaaacaggtcattctagattaatccatgcctacatgcaacgtgatccatgccactagatcattaaccaaactagattccaagcaaatgcatagctgtttctttccggcgggaatcacccagatcagcatgatccaaaagagattcaggtcaatgcgaagctgttagcccatgggattctgaatttcgtattgccgccaaattaacatgtcaaatgtcactgaaactcataaactaggggggcacacaacggtatgaaaacatgcttggctgcttgcaggaatgtatcacattacaggcatagaatagtagaaaatactttcccttgtagaaatattctccttgttttcttttcctgctcacatggcacactaatctaatcttgtcaggatgaacagctagaacagaaactgatagaagataactctggcgaatgggagtggaggacaacatcaagcggaactcagatatcgctttaatctatccaagaagcaggtagatcagatgctatcgcgttacgtctcacccgatttcttaaaacagaaacccgatttaactaaaccaaagtcagaatatccacgcgtagatgcaacaatcatgtagtgattcttcacataagcataagcaacacgaagagaaatagcagattaatcagcgaacatgcaaagcggaatttggcaacgggagatgcggcaagtggggaagtttcttactctgaatatgtttacctgcagagttcattttttttctctctcaccccaacaagtgcatattagtccatccttgctgatggcgatttaataaggaatccgataggtgacagggagataaacaaatcggacgctgaccttgctgtggcgaactgggtgatcatcgatggcgatgcgagacatcacccaactgcgtcgggtctccacaggagggagttgcttgtgcttggtccgtttggggatcgttaacttaaacacttttacggcgacctcgacacagctaaaccctaaactaattgcgagttagaggcttatctcgatctcttctatgcagatgtttgacaacttgggagtagtttactgctggtttggagtatcttctcaacttgcaatttgattatgtttaaacggggagtgcatgattggtgttcgcatggttttaaatcagattttataaactgatgctcgtcaagagacgacaaggggccagattagggcagcagagtacgtgcttgcttgaattctgaagcatgtacgaaataaatacgatagaaatttcttaagaaattatgtatttttctgaacctccaataagatcgcgtggttgccagtattgcacgtcgactactacatatctgaattcagaacaatccagaagagatgttactgttgatatttctacgtataaaaaaaacatcaaaatgctttgtatattacgaaaacagagcgagttcccttattgaccagagcaaaaaggttgagcctgattaaacaaagtctatgagcttgcaggatgcgtctcttcccaaatttattcacaccaaagtcctcttcgatgacatcgccctatttgaatcttatcgttgacattgctcattttgctctttagttaatctgggcaaatgattggcggtggtacttcgtgatgtggaacagtgaaactgtttgtcaatctgtgcgctcgaggtacaaccaggtcggttcctttgctgttttattaataaaaggagcataaattagcgccaaaactcaagttttaccacaaaaaaacagtcagttttaataaagattaagcaaacccttgaattgcactctgtaaaatgtttgtttcccctcaaaagctgataaggacggacgccgatgtgaaacgaaacctgctatttcaaccatgtacatatataatcaagaatttcctacacgacttccattttttgtgtgttgactagtttctctccttcctggaggtgttaaaagagttccgattctgtcaaaacttccatacagataaatccaacctgtcaaactaccagctgtttaattattccttttcccattttgttatggtacacaaaggcacataaccatttacacggagcagaacagaataggatatgtattaaaaaaacagaatggagaaaaatcctgagtcacaagcacgaaaaatgaaggcgagattaattcgaaaccatacacatcatcatccacatctcgtcgtttgtctcacaggacatgacacagggagcgaaaaccacatcattaatcgcggcctacagctacacatccagattctcccgggatccccgaaacggctcccaccccgcaaccgccgcaagccgacccagccaaaggagatccccctccaccacggaagattcactgcgcggtgggccccgccgccaaaaaccaaaacgacgaaaccattccgcgtcatctctcccgcacggcgagcgagcgagcgagcgacctgacctcctcctcctataaatccggcgccagcgtttctccccaacctcccacgcccaatcctgccgccgtttcagcagctctagtttgaacgagggatcgtagagaggagggtttggtgagggagggaggaagatggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgccttcgccttcggcacgccgtccaacggcttcatcgggaagcagttcttcggcctcaagcacatgccgcagaccgggttcgactacgacttcttcctcttccagtggg

SEQ ID NO: 64259 - DNA, 4380 bp, Oryza sativa
cctctgcctcccgcacgtccggacctctgctgttcggctccggtgtcatcgacttcgccggctccggcgtcgtccacatggtcggcggtgtcgccgggctctggggcgcgctcatcgagggcccccgcatcgggaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtaaccaatccagaacgaacgacgtcacagcgaaggaagaaatcacgggtttctctccctctccgatctcgatcgtcacgtcataaatttgatccccatatttgattgccagtttctgtttgggccaaatgcttttgccgctctctctggtgttgcaagactgtaaaaacactgtaggatggacgagtgtctttcacttttgctgggcttctcttgtgtacaggcatgcgtacgtgtcttagaatgtgtggtgtgaaggtgggaagaatcagaggttagggtttaattttcttttgcacaatggttactgctattattgttttattttgtggtcgaattttatcgtcataagggtgtggtggaatggtggtcaagataggtggctgtgcagggctcaaagactttgcgtgggtccttttgtcctgcagtgctctacctctctatcaaaactttggcttatttcctggaatctagtggtttgagagtgtttgttttatactcagttctgcattatgtttacgatatatatttttttttaccaaaagcatttcatttaaactctaccgagagtacttgtttatgctgaatcagtacatctacactgagtgatatttagagccttatactaattgaagattaaatagtcaaagtccatgtgcacatttctactcgccagttagtctgaaagaaaagattcctgtgtgcaattgtgcatatcagcatatgccacctggcgataaagtaaacatactatagttgtgaactgtgcgatgacaacgaccaaattaagcagcctgatctttacaacgaccgctgtatagagaacagactatatcaagttttggtccgctgttcttcttttgggattgtgaagcatgaaaatactacagttttgcatttctttttcccgtaaatgtggaatgcatctcgatatgatatggctattttagcaattgatctgtctcctttttttttcccaaaatacaattgatctctcatctgtcgcacacagccacgatatggtatagagttaattttggcatttttggcaatatagcacattactattatccccttaaatattgtgatatctgtttttcaatatatctgctcgttgcactgattagtccgcaaaatgaggtctgcaaattgctcggtacagcttttgactatatatattaggataaacggatgctttctcgtcttgtagttctgaattgcaatatgttttcctctttttttaatcgacgacaatatattatccattcaatcatggtctgtagtaccttcctgcagtacactccctacctgtaaatttcaaacatgtatgcaccacagtacatactcctacatctctctttcaccaatgctgccaaataagacgctaggagattgaaagagattggatagcacaacatgcgcttgcctcacctctctcaccagtcaccactcacgacaatacaggttgatacgcacggctagcactgatccgcaaacaccccgcataattaattagcaaagtagccaatatcatcaggtgagtacgttactaatctgactgcttgaatctgtgacaaagaagaaacgactggttgggggggagagaacatagatcgagacctatagctatcatatcccaccgtaagattcccacactgcgcggctgccgatcaaaaggctgtggaaaaaactaggaataattgaactttcgcagcactgaacgtcaaaaaaactttcgcagcagaagatataaaatgagtgtaccgtatcgttttcacgacagaaagccgatactagtcctctatattttactcctgttatgtatgcccacgatcgaagttccggttaatctctccaagctaatcagtatacggtcttatcaattgcaaattgagatttttttttacgtgaagaaaactaccttagatactccctttacctaagcgcgcacgggtacggaaaaggacacgcgcgcacttccctcgtagaaggagcaggaggatgagcgcggccgcaaagctgggcgcgcaccctttgtgatgtcaccgcctcacgagacgggcccgaggaaatcggaactcgaaaggcacgccacactcgagcgcaccggcgcgccaccgctcgcatcgcgcggacggggggaagcccggaggcggacccgcgcgcgcactcagctcggcggtgaccgagccgcgcccccgctcgcgtctcagtcctcgcctttttttttttcctttcctgacgtctcagaatcaggagacccgagcgggcgcgcgcgcgccgcaccacacgtccacacggctcggatcagcagctagcagcagcagcagcgcgcgctcccctgcgaaacgggggtagtctcgcggtctcggtggatcacgaggatcccgtcgtcaaaccgtcgtctgccgcccgatcgactgcccgcagccaaaggcaacgacacggccgacggcacgcgacgtgagcaaagtacatatactagagtatactagtcggggtgctgcgtgagcgtgatgcgcacatcgatgtgattggtgtgcagccgcgcggagtcgatcgcatacttgcatgcatgcatgtacacgatcattgtttagcgagaagataatgccgcgtatgattttcggagagataataatgtctcgtgatacaggcgtacagcgctctgaggttgtccctacctctcgtcgcgtcagctagcgggggagcaggatcctcccatccatgtaggtacagttgggctgggaagttgtttaatccatcaccaagatctgcccgtacaaaaaacgtttgaaactcgggttaagataatggatgatcgagcatcgaaaagttcccctttttgagcgggcgggagcgacagcttttacgccccgaaagattagtacacgtaatttaatggctacggtggtttctccgttttttaacaaattggtccttttcaaaaacttatttcaaaactaatccttacaaaaaaaaactttaaccaaaaatagaactcagagccatggaccttagcgctaagctcgaatccgaggtggtaggaatttgctaagttgtttggtactgaggttctaatgatttaaattactgcggaggcatttagtttaacaacccaccgatagtatagtggtagtgggcttctactctaaccttatggagcagggttcgatccctcatctctcccattttttttcttttcttctttttcttctctctctctctctctttattttttctttttttttcttcttccgatcccccatctctcccttttttttttctttttcttcttttttcttctctctctcgctctttattttttttctttttttcttttttgtttgtctcgtgatactatcttcaaaagatatgtttaagttgcaatttttttgaattaggaa

SEQ ID NO: 64260 - DNA, 2574 bp, Oryza sativa
ggggggggggaggaggcgacggcggaactgatcatgatcaagcagctgcatgcgaattgctcctcgcctctgatagtgtgatcgcctatctgatttactagtatataaattagtagaaccaggttttcgattggaaaggtgctgtcaaaagtcaataaccacctaatctaatgcaacctggatattactccatgcttatataatgctcggctgattgattcctgcaattgctagtagctagatcagtagtatcttggtgagttggtatagttttttttttttcaacgctctcaagtctgaagatcccaggcactttctttattgcaattttccatttttaaaaactcgggtgtcgtttttgctcaacagttgacacggatatatcgattgggagatatttgtcagaatttcaagctgctgaaagcaatgacatgctttcgttgtgcgttttgaagcagtcttagcttccttgctacaagcacttctgacatgaaaaggattggtacctggtacatgcaactgcgagtgaacattgagcacaactagtactagccactagccagcgctcccctgacctttatccccaaggcccaaactacttgtcaagtcgccaacccgccgaagtacaatctaacaacagtggtagagcatggcataaatgactgagataagatgcagtccaatctacatggataggataagattgctgaaaatctctctaaaattccaattccctgttcttccgaacccctacgtacagacattctgcgccgcgccattgacaacttgatcaaatcacaaggaaagtgtgatggtccaacataaacggatcaattgcatgcagcatgctggaggcaccagctttggttcaatggaccgcattagatattcccagaagcatcacccatatattatctgttcaggttattagctgcagatgggaattgttatacagtagtgaactgaaaacagatgccccggaataatatggaacgatatgatttcttattctgtactgtccaattgtagccaaaagtaatggacaagggtcaaagatgtttggagcatgagcaaaaggtcatgcgggcatgcatgagcaaccaagataaggtcccaaggaacctcttacaggtttgaacaggaaggacttggtgagaaacttttggcagttttgggtccattttgaactacactactgggcaacaaacacaacatgggccactacgggataagccgaggcgagctgcctgcagttgccaacactacaggaatctgcacggcccattggtgaaaaggcctgtgtggagtggactctggcccgttagctgtggccgcaggctaacagccgactagttgaaacttgaaagtttgacgctgtacatgcttaactctgagtctctgagtattcaacaaatatactatcggcctatcggggtgaagaaactcacaagtcacacccagcatgtccgcatgttgcatgtatttactcgctagaaaataacagcagatgatagatcgatcaccaagtcttgcacagatagcgcacttacaatttttcctacagaaaaatagcagccaagtgcggcatagtacataggagcaccaagctagcaaaacaaaatcaggatgtacgtggcattacagcggcatcaggcgttgattgctggcgaaacaaatggagaacatccatgtccgaagatcagagctgagagagaccactgtggaatcgcatccatgaacagaaccacaccggatcagctaacgcgttgaagagactttcgtcgtcagggatgctcgccgtcgtcctcgaggagctcttcgactgactcgatgatgaggccgaagcaagcggcaaagccggcctcctctagcacgtcataatcatcatcatcatcgcaggccacctcttcgacgtcaatgacggctttgctgccgagccgggccgccgcctcatcctggaggaccttgactctggcgcagaagctggcaatgtcgtcggcaacgacgacgtcctcctccgtctcgacgcggaagccgtgctcatcgcagatcaggaacccggcctcctccgtcgacgcgaaggggaagacggggtcgtacgcgaatccctccggagtcatggaccagaacctggctggctcgtacagggatcccgggtacagcggcgtccacacggctggttcgagcaggccgagcgcctccaccgtcgacgacgtcgccatctccgccgtcgtcctcttcccggctctcaattcgttcgtctcgtgcgcgatagagagagtgtgtgcgtcacgatccgggcacgaggcgcagggctttgctttgacaggttgacgtacgtgctgcgggagcatggcttatatggagccatgttacgacttggagtcggagacggattgcggctgcacgagcggaggctgggggcgtcacgcctgtacgtacgggcaaaaccaaaacggagtcgagtggaagacgagatgggggaggtagaaaatgccaccgcctcgaccacaaaccatagcagatgatcaccgggttagaaaatcgacttggaataattgcggtattttgtta

SEQ ID NO: 64261 - DNA, 20352 bp, Oryza sativa
acgtggcggtgaccataattcatgcatgtgggtcaatctgaactgaatggagaataatccataatgcaaccatcgttctcaaacagatccatacacagaaatttatgatgctagagtaacaaaaagaacaagatgaaaggaaggacgaagctgcttgagcagattaatgattgctggagacatacttcgctgtgccgccaccctcgaggtccagtcgatgttgctgccatagccttcaagatattcacaactatttgatcgtcgaatttgaacttcatttttcgtggacagatagatatatatcacaatactcaacattttcaaattttttcttcataattttcacagctatttgtgtattgaatttggaagaaaaaagatacacgaggggacattccctcaaggtattagaatccactcccccaaatcatatggtttgcaagatgttgcatttagcacccaacacaagtttatacaccgtaggttcaatttgcccaaaacaatatatctgtagctatattaatggattggctgattcgagaataattgcaggttaataagagaagcaatatctagcatcataaatgttgtcttggatcataaaaaagaacagaaatttatgatgctagagtaacaaaaagaacaagatgcataggcggtgaaagtgcatataatgttttctcatcaatgtgcccctaatgttgtcttggatgcatggttaatggcaaacgtttaaattgtcttggatgttttcattgacatactgaaatactactgaatatagaaaatagttcacattggtgtcaaagcaacgttggagattccggtttcataaaagagatcgaattgaatggatactcgtctggtaaaaatttttttatgagtattggaatatcgtactatcaaaatgttgtttattcgggatttaggctcccgtggagactatgcaaacactgagtcacaaagcttcaatattatcaactccacatccacatttccaccgtgacacaccaaggtgtttacccatcatttttggattttgaaataatatattgaagtgcgacttgtagtttgtaatttcgaacatggaaaatgttctaaactccaaactaaatacataatttgctgcgcggatctatatacagcaaataaataatttaagcaaatgcctacaaatagcatgtgaaaatggtacaagaattgtcaagatcaaatctatcagctcaacttcttgatgatgtgacatgcatgtgcttctttatggcagtgattacagagcacttgatgattttctatttatcaattccattttctgaattatttaatcaataaaaaaactgaaaaatcaagggaaaaaaggggcattgggcaacaaacaggccgaaccgttggcatgccgctgccaacagtacagttgtacacttgctctgatgttcaacggcccacgagtggtaggcactaaaaggcccatgtggagtggaatctggcccggtggttgcgcttgtggctgcagattaggaataagttcactttaggtccctctatttgtcgcccaatccgatttccgtccctcgaccgcaaaaccgggtacaacctgtcccccaactttcgaaaaccgggcacaagatccctcggcggttttgaaggtggttttggctgacgtgacgtctacgtggcttgtttgactagttctccgtcccacgtggcattgatgtggcgctgatgtggcaattatatcttcaaaaaataataaaaatcgtgggcccacaatttaaccatagaaaaaataatttaaaaatgatgggtctcacatgtcagctaaaaaaataaatatggtagggcccacatgggccccacatgtcattcccaaatgaccaaatcctatcctcttcttcctcctctctctggctctccccatctctctgctccctcctctcgccgggcggcgtccagcacgacgggcggcgcggcggcggtaggcggcgcgggcgacggacagcgcatggccggcggcgggcgatggcgcgcgtggcggcgcgcgaggcgcgtggggcaggggcggccatctctctcttgcgcaacagatggattaagttgtgaccacgatcgatcgcttcaaaccaagttgagttcacagcaacgagattcacatactgcaatgcagaaacgcaaacagaacaggcaattcagatggccaaatgcgacagaatggaagagttaaccacaatccagagctagaggattcaaacagcagcaccagaacggcttcactgggttatgttgcgatcgcctaataaccaaactgaaatcacagcagcaaggttcaaatcaccgcaatgcaaacacagacaagcaattcatgagacaattctccactgcttcatcacagatgctcaaatccaaccgaggaactccaagttagttcaaagttcaaaccaattcccttcctccaatccaccgaacttccagaaacacacgcgtacattgaaaccacactcgattaagaacaaggcacgcagaatccgaaccaatttcaaaagttcaagagctccggagtttactcaaattcgccatctcgaactcgaagccacgcacgcacatggagcagagcgaatcacttaccagtggaagggagggcgacggcgagcgaggaaggaggcgcgcggaagcctgcacgcccggagcggcgcctcgcacggaccgcacacggatggctgacgcacaggagcggcgccggcgggagaggagggagtgacgcccgcgcgctcgccggtaggccagggagctcgcctagccgtccgccgcccttctagctcgccggcgggagaggagggagctcggcacggctctagctccttcgttcctcttcccctttcccatacgcgcgtgcccgggagggagtgaggcgagtacgagccgccgccgccgctgctgccgctgtcgcggcggacagggagaagaagctgagggcggaggccgggtcgggggaggaggcgagggcacggagcgtggtgttgagcatgaaggaattgggggcgcaggggagggaggcgaggaggcggagcatggcgtcgggaggggagagcgcggcatagacggcttgtggagcggcggcggaaggatgacgagcgcggtgtagaggcgcttggcaatgccgtaccggcgcgcgcggagggcgtccgggtggtcggcggcggcgacatggatggcgacgtcgatggcgtcttccagggcgccgccgcgctgctcgccttcacgcggagcggcggcgccgaccacgcccgccgccgccgccggagctcgcctgctccgccgcccacccgcgccgtcctctgcctgagaaagagaaagagagagggaaagggaagaagagagagaagggagagggaagaagagaggagtgagactgacatgtggggcccacatggcccacactattttaaaattattttttttgcagccacgttttttattatttttctgagatataattgtcacgtaaacgccacgtcaatgccacgtgggacggagacctagtcaaacaagccacgtatgcgccacgtcagccaaaaccgctgagggaccacgtttgcccggttttcgtaagttgggggacggatcatacccggttttgcagtcaaggacgaaaatcggactggataaaaaataaagagacccaaagtgaacttattcctgcagattatgagcaattctccgttcaaaaaaaaaaaagagagagattatgagcaattctgcaattgagcacgtgggcgtactctcgactcgagcatcgattgtgtgaagaaagaaaccagttaaccagcacgtaattcctcagaaaagaaagcaactgatgatatctcaatcaccaagttttgcatactgcaaaggttaagtgagatagttattccattacatagatagatttgcaacacaacgtactacaaatccaagtgatctgcagcttacatcaatcaagagttaactaatctgagcagaacatcctagattagatactggcgcgaacacaatcttgtgatctgccgcaggagctacaaaattgtcttaaatcctaagagcatctttcccatctttaagggagtaccatgaggtactatgaagtacgagggaccataaggtaacaatctaatctaaccgttgatttagaaggggtatgatcggactaaataaagttaaggcgccgcaaatcaccgcccactcaaccaatagcgataccctgttcccgtctcctaccttctacctcatctccggccgccgtcgcatcatggccgccgcggccacgcgtcacacaagcttcagcctccgtcgcatcgaggccgccgcggctgtgcgtcgcacacgcgtctgccgccgtcgtatcgaggccgccgcggccgccgtcgcatcgaggccgccgagcagccgtcgcatcaaccccgccacggccgccgtggcttcaacgccgccgcatagacgtcgccgcctccacccgctgcatccgccgtcgcaggcgcatcaacatcgccgcctccaccccgtcccatccgccgtcgtagccaccccgaagactccggcatcttttccaccatctggtgtggactctgtcgtaataagaactaaatttgaaatgtgcttcatctggatttgttatttgttggtacattttatggttgaagaagttatgaaggtggtaaattatttggcaggttcactgtgccgtgtacagtggaaggtgttggtagcagaacaaatatgctgtatgatgttgttgtttgtctaagtttgagctgaatttacattgtatgccgtgtgcataagttgtttcaaccattgttgtttgtatcttgtacaactttcataaagtaagtacttgaatcttgttggtctaagtttgatctctgttcaagaagcagcagtgccagcaattttcagttttcagcatcaaaaagcagtaccaagcagcaaatttaaatttgtagcaataattccagcaagaggagcaataaattcaggcaaactgcaattgtgacacagtcaattcagcagcatatatgtgtatttcatctcagcaacaccaacttcagttccgcagatagcatccactagtaacaaataatcagtaagcatgcaccagtaataaatctcgcaagaagcatccatacaaaatgcacacaaacaggggcatcaattatgcaaaccataccactagaattgactgatagacatattacatcggaacacatattacatcggaacttcagtgaacagaaacacacaaacatcagcttgctcgaaaagattggctccaaccaaagcattccatccagttgtgaaggttgctcgcttatccttgaatttcatcagtttcatccgcatccaaccatcgccggcctcccgccgatgcagcgccgccgtcgcatcgaggccgttgccctccgaccctgacgaatcgccaccgccaccgatgcagcacagccgtcgcatccagacagccatgcccgccatcgccgacgaatcgccgccgccgccaatgcagcgcagccgtcgcatccagactgccgcgcccgccgccgttgacgattcgccggggctacccgatctaggccaccatcgggtcgccagtccaacctactcccgccgccatctatcgccgccatgcattctagggtttctttctctcgctgctctagcccgtcgaatacgcggcttctgttctctcgccaaacagagaagtaaacagagaaggaagggatgctgcgtgcgtgatgcggaatagacgcgaaagtacataactaccctcccacccacggtaccacttcaaggcagaggtgtggtaccatgaggtacagatgatttttgaccgtccgatgagacctgatcaacggtcacgatttggtactgcacagcctcaaggacagtaaaaatgctcaaatcctaatgacggcttcagtgtttcgccacgtcgtcttcgtcctctaacatcagtacatcaacccgactagctcgatctccataagactgcactgcacgtgaagcttatagagcacagcaactatgcggcgtccatgaaccgggcctagctcgagctcgtctcgtcgtcgtcctcaaggagctcttcggctaagccgatgatgtggctgaagccttcctctgtcaacgcgtcgtcctcatcgctgcccacctcctcttcggtctcgacgacgtcgtcaccgctgtggcgagacgcgagcgcgcgcgcggccgcctcctctccctggagggcgttcactctggcgcagaagctggcgacgtcctcctccgcctcgacggcagggccggccctgacgggggacgagcagtgcggccgctccgggcccccgtatcgtaggggccccaccccacccccaggccaccccctgccgtggttggcccaacaggccatgcagacgatgagacgctgaggcggaacagaagacgcgagggtttccgattgacgcgcgttagccgccgcccacgtcctcacgctcacgcaaaatcacatcgcgcattcatcccgcagccacagccgcagaccgcatcggcgccgcgttgtcgtccgtcgcccacgccgacgcatcagccatccacggcgggcttcctcttccgcgcgaggcgctgaggcacagccatcaggtgagcagcagcaacacgccaacaccattggtccattgccaatttgccatcgccttatgaaaaattgaaagattgtaactgattctatatgtaatctgttggctgttgccatgtaagtatgtactgatgttcagtagccgtgcattttgctgtcctgtgcaaggtaaattcagttggaccgattgttggatacttggacgaaccgaggaaggcataaaactgcacctagtgtgtatatattttcgatttactagtaaaatgcccgtgcttcgctacgggtaaaaagaacgtttaaatgtaataaatatttcaagaacggatataaaacactgtcccattttgatatactcatattgtcataacgcgctctctatcaactctcacatggcaagcgcatgatattatttacaaaattgagatggtgcttggactgtaatatatcgtgttttgcggatgacggaaagaaaataattacttacttaaaattattgatttttgaattatccgttattgttcgtatattgtctgcattatgcaccacacacaatatccgtggatccacatagttgcctcgtgttgcaatagataaaaactaaattaaatttgtgttgacgtaaaaattaaactatatatcataattatgaaagctaatggcatagccaaattatgaaaatcagtgttattattttttcaatgggagtattgttttccatttataaatcacattgtcaaatatcgaaaaaaataagaagcagattagacgtagagaaaaaaaacagaaattaaaactatggaagcagagtgacagggaagggataagaaagcagcagcagagcagtctcggacctctcggttcttccattctcaatttatctctatacacgatactctgttcttatcctcccatctcactctcttagacactggcagggacatgtaaaaaaaccgctccccatcactttccccacttctcctcctgctcagctgctctcgatgaatccgccgtcttcctttttctgctctttcctcttggttttctctcctctcatctgctgctctccctcctcgaccacccaccgacggcgccactccctctccgccgctccccctccttgtccctccaccgagcccaccggcgatggatccaactcccccgaactcgctggcgatggatcggccttctctgagcttgccgacgacagatccacctcccctgagctcggtccagccgtcgtcggcgttgggtggcgaatcagtcgacgccgatagcagatcgagctccccaacggtggattgagctgccacaacgatgcagttcggtgccgagcggattggggcggctttggcctttaggcggagggagtggtcgaagacggggggaggctgagcgagtcgtggatgccggatccggtgggtttttcttgtctcgtgatgtcctccatgatcactatttggtctgattggtgtttgttttgttggatttctcaggatctggtacagtggacgaatgtccggctcgacgtcccgttggtgcttcttctggtcgtccagtcggctctcaaggcctggctgcggcccgccgagtttgagagctcgcctgccccgtgcctgccagtgactgatgtccttgattcgccgtcagttccagccactgacgcctatggtaattttcatttttaagataatatatcatgttattcatgtgaaatcttgggatcatcttgcattggagcaattctgtttttgaaatgggggaattgcggaacaccagtgtatttccatgctgattaatttggaacatagcatagtgaacagggtgacaggtggttatcttgatcttaaactgtctccaactcttcattgaatgtttctcagatgaattgattcatttaattcattaaagccacaggcatatgctgaccactgcatttcttgtacaatgttgaacaggtacatggagttggctcactgagttgatgaagctttgtggttcatggcagctgatggactcactatggatcaccctattatgacaacagaattctggacatcacatgagtgccttcttcttccctatgagcaagcattacctgaaaacattagagtgaaactccctcacctcatacgtgctgttcatgttgctgtccagatagtaacatgggttaccgacccgatgcatggtaacacaatgaaggctccttgtggcctcaagactcgctcctttgctacttttcagtatttgcttgttcctattacttctcagtagtatgtaactgaataattgtcttatttttgctggacaacctaattgcatatgcactatgctgctatgcagagagaagctgtttatagggtgtttgatggttgattgcggcgtacaatgtctgacaggtacgcggaagtttccgatgcttaatttgaattgttgatattgcaaattaaatcagtaaatctcattctaagtcttttaactcctgttattcattttttattccccgcacaacatacacacacgcacaagttatatctcaccttccagtatatatgttttttaagattgcttttgtattctagtagtttttatactgcataagagtagttttttttttaaaaaaaaacagaacagttagttaatttgatttcattggtttgtagctctacgacttatggaatactgagatgaatataaacctaggtggtacctgtggattgtaatttaaactctacacacatgggtaatcttatatgtcttttcgatgaattaaaaagcttcacaattaagaaaacataatgtatttaaataataaaacaataacgcgaggatctctgcgtgcacaataagtttaggccattaagaatagaatgactgatctacatgatatataatagatttcaaggttctatcacaaagcagaattccatcaagtttatagtgacaaaacactaacttttgaaacattaacaaagttcaggagatcaaaactcaaccaaaaatagcaaaattagaagagacctttaggtgttctatctaaaagaatagcatgcaaagtatatttatctagcaagatattgattaggagattatgtactggtaaaaacaaataattagtttacattatgttaaataattagtttacttgcttgattctcaagtaatttatctctctgaccagaaggtctgcatgatgtgtctgttctagctagaaggccatattggtgtatgagaatctgtcaaatccctatggaatagcgggaactctccttcatgtccaagtctcgcagtcctatcttccgaagccggtaagcattctgcttccattcctacttttccaggcagctttcctagagcctattccttacgtaaaaaatgacctctcgtggtcctactctgtctattcgtttaagccagctgtgcttttcattttcttttatctttccgcgagggcctctgctttcctttctatccctttatttctgggggcattctaaggttttcatgatgatctactctgtggtgctcaattatattactgattgatgtcttacgtttttacagctgtttttgttcgttttattgagctgcaggagattagatcacttcattattttgacactaatatgatattccaacattgaatggtatcttattgtgctaatcattttcctatgttgattcctgtagaagtttattttcaatggcggacatgaactttgggagtggagaagcatatggtaggtgttttgcgctgccgccagttggaaatatgtaagttttacggtctctcaacctcaactccttcctgcttgtttgtgttgcatgatgtttcatggtctgcattgttcagtggatgtggtcatatggatagtcaacctctaaatgatactactactcgtactgaagtaagtacttctagcttgtgtggacactaagatctatactattatgtgggtgtggatgttcaaccactaaatgatacttatcatactgatttgtgcaaacattgataatacctctaaactgcacttagttagctgtgattttgagtgccaccacgcaatcatggaagcaatctcagaacaacttgatatggatgcatgatgcatatgtattgagtattttgcatgccactgtttgtctttatttcatattagaattgcatatagtgtagtagttgttcttgctcctactacatttgacctggcagagttgatgcaaagttggatcattctaaaaaaaattaatctggttctaaccttttcatttgtgtgtatgttaagagtgaaaaataattgctgctaatgcttgctatatgtaattgattttgtctgaatttactcaataatttaggtaaaaggtgggaaagtagtgagcaggaagtagaagaataatttacaaattccagtctatgagagcagacgaataattaaatatctagattcaattgtgattgttccaaaagttatgccaaaaaataaatacaattcttaatatgtgcatcattaagggctaaagaattacctgcgtccatcataaacgtagatttagtatcacgttgaaccagaaattgctcactttgaaaaaaataacaaatttgggggcatatattagtgccgagtgagagattgctcagtatccacaccaaattttgggtgcatatgagtcttatttgtgatatgtgatttcagttttttgtataggttgataagatgtttgtattctacttggacatgtaatttcaatagttggattctgtatgtaattcggtatgtaatttctatcattggactgtatgcaatttttgggccatctaattgttcccgactctatttggcctttgtaatttctgagtcatgtatttgtatcctactaaatttgtgcttcaacccaatcggatggaaaaaaagaaaaccacggtaaaaaaaaaccggacagccgaaaaaaaacagggtagaaaaccgcaaaaaaaaccggatagaaaaaatcaacgaaaaaatggaccaggaaaaccgtgaaaaaaccagacggcccagaaaaaccggacagaaaaaacgacgaaaaaaaccgggttagaaaaccacgaaaaaaccggatggcaaaaaaaccgcgtgtgcgttcaggaaaccgccgacggacgaaaaaacctcacgaaagccttacgaatttttttattaggtatagacttgtggtgcacactcaaacgcttgcaaattacgatcaactaattggtaagattttaaatttagatttataatttttagtgtagttcctttttttttcaattattaggccatgtcattgataaagtatgcatcgggtagcgagaaaaatacatttttaaggtaataaatagaatttttttatatcaatattatttatgaatgcaatttaattaaacttttacggcaataactcatatatctactactactactactattatgttaagggcctctatgtttagattcgcaccggggccctgaaaactcgggaccggcccgacgcggaatccgcgctcgtcgtagtggaggaggagcccgccgacggcgccgtcctttgtctcgaagcggaagacggggtcgtacacgaatccctccttcgtgatcatggaccggaacctagccggatcgtacaggaaccccgggtacagtggcgtccacactgccgccgccgtcgacgccatctccgtcgtcccggctggctcaaatccgctcgtcgcgtgtcgtcgtcatgggcgggtgaaaccggcaaggcgggagtgcttgcttttgacacaattttgacttttgacgtgcaaggagctttggttgacaggatgacgagcaacgggggcggcgctggctttatggcctgagagacagaatgcgagtcggagacacgatgaatgcacacgcggcttggaatcggagacggagtgctgggcgccaatctgcgaagatcgagtaaccatgacacaattttcaacacacagtcaagtccgtatttcagtcagatgcttggtttggtcaaggttaatcgaaatatctctttgatacaaaggggtggattaggaagagatgaatagagggggacttatctccttgctccttcattccctctactcttcctcttctccctcttcatccccctcccatctcttcttctctcaacggtgatttcacatgactcaaaattttggcttcgcgcgcgctagtaatggtagatactttcattattaataacctattcagatcggtgtcattttaaattatatcctttttagtaaaattgataaatatatgaatacatttagtttgctaccaaatattaatactaatgttcagtgaattttagtaataacacatttatgagtctgtcatagatgttagcaattttccaaaaatttagtactcctattgctaaattttagaaaggtttattttaatactaatatgaacataatactaacctatcaaaataaaagttttttttcgaggaatcaaaataaaagttgaaccaacgtagtacactactggcctgctgggcagatgcccggtagtatttggttaaaaaaagttgaaccaacgtcgtcatataaaatttaactcaaatcgaatagcttccacttcaaaccttaaacacgcattaatggtttcaaaatctgtagtactacagtaatatatctacagcaaataatcatttatgatcaatactcgacagctcatctgtacacaaagcaggagtaattactaattagggaccgagaagtcgaaggaggtggatacctgagggggctctccgcaaaaaaactcacctactcgacccaacccgtcccaaccaaatccgtccattttagatccgacggctcgcagtggagatcgtaacccaagagaatataataaaaaaaagaagcgcatagccatcgcacggcggaaggactagaggagaggatactttcgccgaaacgggcccacactaccgtctcttcccccccctcccttcccttcccttccctcccctttctctctccttcccgatctctctctctctctctctcctcgagctctcgccgcacgctcccaaaagcggcgccgcgccgagctcgagctcgagctcgcggcgggcgacgagctccggcgagcgcgcgcgcgcacgctgaccagcgggggtttccccgtccgagctcgcgcgggcgtcgtctcgtcgggcccccttttcacctttctatcggtcattgaggggtgttctctctccccccaggccaccgcttcgcctggccgctcgggcgctcgccgcggattttcctggcccgccgagtggcgggatcgcggccaaccggtaatgtgggctctgatccctacgttctgctgtgaattaggactgattgtgctggctatggtgctgatttgtgtcgtgtttggttcggtttgctcggggttgtgcagcggaatggcgcagagcaactgggaagcggataagatgtaggcgatttctctgtcttttggtgcctggtttctgcggattttttgttgttgtgttaggattaatttccggtgcttgtcgtgcaggcttgatgtgtatatctatgactatttgctgaagcggaatttgcaggcgacggccaagtcgttcatggcggaggggaaggtctccgccgatccagttggtattcatctccgctgcttctgtagccgcctccttttggggttcccctttggtttttgccttgctagcttttgatagcaaatggagtttgtgaccacaggaaaattctggattttaagtagaggggcaggtttccatttttattttatttttttgagatggcaggtttcgagcattagtaggaacgaaaatttgggtttcgatctggaatgggagtcttgtgccatgaaatttgaaatcttcacacaggggttgtttctgatcaaatcagaacagaaaatttggaacgtggaagtatttgggagactttttcttccttcaaaatttaagaagaggtgctcacggttagagcttcgagctaatgcagggtatagctttcgatgtttgggggaaaagtaacttggagaatggagacgcttggtgttcggttcacttgggtgtctagctttcgtggttttcattcagctagtcatgtgctacttccattttttaatatatgacgcatttaacttttgtgattcgtttggctattcatcttttctagaaatatctgtgcatataggcaaacatacaatgcatgatagttgtgtacatccactttggatgtagaggcctggttttttattttctttcttaaaaaaacatacaacgcacgcttaagtacttttgatggcagatctagtggtactcttttcactttaactaagtaactgaataaatattgtaggtaaaatttgaaggaaataatgaatcatgttatatattaaaaatggaggtagtaaataatagtttcaacaactatcttattgagtggatggcgggattgggcggcttgctttggacattcatgcatgcttgtagacaacattggattttgatggtggagtacagatgtattaaaagcagaaaccgcatagatctttttagttgtggctcttttcatatatctatcataatgtaattgacatatatagccagaaatgatctattaatggtatttagctaacttagctattgttcagccatttctttcagcactcgatgaactgaattatgtcaaattgtcagctgtgttcaaataagaatagatgcatacatttagaaaagttgtaaagggttttgagttttggtagtaaaactccagatgtatagtagaacaggatgcttaactttctagaaactactgttttgttctgtgacatgagaaataataattgatacagagtacattatattttgtggccctaaggagccctaacatggataggaatacatgtgcatagtgggaccagaactacagaacaaagtaatactaatacaatttgcatatttctcacacatgtagtaggtagttctagactactagtactatacagtcaacaactgatacagtgccaaactagggagctgaactaaacttagaaaataaagagaaaaactttgcttttgcccttttagttccaaatacacgtctcgctaagaccaggcctgttagaaaagggctagcttcatctttcacgcattactcaaaatgataattcattaatttgtcacctttgaaccctccatgatgtttgaccctagttgcttttcccagcttaaatggttcagttctgtcacataaaaaacagcatgcgatttacaaaaatctttaaatcctcatgaaacgtaccatcacctttaattccaaataaacttctcacttactaaaattggcatgtgagaaaagggttaggtagtatgtttttgttttgctaggttcttcagatgtgataactaccacatctgaaccttccaattcaactttggcatgtggatatcttcaaagatgccaaaaaccctaggtgatgataatatatttaatgcaaaacacctagaactaataattcaatatagatttgtgtcactccaagaacttatgcatgctgtttacctgtgacccatttactacattagtttcaattcataggagattcattcaagcatcataattgtaaattcttgtattgcagcaattgatgctcctggagggtttctctttgagtggtggtctgttttttgggatatatttattgcaagaactaacgagaagcattctgagatcgcagcagcatacctagaggtacctttggaattgtaaatttttaatcaccatgcatgtcttttttagcttgtccaatgtaaatttccttttggaaatataggcacagcaaacaaaagcaagagagcatcaacagcagatgcaaatgcaacagttgcagctaatacaacaaagacatgctcaactgcagcgaactaatgccactcatccttcacttaatggtccaataagtggcctaaactctgatggcattctgggaccatctacggctagtgttttagctgccaagatgtatgaagagcgcttaaagcactctcatcccatggactctgatgggtcacagcttcttgatgctagtaggttggctcttctcaagtcggcgtcaacaaatcactcagggtaatcctccatgtcatttttttctgatatgtgaaagcaaaattgaagaaattgaatttgatgtgctatcagcattctcactatttgtatattttatggaaataggcaatcagtacctgggactcctggaagtgtgtctacgacgcttcaacaaatccaagctcggaatcagcaaaatattgtgggtttattggttaatttatgctgtgtattttaagttcactactttgtccattagtccattaaatgtatacaatgatgacccaaatatcatctctaacaggatataaaaagtgaaggtaacatgagtgtagcacaaagatctatgcccatggacccatcatcattatatggtcagggaataatccagccaaagcctggattgggtggtggaggtcagcccattcctctctgtatataagttcgcttttgttgctaaagtagcactctgaaataaatgcagtgaacgtggaacttatatactacatcgatttatatgttgtttctgtggtgactatattgtgggcatattctgaaacattaaaagcaaatgctattgttctcaagggagaaaaatatcctattcttgctttgtccattctgattttgttgagaaatctctttgctgctaaatgattgagattcatttttctgttaacagttttaaaccaaggagtgagtggtctaccattgaagggctggccgctaactgtaagcttcatgaatataaattgcctcatctgttcatgcatttattttggatctactgattaatattggtgctatcatcttacagggaattgaccaactgcggccaaatttaggtggtcaaatgcagaagccatttctttcaacacagtcgcagtttcaacttatgtcgccacagcagcagcagcaattcttagcacaagcccaagcacagggaaatcttggcaactctaccaatttaggggatatggatccccgaagattgtcagcgctaaccaggagcgtgttgaatggtaaagatggacaacctgctggaactgatgggtgcattacttccccaatgcaatccagttcacccaaagtcagaccagaccaagaatatctcatgaaggttggtttttcttctggaagtgtgctgcttctttgttttgcaaaaaaatctagttatacctaaaaggtacccacatgcagcagacatcttctcagcaaacacaggaacaacttcagcagcagcataatcagcaacagcaacagcaaacacaacaggtaccaactactgatagtatacccaagcccaatctctgaattcatcttctgttgtagaaaatttaattgatgtgagcgtttacccctaaagttttaaccacaaatgtggtcgagaaaaaaaaaagttgaaaccataaatctgccaagcaaaactattctttgtacctactgccgcacttctgtaaataaattataagtgttcactgtagcatatgaatcagttaaatatattgatatagtgtacacgatggaatcaaaatgctggtctgaaaaggccaattgagacgattttgtgctgatgatgtactgcagtggcacagcttttctacttttttctgtagatataatgatttagttagttagatatggtgtacacaatagaatcgaaatgttgacatgacaaaatcaggagaagattttatgctggtcttgtgctacaagcttgctattcttttttcaaaaatcaaaatctgtttgggaataattttcctgaaatgattccaagggagacactgtagagggcattaaagtgaatgggatttaattgagagcactaaatccaactctatgtcattatagttattaatggcatatttgctaaggatgatgtctttttttggcatatcaattaagcggatggattttgcttctgttttttcctgcatatgtctgagaccaatttggcggcatggtgcataattttgcatgctctaatagactaatacaaccccttggtttcctcactcagtcgttccctttctctcacccattcaacgtgcgcgcgcacacacaaacatgattttccggctgaaaataattcccctcaaatgattaacttgcaatttccctctctttcaatgcaattcatgtttacttctatatgcttctcattctataattatttatggcctccagggcaatagaaaaagaaagcaacctacatcttcaggagcagcaaatagtaccggaacagcaaatacagttggtccttcgaccaattcaccaccatctactccgtctactcatacgcctggagatggacttggaatgactggcaatatgcgccatgttccgaaaaacttaatgatgtatggtgtggaaggaacaggactgccatcctcgtcaaacctggttttgcaccttctcttttccatttaactgtactgctttatctatgtaattattcttctatgccagatatataagcaaggctgtcgtttacttacaggatgatcttgaacaatttggtgacatgggctctttggatgataatgttgaatcattcttagccaatggagatggagatgcaagggatatttttgctgcacctgaaaaaagtcctgcagagcctaatccagtggcttcaaaaggtgatccttgacgttctgtgtgttctgtaaacattgaatgtttccatgtttacatgaaataacgttccatgttttttaggtttcaccttcagtgaggtaaattgttggcgaacaaacaatagcaaagtagtttgctgccatttttcatcagatggcaagatactggctagtgctggacatgaaaagaaggtatcggtaaatgcacttcttttcagcatccgacttttctgaatattgtggcttattttctgctgtcttttaggctgtactttggaacatggagactttccagacacagtatactgctgaagagcatgctgtcattatcactgatgtccgtttcagacctaactctaatcagctggcaacatcatctttcgatagaactattaaactgtggaatgctgcagatgtaagtcatgatttttcctgtgtgtgtgaaagtgggaaggagattacccaattatgcctggagttatgctgtccataacactaattctttctgcgccgtagtactgactggcacacactttcatttagagtactgatcattgcagtatatgtcataacaaatataccatgacactactgtcttggaattgacagtataaggcaagaccaatttgcaaacgaactagtctgtaagctatagtatatgtgtgattatggttttggtctattagctaattgtaaagttatttggcacataagagttcagtgtgtcgagactatggtatatattcaatgttggttctatatttacttgatttggtaccgtgttgattataaaagtccgcttgttttgcagcctggcttctccctgcatacatttgctggtcattgctctggaatcacatcactagattttcatccaaagaagacggaccttttgtgctcttgtgatagcaatggtgaaatccggtactggaatgtgt

SEQ ID NO: 64262 - DNA, 2878 bp, Oryza sativa
  unsure (1)..(2878): unsure at all n locations
ctcatcaggagactgtactcatgaggttagctctaatggaaacaagtttcattcttgtgtgttccacccgggctacaccgatctccttgttattggaggctaccaggtaattattctaaaacatggatcttagtcatttattggcaaaacatagcctacttttattaggaagcagctgttgtaggaacaacttgccatgcactgtcatacttgtgtagtggcgtaatttctcagccacaaaaactgtttcattgccaaccattgggaaaagaaaggcttaataatctatggttcgcggcaaaatagaccacatgcaacaaaattaatgttagcttcgcttgtaatgatcaaatctagttatgttttaattcaaaacagcgcctccgatgactttgatctttgtcgcttatttatttctgatgaaaattgcaatgatgcagtctctggagctatggaacatggtaaagaaccagagcatgacagtgcaggctcatgaaggtctaatcgcggcgttggcgcaatcaccaattacagggatggtggcttccgcgagccacgacaactctgtcaagctgtggaagtaacaatggctgcacttcggtaacatagtttcttatagttagttgaaagtttcttcagccgaggcatagaatgggtcacagccgaaagatgctgttgttgttgtactgtatcgggaggcaataaaaggatgtcgaatttgaaccgttcagtgctcattgcagcgagattgtgggagttgcatttattatttatttatttatattaataggtgttggtgtcgcccaaaatgatcaaagaagaggaaaaggaacgaaggccatagtaggggctctgttttattttatttatttatgttatatgaaatgtaaatggtaacgtggtattcacaatatgtatggcgattgatgataacaccagagcctcgttgttctatacgcctcagcctcagactggaaatgtttagggcttgtttagttcgcgaaataaaaattttttagtatcacatcagatgtttgattggatatcggaaagggttttcaaacacgaattaaaaactaatttcataactcgcccttttaagtttaattaatccatcattagcacatgtggattactagttatggttaatcatggactaattagacttaaaagattcgtctcacgatttcccccctaactgtgtaattagtttttcttttaatcttatatttaatgctccatacaggtatccaaagatacgatatgatgtttttgggaaaaacttttagggaactaaacaggcccttagtgatgatcacaaacgaagttttctacgtctttggtaagattcaatcaatcaggtgtatgtggttgaagaaaatatttcatgcatccagcaaccatcagatcaataaactggtgggtatcatgcatgccacagttgatgctcagatatgatgctggtacagttgattataaccctatcttcaattgcaaaaatgatatccaacacccccaaaacttgtttcccaacagtaacaatgtagtgcctacaatgatgagtagttggacaacgttgtcatttagtccctttctttagctatcctcttctcctttctcttttgctctcgtgtacctatagaagaagaaagatcagaagaaattaatagataatgctgacagacagcggacatctatttaacatgtctactaaggtgctacaatctgcagtattacatgcaagccaaaccgtacggacatacaaagatttttgctgttcaacctctatttagagtaagcttcctaaagatgcatattcatcactcatcaggtagtttgcctgcttcctaaagaagaggggtagaagaaagcttacttttcttctctttttgcttctttcgcctccaattttcagcaagccttcgcttttctctttgcttgtcaatgctcacacacacctggaaaaatacaaaatcactaaatagataagcaacaccaaaatataccataccataaatcccaaaaatgatgctggccctgaacagaaataaataatcttgtagaaaaatctcatttgcacaaacctcttgcccagaattctgaagagcttgcaagggttctatttgatcctgaccaataacaacaaatcgggatcctttatttgcatttacactagcactgcccttaacattccttttggacaactcttccagttgcttttgaagtaacggtgaaacaccagcctgaataattgttttagtgattcaagtcagataagttgatataagatactatagcagttccagaaacaagagctgtgccagtaaactaaccccagctaaatagcgccgcgaaaaagtcttaggctgcaaggggcgttgcaagagctcactcaaatcctacatcaattcacagaaaaatatgttgaaatataggacaaactatgaatacctcataacaacttggttttcccaaaaactacactaattatataaccgaccctgctataatattgtaaatcattcaaacctgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64263 - DNA, 789 bp, Oryza sativa
tccatgagacgtatattggtatatagttttattcttcaatagacgcatatagtattctttcaagttccatttgaaaacttggggattttcggtcgtaggttcacgagtttgggaaaacttgggaatttcattctagtttatcccaatcttcccaaacttgctgaattgaattgctggaaaattttgctttatcccgaaactccttttcctgagttaatccgaagctaattgcttcatttactgataatttacatcaagacataggcatatatggcatctaaacggaatgatgggaacataatggctaagtttctgctctgataccacaatgttgtctctaattatataaattgaatcttagcctaacatgatcacttcttgcttatgtgaaatttgatctataaccgttttgagatgccactgaagccacttcaatcttctcccggtttctttctttatggactagtgtttatgcacttatgtttggcttcgagatcaccggttttagagatcgatggagccctctcttaggttttaaaattggtgatagaagaaatagttgtcctactgctcctcttaattcttttcttataatagacggtgcttgtgaggcttagggactaatcccgactaatttttcatataaaacttacaaataatgatattagccgtttaatttaacactattacgggcatgtttggtacagctccaactcctgaaggcatgtttggtacagctccaactcctaaatattgcttcaagagttgagtctggagtggagttgtgga

SEQ ID NO: 64264 - DNA, 1281 bp, Oryza sativa
tttcatgttgcaaaaccttttatcctatgccttctttttgctcaattggcctaacaaccaagggataaatagaaattgccacaggatcttcttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatttgttgcccttattttgcttatatctacacatggccatggtgcttcatgtttattttctgaaaatgccaacaccaaagattttgaagcacacaactgacaaagtggacatgctacaacaatttctacaacaagaagcaccatttatagaacaaaatgcagtacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaagg

SEQ ID NO: 64265 - DNA, 3899 bp, Oryza sativa
gaattgtagattttctttactgaaaactgcaagcgacaagttctgttccattggtcaatataatctttttggtgatattctgcaagatgtttagtcaaatccatgactattatatccagactagaaccaaatttataccacaaaatatagtatttattgctgaggtcgtagggtttatttgtaataaaatgtgttcttttttattttatgtatgtatgactacctgcctttgtttaatttatttctcgcatgcttgttttctatacatatctaactttcatgtaacctctgtttttttacctgtcttgttgccggcagcgcggcaacggcgcgcgccacccctagtgttgatataagatgaagggaaagaatccaaatacttcctaaactttagatggaagatcgtctaacaccctgagctttgaaatcggacatccaaccctctaaagtttgaactttgtcatactatccacttgcccttaaaatagttttggatggtggttttgcacatatcataagcttaaacaaacaactttaaataactaatataacatatttatatatcatcagttgtcagtcatcgatttatctttatacaatcatatcttactattattgtgtaggtgtttgtttttcagtgagagctaataagaagtaaaaagaaatatttaagtcatatttttaagtgtaagccataatcagaaagttttacacgtcaattcattagaagatgaaatactcatactctcctactagaatgtttttagaaaatactcctattataagttttagggggtgtttagatcaggggtggttttagcgtgtcacatcgggtattatatagggtgtcgcatggagtgttcggacactaataaaaaagctaattatataatccgtcagtaaaccacgagacgaatttattaagcctaattaatatatcattagtaaatgtttattgtagcactacattgtcaaatcatggagcaattaagcttaaaagattcgtctcgcgaattagtcataatctatgtaattagttattttttagcctatatttaataatacgtacatgtgttcaaacgttcgatgtgacagggggaaagtcctcggaaaaaaacacacggggcatcagttgtactgtctgcaatagggacgctccaacactggtgatgaacacatctttgaggacattgaattcctggacctggaggctgatgcagagccaaggtctgacctgtggttggcagatttgcagaaacggttgccgaaggaagggaacttgcaagaggaggagggataggtttatgtgtggaaaatgagcatggataagcagctgaggacaaaggctggaagagtactgccaaccatttatgctcattgatacagtctgcttgtacgaattgaagttgctctgcaagtttctgaagagagccaatagcccaagactaccacacacaagagccaaacgctgctctgaaaatttctgaaaggagatgactagtacagctgattgacatacacaacaggatgaagattaagattttcgtggcatatttttcaaactgctaaacgatgcgcttcgtgcgaaaactttctgtatgaaagttgctataaaatatcatattaatctatttttaaagtttgtaataattaaaactcaatcaacatacgttaatatcatctcgtttttgcgtaaaaaaattaattttcatctttatctttaagagaaaaggagaaaagaacatcaccgcatagttccaggcctattattgcacagaggttgctgtgcttctcaacgattgccagaagagatcttcagaaagaccccaaagtctagaaactcttccaaacataagctaaggatgtgtttttatttgagtgtaaagtttttaaagtatatgaacgcacatttaaagtattaaacgtagactaataacaaaacaaattacaaattccgtatgtaaactgcgagacgaatttattaagtctaattaatctgtcattagcaaatgtttgttatagcatcacattgtcaaatcatggcgtaattaggcttaaaagattcgtctcgcaatttacatacaaactgtacaattgattttttttccacatttaatgtcctatgcatgtgtccaaacatttgatatgatgtttttggctaaaattttttagatctaaacaaggcctaaatgatacttgtgatggaaaatgcatcaagtttattcacagataacagaggaacatgcatgaagatgaagtgcacatttcaagaggcagggaaaatatcagactactttcatcctactgaagtcagggtgtgtttagttcacgtcaaaattaaaagtttggttaaaattgaaatgatgtgactgaaaagttaaaagtttatgtgtatagaaaagttttaatgtgataaaaaagttaaaagtttaaaaaaaagtttagaactaaactcggccttacctgatcttcagaaagaccccgaagtctagagatgaaaatcttctaaacataagtcaaggatcacaatgcgatgaagaatgcatcaagtttattcacagataacagattgatgaacatgcatgaagatgaagtgcacatttcaagaggcatggaaaatatcagactgtactttcatccttctgaagttagctgatctgtaggaaactaggaacatcttaaggttttgattggaattaggattagtcctagcttagctgtcatcagtggcattacaacagaagcacagaacaacaaccgtggaactgcagcattggaacctagtactgcaaagtctgtcgaagatattatcagcgacacctgtataacaaaagcgtggcacatgagacatggatacattcgcgcattagatgcgatgtcgaccagtcaaccatgtcgatgatataaactatagagatgaatttatagtataaatacttacagatcgcatgaacttcgttattaaaaaaatcgaggtggtcaggtgccacattgccaatgctgcaattccaactgtcaacataaaactatatttatttttatgaagtgtctgaaagttcaaacatgcacatgtgcagatgtctagtgattttattattatgcaaagtactacaacctgtatttcagtttatcaaaattattcatcaaatttgccaactgagctccccttgcggtagaacatatccatcgaagttcaagttgtagtcttagtataggtgcttttgcattttttttctaggatttaatctgatgaggtagtatgctggtgcttgcactttctcggagacttaatctccggaggcactgaatgcacataatatttggtggataagtttatacccatgttaaacgaggctactgttcgaatttgagtgtatgttaggacttagatgcataaagttagtgtgtgcatatgtcaacttaactcgacaaaggaaataagccttacatttgacataaacccctcgttggattactttgagattcgttcaaatccccccacgttaaccctcttccttttcttcttccctcctcaccgatgcacgacatgctcgaccttgacgcctcttgtgctatcacttggatggaagtgtcattaatattgacggagccctcccccctctattccttctcaagccagcagatgcccatgatccgacattttccccatcttcggctgctcataaccaccaccaccgactaccgcttcttacacaagcttgctttgcccctaccgcgctcctttatcccaatgggcgctgacatcgccgttgacgcctcactagcatccattgtccaccaccccccttgtccaccacttcccatgatcatgcctctaagaccgacgatctcctccctcttccccaatccctaccctaaatctaatatggaccctaatc

SEQ ID NO: 64266 - DNA, 7006 bp, Oryza sativa
  unsure (1)..(7006): unsure at all n locations
attcctgcagcccattcataaaattttagatgggttttcagtttttttttcaagtgcaagcaagtaaggcctcaaccgtcaagcatgggaaagctagaaaagttaaggaaaacccactcaaaagcccaggaaccccaaaacctggcccatctccccggtccccgacctcgcctctccttcctcctctgctcccactccgcctcgccgccgcctccaccatgtacggcgtcggcggcgggggggcggggttgaagccgcggtggacggggtggcgccggcggcgcaaccacgaggacgacgacgacgaggaggaggaggagtccggcgaggggcgcgtcctcgaggcctgggagcgcgcgtacgcggacgaccggtcatgggaggcgctgcaggaggacgagtcgggcctcctccgcccgatcgacaccaagaccctcgtccacgcgcagtaccgccgccgccttctcctccgctctgccgcctccgccgccgcccgcatccagaagggcctcatccgctacctctacatcgtcatcgatctctcccgggttcgttcccccgtgccttctcctaagcttgtcctcgggtcagtcactccgtcgagcacttggtgagtgcggagttttccgtgagctcgggttaggatcactggggatggcgggcaatgctgatcgtgctaacctctcagtgtttgttaaatgcaacacctcgtgccgaggctgatctggtggtattgcccatggcctcaatttggttcgtgtgaaatgtggactggaggcagtattgttgaatcggtgatcactatgtagtgcttttagcttgatttcatatgctagctatttcagtgactagctgcgcaatcctctccacttccacatcaaggtttgatgtttgagttgatgatctcatcactcatgtatgatttgctagcttgtcttcttgcttaggtgttctgcttttagtccctgagagtgggtgttataatcggtgcatatcagggcaatactggaatctagccatttttgtttgccattgaccagggccataaccagagattgaatggggggttttcgccaaccattgaacgcaatgaagttcacaaactaaaatgaaattgtatatggtttgtattaaaaatggttcttctacaattataatagtttgttttgtaaaggaaaaaaattcttgtgccaaagggtctcctgagatctgtggtaaataaaattctttctataaattactgcactatgactcttatgagcaagctaaaaaggaaaagacatatttcataccccatccctgttaggctcatgctaatagcaattttctcttggttctgtcctatctgaaaacttcataggaatcggaggagcgtgaggtttttcattatcaagattctgaagcggtaaagcgttttggttgatcgtcatttgttttatgtcaaaggaaaggggcaccgtactgcattactgctccataccatttgacattgttggaaagtgttttctgttgatttgagaacactacgtatattttgtgtatgcattcatgtggaaaaagccctttcttcctttgggtgataggtagtaaataagatcctctttggcacagctccagatcttagatccatggtagatttgaagtttataaattaaattataatggtttaaaattctaaatttcatttgaaatgtgcacgaaataatttatttaaatgttattaacgtaatcgtagatctagatccatggatttatggagctagaaatacctagctccaagaaatcttggagagggcctataccatttattttagcatatgtacattttcttctcacaaagtaggctgctcatgattgttctggtgatgaagatatttttactgcaaattgatatgctgcccacgacttcttttacttctttgcattcggttgtaatctccatttatcctggttgtatctttgatcatgtaggcagcttcagagatggattatcgacctagtcgaatggctgttgttgcaaaatatgctgaggtattcataagggaattttttgaccagaatcccttgagtcatgtggggatagtgacaatgaaagatgggatttcccatcgacttacagagattggaggtagtcctgaatcacagattaaagcattgatggggaagcttgagtgttctggtgaaccatctctgcagaatgctctagagcttgtccatggttatttagaccaggttccttcatatggtcacaaggaagtattatttttgtactcggccctgaatacctgtgatcctggagatatcatggagacaatagcaaaatgcaagaaatccaaaatacgatgttcggttattgggcttgctgcagagatttttatctgcaaatatctgtgtgaagagactggcggatcctacacagttgcactggatgaggtcttaaaatatgctttgtgtgtttacctttccttattcagttattgtgaagataaataatgcctgttttattttggcagtcccatttcaaggaattgcttctggaacatgctcctccaccacctgcaattgctgagtatgctgcagctaatttgattaagatgggttttccgcagagaggagcagaggatcttatctccatctgctcttgtcacaagaaaataaagtcgggggctgaaggttacatatgtcctagatgcaaagtcaatgtatgtgagcttccaacagaatgtcgaacttgcgggctgacactagttagctctccacatctggcaaggtcctatcatcatctcttccctgtacaaccatttgatgaggtgtcctccgtgcacccaaatagactaggtcaaaagggaggacaaaagtgttacggctgccagcaaagctttattaaccctggtatgcagttctttaacacgtctaacagtacatgctaccttttcaatgcattttcatacaaggaaagatatccttattgtgctacatatgttgcagttggtagaaaaaagaagagaaaatacataatacaaagcttacatttgtttgttattacatggcatcatgttcttcaattaccaatcctcatacttctcttacatttaatgtttttcactggtttttgtgctagattatactccctctgtcccataaaaaaccaacatagtactagatgtggcatatcctagtactatgaatctggacatacctctgtttatattcgttgtactagaatgtgttatatacagtcctaggttcgttattttttgagacggagggagtactttgcaattatcaggtttattaattatttatccaatatccttgcagatagtcaatctagcctccatgttcgctgtccaaaatgcaaccaacacttctgccttgattgcgatatttacatccatgagagcttgcacaattgcccaggttgcgagagtcagcgtagttcttcatagggatgccattgtggtgttaatctttgtctttttaactcaagaagctacccgttgctgtaagctttctcgtacactgacattggtaggcgatgttgtgaggtaatcaaacagtgtacagatgatatagtgcccggcctccattttgttgacgcttcctgttcatttagatggagtagctagttaagctattttgatacagagtactggtcaaagagttgttgaagccatagcattgttgctgaggggaggtgttagaaatgtacaatgcgactgaaaagtgaaaacttgtaactcttgccgtttttctgaggcaaagatgtattctttcagtgtcatagtcatgccctgacatgccatttacgagcagaggctgttcctttctttttttttcccccttcctctcctgatatgccaatatgctggatatcgacggctcgacgcacgcacgcacccggcgttttccgttgctggttgctgactgtagaatcgtcaaggtaagcagttgcctcgtgcaattaactgcacaatttcaaagcaggcggagacgcagaacgaaacggcaaaacgctggagagagcacgatgttgctgacccaagaggctgatggcttacgtttttttgctgcctcgcaattcgcttctgatgggcggagtcaacacagatgctaactctgggctttttcgttgttccctttcagctttccggtgacgagcagtggcgatcatcatgcataattacatatacgcagcatatccctggttccctacactctgatgaaagtgtgcttcctgtggctatcatgtcgactttgctaaagcgaatggatgacaggcagcggtgccagtgctccttttcaccagttgcacggccaagttgtgggcacgacgaactgcaggctgctgcaccgtcctgtgcgttttcaactgtagatcactcgagtccacttgaaagaaacacaggtgagacagcacgacggcaaccgatcgaccacggccttttccgagcactgcacagtgtgcacactctatggcgctaagcccttttcgtgccctatgctgcctatacacagtcacttgcaacttcctttccttcaacagtacggacgcctcgctcatataaacacatatacgcacatcatatttttataagagtaaattttacaaaactacatgttttatggttcaagttgcagaaaaccacacatattttgacacttggcatttaagtacatatattttggtagtttagtttcacaaaaccacactatcgatgaatggattcacacatgagatgacgtggttgttttatctagatgatgacgtggcatcctattaatttcatgggatggctagtaataagatgccatgttctcgtcctagttgaaacagtcacatcatctcgcgggtgaattcattcattgatagtgcggttttgtgatatcacactaccaaaatatatatacttaagtgccaagtgtcaaaatgtttatggttttctacaacttaaactacaagacgtgtagttttataaaatttactctttttataaacatctctaaagattacatcggtatatatttaatttaagattaacaaaagttatcatagacatatctctctatcatatttcaaagttaccatagacatatatggatgtcatgtgtcgatatatatagtattatctaccactaaaagaattaactagctataaatattaataaccgtgttaagtttataatttaaatccggatcgacaaactcaaaccacaaggtcgaactgagttcgccgcttgcaactttctgacgatgtggtccggcaccggctgggcatcgcatcgagctcgtgcaatgatactgaccccatgatgggatttgcttgctttggcttggagagacaacgacatgattgccatcatgctagttgctcctgagctgcagcctctgtactatggacaccaaacatttttattactcgtatctctgaaccaagcaaacattcagaacccagaaaaaggcagtggtgaatttccttgcatcaaatggctgaaaagttcgcatcaaagtttggtggaaaaatatcagctccaaaaggtgtggtttaccgggacaaagccctttacgccgtgagtttaccaagcccggatttgccggattccctctctagcaggaaagttcattgctgctttacggcagaaatcttcagcatggaaagggtggctatgctaattgctaaagcacatgtttggatagtcaaccatgaaccttgcagagaggtaaggttagctgcacgacctggtttgggaatttttcttcttacaacgaaaaataactatgaaattcttgtgaaattatgtgtttcagacggcattagactgaacatctattttctaaaaaataagactgaacatgtcttcgcgctcaacagaaggtcagtgcaagcaggtgcaatatcgccttttctgatcacaccgaaatcattttgaaagcaacacaagtataactcatactacgcgtgtgtaacatataatggaagggaaaataaacttatgtccgttctaataggatggaccgatggatgaagccttttcccttggtttcaccagcatcttgttcatttatttccactatcccatactataagatgcttgattcaattcaaaagaaatttgaccaataattagtctaacatgaattaaattttatttgacaaaaataatatcattgggttaaaatttgaatgcacttttctatggttgactttgttactataaatattacagtaataatatacaagaaattaaaagtcaaaaactagttttatagattgtgccaagttcaattgtgttggttttttttttctgcatttctttcgatgtcgctacatgcgcttaccgcacattataatttgaaacgagggagtaatatgcatccttcggtcgtcccgtcctttcagcttacgtcgagaaggcaaggacaggtgattgtccaacgagtcttatgtacttgtgttagtggatcaagtgtgcctcgtgcgccattatgttattttccgtcgaactcactgcaattatcaccggatttgagacagcataacagctgccgagacataattatgtggggattattaggatgtcacgctcggtcggtcacctgcattgtacttgtaaatatgtctatcagccgattaacaaacttgagaacaccccagctaacaaacctgaaaacataaatcaataaagaaatcaaatctcgtttgattacactcgagcatctctgcaccggtaggattctgctatggatcagcgtttacctatttccattttgtttttcctgatgtgaatattggctggatgtgagccagcaggatagctttgttaagcctcaaaatgttctgaacaatctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64267 - DNA, 5973 bp, Oryza sativa
  unsure (1)..(5973): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaacccctacctggcgcgccaactgtcgaaactagatttcagcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacaaggctattccccctaaagctcggattaattagtggttaggcctcgcctcctaataaactactgtatgttaagtatgcatgttatactgattaaaaataactttacccggctaactaattaaaatatactagaaccctctatacaacatacttcctccgtttctggacgccgttgactttataagtatatatttgaccgttcgtttattaaaaacttttatgaaatatttaaaactatatgtatacatataagtatatttaacagtaaatcaaatgataggaaaaaattaataattacttaaattttttaaataagacgaacaatcaaacatattaaaaggttatcggtgttaaatatttagaaacgaagggagtatataaacaaatttacatatactatagaaaacaatgtataaatcaattatcaccaaagtcaacccatatactgtaatctgccctctctgtcccccaaaattcttttgttgctgctccgtgtgctaattcataagaccagatgtttgtaccacatgtatcaaggtacgtatctgcgcagaacggtaactttggtacaaatgccaattcgccatcgcgagcaacaaggtcaacgtggacggtctcaggccactggtagaatcttggaaggaatatcatattctgcatccagttaaacttggtcttcttcatcatcgttgttagagacccggtgaacactgtctggctatgcaagctatctaccttctcccactccatgctttgctcgttaagcttgacgagatggaccttcttcccacgtcgttcaatcgctacaaccattaattcaccttggttggactcgagcaagtagctgtcttcacatttgaaaccgaagctattaggcttgtcaagaatcttaaatccttcatggtgcctgcaaggatcataaactgctaaccttccatcttgagctagaaggtatagcaagctgttatggagaactggattggtgcccggcgatgcctgaagttgcgaccagtcgggactgttctccgccaaattccagtcctcccactcgtcactgtttgttcggatggcactagcaacctcaattgtgaacatcgcctctataccaaatagcctctcatcacggtcggagacaacaaaattaaacagcgcataaggtttttgtggcaacacttcaacgaggacgccgctgacgaggtcgatatcaaacaccgaggatttatccacgcgcatcttgaggtgtcgtccggtggagcagcagattttcgcgccaggcaccttcagagtgtcgtcgacctcgaagttcttgtcgtagtaggggctatagtatcggatgttggcggtgccaacctcggcggtgttgagcaggagcggcgtgatccacgccgggtaaaagggacacagcgacgcggcgtagcgccagtgccggcacaccaacgcgacgatcgggtggctcgaccaccgcagactccccagaatcaggacgagcacgtccgccgggagagacgaccagccccgagcctgtgacgacgatgcggcggcggcctccatctagctcgatcgcttgctcgatctcgccggtttaaacccagtactgccggcctgatcaggagagacgacgtgcgtgagcgcggtgtgtcttcgtctgccaatggcgttttcttttttaaacattacagtgttatggagtatatcgtggtgtgccgcgcgcgcgcgggagcttatatatgtacgtagggcgtagtggagcgaaaataccaatcggtttacatgtggagttgcaatgcgatacgagttgtccggggaaaaattaacaaacctacacgtaaacgtacgtacatacgtgtgccgctggccggcacggtatagctctgctgcacgtacggtcggcaatttggaaaggtgattttccttagaaagggatcggattttttttaatagattagcaatagtgcacgtgcgttgcaacgggaaaaacactgtttgataatgtgacaccttgaaaacctcaaatctatattaacaaataggtagaaccgagtctaatttaatgaattagcataggatttaggatttagttttagattttatttttcgagcctacttaggagtttatccgacggagtttaatttaaaatatctgagccatattgtttgatcaaatatactttcggcccaggtcttcccaagccggcccaaacttgggctggcccatcttcggcgagccgagtcagttcgacggcccgcaagctgagcagctgaccgcagcacatatgcggggatggtctgatgcacttccgcggcccattgggcgcagcgtaatctgctgcggcggcggtgacccaacgctgggtaaatctgaaccgtccgatctaatatggacggctctgatcgtccccttgccggatgaagtgccgaccaggagagaggagcaaaaccctagctcccaaatccctctttctcgatcacatttctcttcggcgatgagcgagcggaacgacggcgaaggcggtccggcgagctggtgtgcgcgtgtggtgacgcccgtcgagcagctcctgcttcgccggctgggggacgcaaccgagggcggcacaaagccgtgccacggcgtcggtggtccggctaggcgggcgcgcaaacggcgatgagcgccgagcggcatggagctctcggcgggaggggcgacgccaagccgacgcttcccgtcttcggcaagggatggtggaggggtgctccaggacaacgcatgcacaaggaacccaatgtgactgcgaggaggtgaaggtgcggcggtgccacttcccggaaaactccggtgagctttgggacttcaagtgcggtaagtaacccgaacccttagcttaattgatttggatttttgactcttagggttcttacccgaaattaggtttcttcgaatttggggaattttgtcgggaaatttcaatctattttattccctcttttcgagttatgcgagtttcaatatcgtttatccacttttaattttgggaacttcaatctagtttatccctttgctcaatttattttttttttttttgctttggccggcgtttcatcacgcgggcggggacggagggcgccgctcggtcccgtcgaaaagattgagattaagataagatgatattttcacagacgacggaagtaaattcaatttaattttgggaacttcaatctagtttatccctttgctcaatttctttttttttaactttggccggcgtttcatcgcgcgggcggggacggagggcgccgctcggtcccctcgaaaagattgagattaagataagatgatattttcacagacgacggaagtaaattcaatcgtaagatactattttattcttttttgttttaatttttttaccctgttttggtttcgttattacggatgatggaagcgttttcaatatttaagcagtagagatagagatatataggctgtatttagatccaaaatttggatccaaacttccgtccttttccatcacatcaatctgtcatacacatacaacttttcagtctaatttcaaccaaaatccaaactttgcgctgaactaaacacaaccatagtacaatgtcacatataatagtattcgatttttttaccgcgtcacatataattccttttttttaattggacagaattcatttttttattttttttccgccctttttttaccctgtccacgaaatcggattctttttttttccctttttttcacctgatttttttcgcctgattcctttttatcggacagtcggttttttttttcgccttttttacacaggatcggattcatttttttccccggttttttctcactcgatttttttatgcctggtttttttattttttcgccctttttttaccgcgtccacggaatcagattctttatttttacccgattctttttttctatcggacagattcgattttttatttttttttttgtgttttttacacgggatcggatttatttttttcccggttttttctcacctgattttaatcgcacccggacgaaacggggagaagtgacgatctgaaaaatactaatcttttaattagttaagattaagataagaaaagaaaaggccagtgattttccttgtatttatatgggtagcgtttatgtgcaagctagacatttcgcatggatatataatttgtgttgattataacctgtcacactaatcaacgataaaaattaattgtatttaaaacttttatatttatgtgtttttagcgacgtaaaagctaatgttacaaatctctactacttaaaaaaaatttaaatgattttgtcgtccattctatcatggcaaaaaaaatcggacctgaagaaaaaagagcgaaattaaaataatcggtcctattcctaatcacaaaaggacaaaagatctaataaaaaagataaaaatatgtcccaccacaccttgcgcttgcttcgcttctcccccttccgatctcttttttgcccttattgttttaaaaaataaacaaacaatttaaattactaatcacaaaaagacagtgatctatctatctactactttacttaaaaaaagaagaggtgcttccatcgtccgtcaaaaaaaccgggtgaaaaaaaccggacaaacaaaaaccagtttgtccgataaaaaaaccggtaaagaaatttccttcgtccgtacagagaaaggaaaaatacgcgcgaataaaaaagtgcgtgcaaaaatagtttctgtccgattccaaaataaaaaaaattccaagcgaaaaaagagtttccatcttcctacaaaaggaaagaatagtgcgaaaaaaaaagtttctatccgaagggaaacacgcgcgaataaatacctaattaaaaataaatatctatctctaaaaaaccttctgtcgtaaaaaaagaaaaaaaagaccgactcccgtagagaaaaaaaaagtccgactcgtgaaaaagaggttttctcgtccgtaataaaaaaaaggaaaaatacatctaactcaaaatccgtaaaaagaaaaggaggaaaaaacgacccggccaaacttaaagtcgccttgttgtccgtatatatctctttaactctaatctaatctatcaatctaatctaactttttagagagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaa

SEQ ID NO: 64268 - DNA, 738 bp, Oryza sativa
aattcctgcagcccatacgccgacggaggccatgcaggtggtgtcgggtaggcctacgtgacatttaatatggcggtataaagtgtggaggtactcgcaatgggaggcaaagtggtcggtgtagctaggcattggtgaggcccaacagtggaagcggttcgatgaagatggggaagcgatgtagttgaggagacggtgagagtagaacaggagcccacgctttgatcacacaggcacgatcatcatatgctcaatggatttcttaatcattgtgttgtaccgccaccacaagggaccagcgtgtggggttcaagcttttcactccaagttattcctgtaacgtagtaagggcgaaagcagagttttgtatatccgcctactcgtccaaaaaaaaagtttcaaaaaaccggtgaacatacacaaatagagaaaacaaccatggaaaaaaaagttgaaacacactaaaaaactgaaaacatactatagtagagtggaatggaacgtttaacccctcttactagatcccgttgcaaagcacaatatatttgctagtaaactaaaaatatatcaagtttcaaaaaatctaaatgttggcaagaactgataagatgaagcacagaagatggaggcggaattcctccgtctcaaaaacaaattaattacctgctattgaagcggttgcatgacctagtgcggaaatgcaatttgaggactgtctaaggctgagtttttttccca

SEQ ID NO: 64269 - DNA, 1004 bp, Oryza sativa
caactcgttggctcccattctgtaaggcctcttgtggattggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggttcaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaacccgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttac

SEQ ID NO: 64270 - DNA, 2689 bp, Oryza sativa
catcgctgccgaatctgctagtgggacatccccttcgatgctccactcgccccaatatgtcctcctctccttgttgcggcaccccccttcgctggcagcgacgatggcctcctcctccatcctcatcttctggtgttgggcgtaggagcaggcgatgattggagcgggtgctgcggtggcggacgcgatgatgacgagtgcggttgagggtggcggtagtaggccccaacgggccccaacatccccctcctagtgattttattttttgacgaatgttttaagagatttccttttgttgttttttcctctttttgattttccccttcctgtgtttgaatctgtgataaattgattagctatgtttttacttgtaaaaaatatgttgttttcggtcctatcctgacctgcatggctgcatgtcaaccaaactgtcaaaaacagatttttaaaaaaattgcaatgcacattaaaacatcatatatcaattagaaaacataaagagtcaaattatatgtagaatatttaaaaaacaaatgaagactctatttgtgacttagttccgaaataatattccatatggttctcgtaaattgcaattctcacatgtaaacatgtttggagatacgagaaaagaaaccaccatgagctctttttaccgtctcttataatctttcttattacaaataattatcgtttaattatggtcagctagctagtactaaaatcaacccatatactatagtctaccctctccaatccccaaaactctcttgcctcttcttcttgccgcccaattccatatgaccaaatattcatactagaggtgatcttctttatgctagacggtgagtacgactttggtacaaatgctgcttcaccatcacggacaataagatcaacatggacggtctcaggccactcatacaacctgggaaggaaaaccttgttttgcatcgatttgaacctagtcttcctcatcattgttgtgtatgttcccgtgaacagcgcacgtccttccaaggtctccaacttgtcccactccatcgtcgcctcattgagcttagcgacatggacaggtgcgccattgtagccgacgaggacagccatgagctcaccttggtccgactcgaagaggtggctgtcaacttcttggtggtcaataccaaagttgtcaggcttaccaagaagtctaaaattatcggcgtggttacatggatcatacaccgccagcttcccatctccaccaagaacgtacagcaagccatcgtggagcaccgggttgctgatcggcgccgccggaattagctgtgtccctgcttccacgttgaactcccgttcggtcccaaggcccccactcgccgtcgccatcttgcgtcgcgcaggtgagctgtagcgccagggtcgtgttgacgcagtacaccctccgtgagccatcgtcgtatacgatgaagtcgtaggagtaatggggcgtacacggcaactcgtaggcgacgctcgtcaggagatcgatttgggagatggagaaaggtgagaacaacgtgaggcgttgtccgttggagcagcagatcctggtggcatcattggacgacgacgccttctgcagcgtgttgccgatcacaacctcgaagtttgtgttatggtaggggctgtagtacctgatgttggttcggccgacggcagcagcgcagcggagtaggagcggggtgatccacgctggatagaagggtgacacggcggaggggatgccgccgaggtcgatgatgtggatgaacttgtttgtcctcgtcgtctcgaggacgaatcgttcacggcgatggcggcgaggtggagaagcgggcacaggttgaggaaaagctctggcgcgcgaggaaaagctctgtcctcaccaccccgctgcacgcctcgaaaaggccgaagaccgcgtgcccaacttgagctccgcgaaccttagttggtcacgccagaagccttgctggcaaggaatctcggacgtggcaagcctaagctgaacgccaactaggcgcattgtaaacgccctaataacagccaagatgcatatatgtattccatgggaaatagtttcaatatcccagtttccattcccatttgatgcgataataaatagcgttacatatctcatgcttgtcaaagagaaatttatttggccctggacggtaggaggaaaagtaacattatccttatccacatgatggtttggctactgacagtaaacagggcacatcggtccctgccatagataggttatgcaatcagcactattattattattttttttgaaaacgcacggcaggagctctacctattcaattcaggaaggaaagaaacatgtttatgtacatcccagcacccgctatgacgggtgaaaaaggtactaactccaccccgctatgtatgcgtgtttttcttcgtaccttccttgatactccctctgtattttaatttatgacgccgttgattttttatctaacgttttactattcatcttattcaaaaaatttatcaattatcatttattttattatgacttgattcatcatcaaatgttctttaagcacgatataaatattttcatattttcacaaaatttttgaataaaactaatggtcaaatgttggtcaaaaagtcaacgatgtcattcattaaaatacagagggagtatcaaggaagg

SEQ ID NO: 64271 - DNA, 3554 bp, Oryza sativa
cgcttgccatatccacggcaggcgacgactaaggcagctggtcgttatctctgctgtttgattttttatttttagaggcttgattggttggggttttacgccagcatatctgcttgatagctttgtaccatagcctgtgatgtaattgtaaaatcttggtttgtttattagtttagtatatgttcttttatatatgtcgccattctttctgattatttttgttatttgccatatgctgtacaaattgctcttaacggttgctgattgtaattgtggcttgcacaggctactgtttttacagtcgcccagcggtccacattgatgctagtaaagctttgcttctaccgcacagatggcaatgatagctgtagaaatgtttttttgggggacatttaaggcccctccaatgtacactacgatgtctcaaagataaccatatatatatatgtatgttcttgaattgcctcccaattaaacatttctcttacgacttaggcatcgttcgttcgggggagatcggggagattgagtctcgtttttcgcgcgcacgcttttcaaactattaaacggtgtattttttgcaaaatttttctatacaaaagttgtttaaaaaatcatattaatccattttttttaaaaaatagcaaatacttaattaatcacgtgctaatggactgctccgtttttcgtgttactgttccgggttggaaaccagcatatgcgaacccacccttagaggccattgaacactgaaccagggttagtattgttttctcgtaaaactataggttcttagaatctgtttatttcccaaacaaaaattttcaccctgtcacatcgaatgtttggacacatgcatggagtattaaatatagaaaaaaactaattatacagattgcctgtaaattgcgagacgaatattttaaacctaattgcaccatgatttgacaatgtgatgctacaataaatatttgctaatgacggattaattaggcttaataaattcgtctcgcagtttccaaacggaatctgtaatttgttttgtaatttgttttgttattagtctacgtttaatactttaaatgtgtgtccgtttatccgcatgctaaaagttttcgttcacgaactaaacagtcacagtccctagtccaaataacaaaaacacaccatgttttagaaacgtaattgacatatgggcacatgacatgtctgaattgctccaattaacttgggccacctaccatggatcagacgatggttaattacagacgcacggtagattgggcgctcgccgcgaggccgtcgctattggcctattgcctcatctagcttcctcgcacgcgtcgcatcccggccggcagccgtaagagcagtacaatagtaggctacaaaccagctgcagacatattttaaagagataaataaaaaaagagaagggcagcgggctacagatttgtagccagctgtagcacggactccaagacacagtgtgtgtatgacatgtgggaccatatattaatagtgtagtatataattattgtacgaatgagctattagattggctatagataaattggagctagtagttggctatactattgaacttgctctaagctgccgtgttttatcgcaaggcgcgcaggagctaatcaaaacattgttttcccatagctgtgatgaaaataaaagcaagaatttcactagctgagcgcatgccacaatggccgagcgctactaaccgggtaggctctccatctcgctcctattttctgtagcttcttgtcgccggtttcggcctttttttttttccaataaatttggcttctcattcttttgggcaaactatttgacaattgtaatttttaggtttggttattgggatgccggcatgttttagtgcacaatatccattttctctggatgggtttgaagtgaactgtacatcattcctcttgccactatattgtgctacctatacatggctggtaaaataaataaattgactcgtagggatttgttgatgtttcaagaataaaaggcgaactggcagattgaggcagcacctatagatttcactatttttcagttgaagttagggcctgtttagttcgcaaaagaaaaaattttagatgtcacatcggatgtttgaccgaatgtcggaaggggttttcgaacacgaatggaaaagctaatttcataactcgcctagaaaccgcgagacgaatcttttgagcctaattaatccgtcattaatacatatgggttactgtagcacttatgattaatcatgaactaattgggctcaaaagattcgtttagcgatttcctctctaactgtacaattagtttttttaatttatatttaatgcttcatgcatatgtacagagattcgatgtgatgtttttggaaaaaaaatttgggaactaaaccacagccttaataccgcaattggaggggggggaggggggggtagggcccgatgaaggacgccttcgttgaagacgttcttgatggtgcttctcacctgcggcagccaccagagcttcacgaggccggaccatgcgatggtggggggaggattttcggagcctgagtcgtgtgttctgcacatgcagtgaggggtcggtgcggaaggatgtggtgatgatgcgtgaggcgcgcggagacggcggatgacgtcatcaacaagttggtgccgggggttcaaggttggtaccaacaagatatcagttgaaaatgatgggttcttttctccggaagatgaagatgaagatggagattattatttttacataaaatgaggtggtattaacgtatgattgattgagttttaactattacaaacttgaaaaatagattaatatgatattttagatcaactttcatatagaaatttttcacacgaaatacaccgtttaacagtttgaaaagcgtgccacagaaatcttaatcttcatccaactcttattggagaaaagaacgggacatatatctggtatgaccagtgcctcagtggtgaatccagctcctgggctggtacgggaccacccaaggtaagtgaaaatgcttgtaaaatattgttaccgactaagaagtacatttcatagtagaaattgtcaactcctgacttttgagttatactagaaaaaatgcccgtgcgttgcaacgggtgaagtctattttaatcttattattgttatatggtttagttaagatgaaattcattgtgagagttcgcttggatatatatatttgtagaaaatcataagttgcagttaggagtccaatcatctcaagttagcatgtgagttattttaaatagatttcttctgtattatcaaaagtaaacgatcttaaaaaccgactcaaatacggatatttatttccaaaagcaatcgaacttaaaaaccgactcatacacggatgacataccaaaataccgataaaaacatcttcaacttttataatagtagagatttggcccattctaaacgtagtattgcctttggattattcgcatatgaattctcaaaaaaaaatccgattttgccat

SEQ ID NO: 64272 - DNA, 1083 bp, Oryza sativa
ccacgtggtcacgtcttaacatatatactcatatttgcatgcataggcgtggttaggtgcacgaatgaaagaaagatcgtcggacgggttcgcgcgactgtctactagcgaacattcgcgtactacacctctcgggggggagggggggtggttcattatagtagccctttggtagagtattcaggccggcatcctccccttggataaagagccaccatatattgaccgttcaccattgcaataattttttttaacgattcgccgttgcaagttggcatacgtgcagcagaggacatgggtgctgctgcgctgtactgtgtattcgatagggatttggtacacacggatttggcaagagctcctgtgtacgtagctatctcgccgttgatcgctcgtatcacgttgcaactccacatggtgaacttaaaccgattggtatttgctcgcaacaaacccacgtcctacatgatcctccgcgtggcacaccacgagaaaatcggcagaaaacaccagtggccaggcgaagcgagatggaggccaccgcatcgatgttgcaggcccgggactggtcgtctctcccaacggacgtgcttgtcttgatcctggagcgcatgcggtggtcgactcacccgagcgtcgtgttagtgtgccagcaatggcgctccgctgtgtcgctgtcgcccttctacccggcatggatcaccccactcctgctcaacaccgctgacatcggcaccgccaatataaggtactataggggagtggattctaatccctcgaggggatatcctctcgtatacctttttcttccaaattcgatgcaaatagttgtgaaaaattctaaaaaaaattgacaatgtagagtataatgatacctactagtccaccaaaattcatgttcaaatttgatctacacatcgagaaacaaaaaagacaaatttagatataaactgtacactactattcatacgctgaatttgtcttttttatatctcgacgtgtgagttgagtttggacttaagattttgtggagttgtatatatgtgttgtatgaatgttatcaaatttttccagaatttttca

SEQ ID NO: 64273 - DNA, 1800 bp, Oryza sativa
attttaatatgagatatgacagcatagtagggatgtcttgtatggtttattttggaaagggatagagtaagggtgtgtttagttcacgttaaaattgaaagtttgattgaaattggaacgatacgatggaaaagttaaaagtttgtgtatagaaaaattttgatgtaatagaaaagtttaaagaaaaaattcgaaactaaactcggcccaagtaacgatattacttagtatgaagtagtcggatgtttgatgccatacctttacgcgtcgacagcagctagccagtggcctagtgcttcgcgctgcctcgccgatacacttcgcgctgccctgtgtctatttattggaactcctcgtcgtcgtgggctgaactggattcaccaagcggatgagaattggatatggaatcggacggatagttggtgtatacacgttttcggctatgatgcgctgatagggcaagctaggtgcgtgtctgtgtctgacacggatccagtgtcccgtacgtatctacgaggatacgttaggtaaaactccaactcttaaatttagcttcacagattagggatcagtttagcacagctccatctctagctccaactctggagcttgagtttaaccaaacagatttaactccacctaaaagaggagtggatgtggtttaatttgcatgtgagacgagaggagccccgtgtcacttaggggcaggggcgacacgggcggcgaccaccaccgcctcctcctcacccccgccttactccctcctccgcttcgttgtcgcccaagcagacgccggaaaacgcacggctacaaggacggggcggggccttccaactccctcgaggtcgcggggtcagtgctcatgaccccggccagatcaaggcagcgacggtgtggctgcgtcgagtcgtcggggtgtcgggcagggcgagcggaggcgggctaggtgcgggggtggcgacggtgccagactttgtgtccctcgccagatccgggccccactcggtctggccaccctctcgcggacaacggcgacaaccaaaggtggaggcaaggaaggtagatggcaggcgccgaggaagagagcagcggcgacgacgaggccagatccacggcgggctctgccagatttggagccggcgaaggtggaggaaggggaggatgaggtggcaggcggcgagggcgcagaaaaggtggcggtggggcggcggctactgcaatgggcgcagccagagcctgccagagctagcgcccctcggacgtagtagggggcatgaggtggcgctgaaggcgccgtcgcgacatggcggtcatggcctcaagcgcgcggcgacatccatcacagttggcgacatgcaggggagttttctaggcgctggcgtcggcttgtgctccacggtggcaaggcatcctcttcttcatgcagctcctcctcctatggccagctcagatgtggtcgcggagagatccatggggaggatggaggcggtgccttgcagaggggagtggcttgacggcgttcaaagcgacgttgttactctgccggaactgtgggcgatggcctaggcctaatcgctgaagagactatgtagtagaccggcgacgatccttcttgtgcggattggtgtgtgggtttggacgggtaatcgctggcgaaagcctcgccgggacgttggccagctgacgatggcaatgccttttggcgtcgctcccctcttggaggcgtcgttatggcattgacccctctcatttccttacccaggcgcggatctacagtatagtcattggtgtcaggcgaca

SEQ ID NO: 64274 - DNA, 886 bp, Oryza sativa
caaacccctaacacgtcggcaatcctcaaaacacctttgagcctcttgaactgcgtttctcagttctggcaaccacctttctgataccatcttttcttgttcaccagctaatttaagacagtagttggccaccctatataaaggaaacatcagtagccattcttgaaacgtagtaagctggaatatagattcattccaccaaatataagatattcaagaccaataaaaaaacacaggactacttgtgataaacaagggcatcccaaattgcaattcctggattgttttagatagacatcagctgcacaataattttatttcactgcgtatcagcatactaaataacattttgtggacttgtcatcaattcaaaattaagaacaagtcttcagttcatgaatcccaatggtacactgctcaattggtaaatgttacagctgccacatgcattacacagtgaacaaaatgtatttgaaacgcatgttagaattcttttcaataacaaaacccctacttccaagagaaaatatgtactgataaaaaatacccgaaatgaaatactattttctgaggaacaaaattgcaggaaccgaacaagtcgacagaggatggaagggaatacaaacaaacattggcaccagtcctacaaactataccgacaatcactgatacacaagacatctcctttatgttacagttctagctggattcagtaaatatctattgtgaagaaagacaaagattaagtaaaatttcagcgtacctttcatattcctgttgagcacgatgtgctcggttcagcaaaacacgatcattctcaaccagatttctccgcgtgtgcaccaaattaatagcctttgataaatcctctagtatactagcttca

SEQ ID NO: 64275 - DNA, 719 bp, Oryza sativa
caatacaagctaatagattcgggtactgttagtatcatagaatgcacaaacacattataagcaccatgagaatttcatagtcatatttagcttaatcatgaactcaaaacgtaaacatgtttcataagccatgacaatgttatagagattatgcttatctgatattcttgataatacgaaactggagtaccaaattgaagatcttggaaacttgtgtgcatattaccattttttccttttttttagagaataaatgttatgactgctgctttctcactgtaagtattaatattaatttggaaggaagcatcttaaattaaattcattacaccacagtggaatcttgaataagtacctccaagtgtctgctgttagtcatgttctgtgaggtgttcccagtaggcatctttttacttcctgccgcatcactagtgccatgaaggcgttgcaagagcttctggcttttagctttagcttcagcagctttatttaaagcatcttctgtggccaagaattgctgaacatgttctttctgcaaggtaaataaatgttatgtggaagttaacttcagtgacatgtacttcatttgaggtggtaggcataaggcattaacacagaattttactagcctgtggagaaagaagagcttgatgaaatcatgcagcttctttttttttatcaagaggaaagaaaaaacaatcaagtgggctgcaggaatt

SEQ ID NO: 64276 - DNA, 719 bp, Oryza sativa
tttattttaaaatatgaaattacgattgacataccattcttttttttatatttgtatagatgcattagtattttacatataattattttgattagtcaatatatacagttataatctagacccaccatgattgacaatactgggccttttgccccctctgattaatgtactaatttctaattcttggggtgaaaattgaaaatacacggcagacatatgtagataagatagacaaaatgatagatcaattgattaagagaaacatgtggatatataccaacgataacatataattggttagaacacgtggtaggttttcttataaaatttgtagaacccagtttaatttatttcttttgtgaaatccatacattagaaatcacttgtaatcgttggacctatgtcgatctcttgagcatgtgctaactgctaagggtgcgactgtggcaaatgtgtgcatttgtgtctttcatttaatcgtaaaacatactttggcaaaaatggatatcctggtaagttgcaacaattaaaagtgattgaaatggtcatgtagcggttgtcggtgctagaatttagttactgttaagaataacttagatttaaattcaaattatataattttttatatagtgttatgaatcaactgaatgtcggttcgtgttcctatttgttactgcaatgttcctttattttacaaccacgatggggctgcaggaatt

SEQ ID NO: 64277 - DNA, 6034 bp, Oryza sativa
ggagcggcggctgcctcccatgccaggggttgggccgccccaaccccctccacgctctgtctcgcgtgtgcggcttgggcgggtgctcccagcgcccacctaccacatttattaaggcagcgtcagcgcggcacatcgcatttaatgcgacgtgcaggcgcactaaccggccacttgcggccggaatgaccgatgtgacggtagccagggagacctgcgcacgcacctactgctagcaagggacgtggcctgcgcccgccctgtctaatcggctttaatgaggggctttttgccttgcatttgagctcggaccagttcttctcacaccagtccatatgagagatcaccacccaacggtgggaacgaacggccggacgtcgtcgataattaagaaggaatgacacgagcgttcgcccgtgtcgctcggcgtgatgggatgggcccatgccgcggtaaggcgcgcgtggctccacacgtcggaagacaagacaagcattaattgcatgtaaagaatgttttctttacgcttgaagctaggttttggccttaatttgtggtaaccccttaagatataaaaggaggtctatgtcctagtggagagagggacgaatcccagagaagaaaggcacttttattctcccacctaaatcaatcacacacaggagtagggtattatgcttccatagcggcccggacctgtataaacctcttgcatctccatcactctcgaggggcccgaccccctctacctctctctccatcaactctcagacctacaaccgtgcccctggaccgaaccagaaagggggtccccacggtcccccgcttgaggagttcgcccttcgacacgcatggtaggaggacaaaacaggttggcatgggagaggatgggccgggttgggttggttggatggttgggggggggggcaggatttctaacatttttgacattcttgaattttttttataaatagactcgtagaaaaacttatttcaggagtggctccttttcacggcgccagtgtgattggtgccatgatcaagatgacgactccaatgtcattggtgtcaatgacctatttgtaaaaaaaattcaaaaataattttcaaaaggactaaaatgcaaatatatttcttccaaataggtcctcgacttcattggcgccgtcatccaatatgacaacgctaatgatgctggcaccgaaaaaagggtccatcctagagtaagtttttctagtgtctatttgcaagatgaactcattcaggtaatttgataaagaaggggaagaaaaaaggtcatgcagtttggtgctgaagaaaaaaattaagccgttgatttagtctgagggggtgtaaaatttttgtgtgggaactaaacagggcctgaattcgaagaagaaaataatgattacattgaattcagtgaattcggagggaaaaaaaggaagtttgaattcagcagttagtctgaatccgaagaagaaaattagtgagttactttgaattcagtgagttcggaggggaaaaaaatgaaagtttgaattcagtggttgatttgaatccgaagattaaaaaaaaagaaaaatagtgagttactttgaattcagtgagttcggggaaaaaacgaaagtttgaattcagtggttgatttgaatctgaagataaaaaaagaagaaaaatagtgagttactttgaattcagtgagttcggaggaaaaaaaaaacgaaagtttgaattcagtcgttgattttaatctgaagataaaaaaagaagaaaaaataaaaaaaaatcacttggcttcgaacgggagaccttcagtgtgttagactgacgtgataaccaactacaccacgaaaccatcttgtgaagatgatctttaccaacgtaataattgaaaattttgtcaatacttgtcaacaaagtttttttttcccgtgcgtgccgaccttttcctcgtctgaatggttttttctctatagatgagcggagcatgtgatgagcgcagttgcaaagtttgctgtcgtgtgtaggaaggagggcatcaagcagctgggagctgtgtcgcatggtgcagatctggagcaagcacagccaccaacaccaatactactctttttttctttttttcaccttgtcctgttcagagaatccactgttctttttttcacctagccctgtttagatcgcaccttaaaatttttcactcggtcacatcgaacgtttgaacacctgcataaagtattaaatataagctaaaaaataattaattgcacagattacgactaatttgcgagacgaatcttttaagcctaaatactctatgatttgacaatgtggtgctacagtaaatatttgctaatgataaattaattaggcttaataaattcgtctcgcagtttataatttgtttttgttattagactatatttaatacttcaaatgtgtgtcgatatatccaacatgacacgtcaaaactttccacccgtggatctaaacaacccccctattagtgcgtcagcgcttgtggattctgaatttcattggactaaattttccttcttccaacggcagcgaatctctgaatttttgctgctccgattggttctacgtgttgtcctggatttttttgttggctttactgtactagaggcgaacgcgcgcgttgcgcgcagcacctgtcctgcaatattggatggaagggaatggattactgttgttccgcatgtatagtttggaaggtgtgacagagacggtgatgatattagcgttgctgatacaatgcgacaacaatggaatggatagatggtcttcaagctgtactgatgcttttttatacggaataagacccatggcatcagaaatggaaaagtgaatacacagctagaagaatttgcttttctggttgtttttgttgatagtatagggaggaaataagtgctctgttgtcatgtataatggtacaagtggaattgatgactgtttccatggtatgagggctaatgtacgcaatgaaatagaatgatagttctatgaagatcccaagttcctgggcccaatcagccagcctataattaagacactgatttgagcatagtattttgctgcaggaaagacttgttagcttgatgcatccaaataagtgattgcggatctgtcacacagagaaaaataaagaacattcaacaacagagatcaatcctactgtaatttaaaatgttaactgacatgcattatagagcttccaacaaaatctgtacattaaatcattggcagataccttgccctatctatgatgtacaaacaaatcaaattgaacctctagcagaatatcaacaacacattatattgatcattgatcaacgtaagcaaatttcaatagtaaaaatctgaaatcatgagcaaatccaggggaacatagtactgaaacatcaaaaaagatggaacattcacctttatttcattatcctctctggtaattagcactgatgaactgttgagccccattgatgcatcatgacttaagagcaaacacaggtagacatgaaatgatcaaatttatatgcctagataaacgaagatgtacaccaaattttaataagcaagcatgctggtaaaagaaaactaatatagcagagcaaaaatgaaaatcccccttttttcctatcacaagcaaaatttaaggaacaaacaaaaaacgtagttagtcattccatattagtttgtaatagcaaaatatgctaagtgttacttgtattttggtattctaagcattgaaatacaatctgcaagcaaagtttatgttctggcatgactgagaagttgaggtacggaggtggcagcagcactactaccctttcaattggtcccttattgtcaacaataaacatgcctcttcataaatttgttttctccctacaactgctatcagcacacatgtactgcattgccctatgagtggtgcctcttgttctagaaattgttacaccatgcccactttgttagttatgcgcttccaaatgtcaggtgctgacactttcagaaaatgaacatgaagcaaagtcatgtttggaataagcaaaataagggcaatagatgtaaaagatagcggtgatttctagagtattaagggtttaaggtggggatttctaccagatcattttaagagtgcccctggatttgttgagtttgttgcctggttaacaacgataattaggcatgacattcatgagttgttccactttgttaatcatacactcaaaacacctaaacaatctatagaaaattaaagcatgcactacttaacactcgtcagaggattcttaaaatgtaacggaaagagtagtaattagtttagcataatatgtaataaaaaattaagcacaagaaaggcacaaaattaatttggtccattccccagaaacatatctattaaataaaaactgaatgaggcatttaagtgcattttaagtctctaacaatttctaagaggtgggatcctggttatcacctgtcaatgttacttagcataaaaaaacctcagtagtatctgcctgtgaagtgagtattaagccggcataatagcaagaaacctgcaacctttctttaatagcaactaataccaaaaggtaccaacattatcaccggctttttcaatcaacaattcagcaccataacaccaggcctaatcaagcccttctcatgtgtatcttcaactaacccgcagacaagaaaaaacacgcatgtcagaggtacggttgcacacatggtttatatatgcttgctcacataataaagtgtggtgagatgttacttagaagtgggatggagtataatcaaagtaaaacaatttgttctagaaaaatatttgctccaaaataactaaagtgaaatcagtttcagtcacccaagagcagtcctgtagttgactgatcaagggggaacgaaaccatacatgaatggaaaaatgggggaaactgctctaatatctgtatggagggacaatacaatttttatcactcaccatttatgttctgatcaaggagcatgagcaaagaagcattagcagcttaactgtccgccaattttcttagccaagtgcattacaggaaaaggaaaagaatatatttttcccctgcaatgttaacattagacagcaggcatcaatagaaaatcaagaaactatagtggtgggttgcaacactgacctcttccattttggtcagacaatcttgcagagtgcctggactatgcaaatatgcaggttgcagggacatgtagctgcagctggaagcatagacagatttgtgcattgtgccggaaggatgccagtgttgttggtgcatgcctgcatggagaagcagtgccgatggccacccatggccgcaatgagcgcgttgtcctcgagacagacttctacaccgccaggttgaccttgtcgctggccactgtcacctctaacataatttccggcaccacacctctagatcggctagtttgcgatctagcaaaggaatctgctcccaatcccaatacatcaccagcagaaacagagaacatcatatgttgctatttactggaagaaagcatgcaacaaatcaagcttttgtaccttgtcgatggctgatgttggatgcgttgtcgggatgtagagactgagatgcggatccacacattgttccgctcaatcgtgacaatccccttctggccaccaccaaaccgagtgctggagagtggaactttccgtgtggagctcaccgctgtggaagaacaaacgacgtcgtcactatcgatctgtggatctcaccgatgtggaagaactaccgccctcgttactaccgatgagcctgctgtggtaccgcttgccgtcgactccgggtgaccagatcggccggcggggacaccgtggctgtcggatccggcacccacgacctccccgacgagcgggcgccggcgccggcgtagcaaggagagcgggaggcaatgacggcgctgcgaggaaagcaggcatcgacggcatccccttcgagcgggcgat

SEQ ID NO: 64278 - DNA, 1252 bp, Oryza sativa
cggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcgaatggtgccatctgcagactagcttggtaactgttgttgtacgagaactcagcatacggcaagcttttgtcccatgctccaccaaagtcaagcgcacaggctctcaacatatcctctagtatttggttgacccgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacatgattcttgctagatagagttctgctaatttctttcctgagtaggtagtgtgcaccggaatgaagtgagccactttggtgagtcggtcaacgactacccaaatagaatcatgccccgatgacgtcctgggcaaaccggtgacgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatactgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcaccgcatagttcctctacccatgcgacgttgcagtaactcttcctgctcaaggcatctgctaccacattagccttgccgggatgatagtgtattcccatatcataatctttaattagctccaaccatctt

SEQ ID NO: 64279 - DNA, 11974 bp, Oryza sativa
aattcctgcagccctagtagatatttttatttagagggatttattcactaggtaaagtcctaattatacccctgaactatggagtgagtacgaagtaccccgaaaatcagatatcttttaccctcaactatcaataccggattgaaccccctcctcaaagcagctttgcaagtggtttcggtactacgtggcagtctagtcagcaattcttttattaaaaaccaatgaggctcacctatcggatctctctcctccctatctcttaatctctttcccctctcatacatttctttctcgcgcgcgtcagatgccgaagaggaggcgcgccagcaactacaagtgtctcgcggtggaggccgaggacgagccgcgtgccggcggccgcgagcgtcctcgcggcagaggctgaggatgaggccgaatgtcctcgtggcgagcggcggccgacgtcggacttgcacgagaagatgatggtggtgggagggggagcggcggacggcaccggactcatcttggaatgacacccacacgaacaccctgtcaccggcgcgtcccaccactgcgaggctctgctgcactaccgccatctgcccatcgccaccctcagctccccctccatcgccccgagccgcctccatccccgctccgtcggcctccgtcctcagctcccccctccaccgcctcaagctgcctccaccccatcccaatcagccgttatcctcggctcctcctccgccgccccgagctgcctccgcccccatccccgcccaccgcaatcctcggctccccctccgctaccccgagctgcctgtgctcccacccccgccagccgttgtcctcggctcccctctcggtgatagagagagatggaggtgaggggagggatgagagagagatagagaggggagaggaaaggacagagagggtgggagactgacaagtggggcccagtgattaaaaaagaattgctgactgaactgccatgtaggatcaaaaccactccgattcgagtcaggggataattcgtccggtattgattgttgagggtgaaagatgtttggtttttgagtcaggagccgattggtcacaatttgagagctctctagagacatcatgaaaggcgactggaaaaaaaaaaaaacaccacctctcctagtaatcctagattagcatagcgtgagtcggtcggtcggttcctcctgttttcaagaaagtgtctttaccatcgctagggctatgtcccgtttagcccgaggtcgctagtgcagtcttcatggcggccagccttacaaataattgatcaggtggtggtgggttttagagtcagttgtccagtggatcagactgcctcaacttcgaggcttggtgttggcggatcaacgaggtgagtggttacgtgtagggtgaaaacagtatgtgtattttctgaccgcccacctgactaaggctcactggaagaatgtgggaaagaaaatggtatacccgatactatctaagtttaaatccaaattcacaaaaaaaaatataggttaggatacgaggagagttgtatccgtccgtttgtcccatattatgaaacatatataaaaatctattataaatcaacctacaaacatgataaaagattggttaatcactattttacgaggtcacatgtaattttgtacaatttttttctcaatatatctcctctagcacttaattatattcttatatttaatatctataaattagagatacaaatacatatatgttacccaatcctatttagaggaaataatatgggctaggattcaagatggttgatatgttatccagcgttacctgtaccggtttcgaatttgaagaaaattatgagttagaatatgagaatgccaccgaacccgtccgttttcaccccttgcaggtgctctcttccgatagatctcgcatcagcgatccctccgctcgttggctttgctggtggggagatgcacatctgctcacacattcggccggcggtccaggagatccaacagggcaggagcttgatagcgacgaatctgctatctcattgacgaacttcgtcgatcggttgtgggcacagaggcagcgatttgtgccttcgtcgtggtgaaatccttctgattcaatacgcaggcaaatgttggtgccttcgtcataatgagatccttcttattcaatgcccgtgttgatctccctggattctttttttgaacttcatctccctggattcatgaagcacctgtttgatccagataatattagatacagtgaatcgtcaccatgctagtgctagcgtgattatgggctgctgttttatgggggtttcttctgttactatcgattgcggtggtcaacaacttaattaacatgtcgattttaccagtgaagtgtcagccacaaatgcgactttggtcagcagggatgaagctagcgctcctcagatttaacgtagagccatggcaattctatattgagaccgatgaagcttataaaaaatcaacaattcaacaataataaatatcaaactaataaatctcaaactgtgctttactctgtgaaggcaatcgaagagatcgccagtttctcaagcggcgtgcacgtttgtaaaggcctctcgatagaatcatcgcggcaacgctggtttcgtctattactactgcacgattgtatttggaagattataaccataacccagctatctttacctggatggctttatttatgtctttatgttgtactccctccagtttataacatttgactattcgtcttataaaaaaatattataaaattattatttattttgtttgtgacttgctttattatcaaaagtattttaactatgacttactccttctatttcacaatgtaagattttataatattcccctcatacatatagatattaataaatttaaacacatgcatatgtctagattcattaacatctaaatgaatgtgggcaatgctagaaagtcttacattgtaaaactgaagcggagaaagtatcttttttatattttccctaatttttttaaataaaacgaagggtcaaactttaccagcaaaacatcaaaacgacatataatttgaggtaacataagttaagacaatgtactgtgcatatttatatttccctaaactcttattaataacgtacaaattaagttattttttttagaaaaaagaaccggcaatggggcaatatcacgcggggagaagcaaggtacgtcccaatccggggcagacttcgcgcgtgcgttccgaattttttttatttttagatttttttaaaaaaaatatttacagaaataatctatcggccaaaaaaattgcaaaaatagaccctgccgcccacctctggggcggcaagctgacgtggcaaacgggggagggacgggcggtgacggagggagggtttttttgcagtaaagcccttgccgctctcttttggggcggcaaggggcccgaatgcaaaaaagctagtcgaggccggtcattttgcaggcggccccttgccgccctctggccgggcggaaggcctcgctgcctataaaaggcctgccgcccagcccccagccctcattcctcccctcaaatccagtgaaaaaaaacaagaagaaaggggaggagaagagaagaaggggtgaagccctgccggattcagacgccgatttcaggtaatattcatagatcctatatgtgactattgagttaaatagtgtattttttaaaactttatttgaataaatacattatatttttagggttttagttgtactaatctagaagtgcgtattgtagatattgttaactatgtagatctgctagtttggaatcaatacttttccgttgcattggcatacacaagaagatattacgttgtagatgtttattgcatgaaagagtaatatgatctagttattttgttgacagatatgtcgaacaaacaaatattccaagtttaccatggcccaggaaacgtctgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacacgggtggcctctagctatggttccgtttgttcacccgaaggatccatgtgtgcagatgaacatggatgatggcgagggaccaagtgctgaagtaaatgagacttctgtggaggaggtcaacgcacgagaggacgggggtgtagtagctccagtgggcattcaaccaggtgtagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggttggtcgtctctgaagaggatagtgtgagatgggagtacaaagaaaatgagattattcaggaagcgatttatagtagagcagaagatatgaaggaggcggtaaaacattttgcagtgtcacttcatagagagttttgggttgccaagtccaaccggtcgcaatatgaagttcggtgtgttaaggaaaaagatggttatccctggagagtgcacgtgtataaggggaaatagaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagagccaaacagaaaataatagagatgagatttggaacttacgaagcctcgtacgacaatttgccacgcctgcttggcgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagcaggtactggttcctgaaattggttaaaacaaaaattgttggtatgaggccaaatgtgtgccagatacatgataggcacgctggcattctgcgagcgatagaagagttgcagtttgggaatatggaacaaggataccctggtgagtgggaagatgtacagagcaggtggtgcatgcgtcatatgggagctaatttcttcaagcaattcaagaacaaggagctcatgaacatgtttaagaggctatgcgatcagaaccaggagaaaaaattcaatgagctttggaagagattagatgagttgacagccaaatgcagtgatcagcgtgcagcggctccatcaaccgccgatgctgaccctccttaagctcttggacctctcccaacggatagtccaacattggttagaagaactggattggagattcggaaattttctcagtggattctgcatgaaccaaaagagaaatgggccaaggaatatgacacaggtggtgctagatatagaataatgacaacaaatttggcagaagtttacaactaggtgatgcgcggtgttcgtggactgccactagttggcatagtggagttcattttacatgggacatgcaggtattttagggatcggttccaggcagttcttccctctatgccgaacaacagcattttgtttggaactttcatgcagaaaaagctagaagagttgcgtaaaaaggccatgaaacatcgagctctagtgcaaggtacccaacagcacaggtttgagatactatgtcaagataaggcaggcaggggtatctaccgcaagagagtgaagcagtagtgtgttctcaaagccgacggcacatgtcattgctcttgtgcaaagccgaagctgctccacagtccatgcacccatgtcattgctgccgcagcggagtgtggcataccagatgcagtatatgtttcacagtacttcagtaagcaagcaatatatcatacatggagcggcgagatttatgggttcggcatagctgggtagttcacagagactaacgatgaagtactcaatattcctgacacatcgaagctccgaggcaaggctggaaggaggaagactcgtcgcatccgcaacgatatggacgagtcggaggctggcagggtgaagcgttgcagcaaatgcgatgaacgtgggcacacctacaagcattgtcctaaagacaaggagaaacctagtgcggcagaggcaggactatcaggatcaacagcagatggagctcgccctacggatgaaggcactacctccactcgaccacgtcctaggcgtcgtcgtgccacgtctggctacatggtgtagttcttatgttctatgttggcatgtggctttgcttgtaatttgtttcgaacttatcgatgtgtttatgtttcgtcgtgaaatgtcagacttcggcatgtcatgtctttaggtctcgtgatgtaacgtcagactaaggcacctagtgtctctctttctttctatctgggcagctgagaggattgcgatcggccgccctgaggtggaccagcacgcgtacaaggagtcactgtacgcggagcgaccagaggtcgactaccctacgataggtactctgtggtgccgtcgtcaggtacgttgcatcgatcttctcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacagtctgcaccagggaccaggcgtactggatgactacggttccgatggtcttcgacatctgcgttgagcctcatgcccctttccgcgtgatgcggcagttcggcttctgtcagccctttccagtaccgtttccgacgaccgtcccagctgctgttcatcggtaagatctttcactacgctttgagttgttgcattaaaatctacatgtccataataatttgcaacatctgtcgattcacactaatatgacacattaattcgcaagtactcgcgcaagggtcagcagtcagctggcgactggcccgccaagttggcgacttttgttgaggactggttgctcacaaccgaggaggtcgtggaccacgagggagagccacacactgaggaggcgtaccaggcctacctacgctggtaccagccacgtacccgtactagggtcaccttcgctcccttggagcagcagccccacgttgcgagcactagagacctctacgccaggcaccgcgaccaggacttcgctcgtgctgtgagtaccatgcatcgcaccattcctttatgttttcatgtctttctcttcatcaaattttacgaatatgtacgaaaaaattaaccaccaatgtttaggcgcggggattccggtacccgtagaggagcacctgacgacatacacgcggatggtggagtcgatacgctcgattctccgagtgctcacatgtcgtgcagatgacgttgctcgggcagacgcagctgtacagcggccacccgtaccgactggtccccgtccagctatgcacgttcctaggccgactccccctccgcacggaggtaagtatttttaaggatttttctgtacatgccttgcacatatatgtgagccgtttcacttgccgattgcttcagggtttcgtgcaccgttcagcaccccgccttcctcggctaggccctctgttgtgccccccacaggtacttaaaaaaacaacattacttcgacaatcaatttacatgcattttatgtcttagcttacaagggtcccgttgtccatgtgtaggtttcacccagttcgctatgacgcaggctgcccacttctcccaggctgcagcgtcagtgtctcaggcagctgcgtcgacctcgcactcagtgcagttctggcagtacaccgggacttcgtcacaggcagccggcacgtcgagtcagggtccaccactggaccatgctgggacctcgtcggaccacttgctgccttccaccttgctcttcgacatcactgacttcgatttcgcttcaggctagacagaggatgtcatcggcccctcacagctgagaggggcaccgccggtgcagacgcaggaccaggcgcaggccactccgccgccagacactcgtgctacccgtgctgtgccaccggatcgtttcacctactcccaggaccacgtgcgagcacaggcccggaggaccaagcgtggtcgcggcgcggggcagggccagtagagcagtcttctctttatttatttgcttcactttccagtactgtatgcttgtgtcatgactacgttgttgttatatgtgcacgatacctttcggcgcatgcacgactactttctgccgcaccgatgcagcctcctttattcgcgtgcgatacgagtatttgcccaccatttgccgcatacgaccaatgtaactttcggcgccgatcaggcatgtaactttcggcgccaatcaggcgtacccaccatgcctcgccacgttcacatgtcagggatatcactcgattttttgcgcctatataagtcgccttaacgagtgaggcctcacaatctttcagaactcagtcacattcagtactctcttcccccacttgcttcattacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatatttgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcctgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggatgcccatccaagatgcaggtgtggtgatcgtggtcaggttcttcgttccataaagcctacaacattgggtcgaaggttttttgtttgtccaaatattcttgacgacgatttcatggtaagaatattttgattacatgaatccttattttctcacaacatttactaactttgctcgctttacatctattctttcctcctaggaaccaccaaggagatatcaatacagaaaacggatagacaccagaagggttctaactccacctagccgtgttgagcagcttgaaactaccagagcaatatagggttactaaagcgcgttttgagagaggagagggatcctcacgtaggggttagctattatcggacaacttggcatattgaaatttctactgtcatgcttccttgtcccattactacatcgtcgttatgttcaactattgcactacctccctcctagttcgaatctaatattatctatgtaaccgcaatggaaatagttgtatcatgttcaaattgtactactatttcttcatgttacataattctccttgtttaaatccatataatgtttatacgaccgaaactgcgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggtcgtactttttgcatctgggtcccttgccgccctctactggggcggcgaggggcccaaatgcaaaaagtacgagggcaacctctttatgggcggcaaaaattgcaattagccccttgccgcccagggtaattgcaattttggccgacggcggcggacggcgcggtcgacccgccatctgccacgtcagcttgccgcccaccactggggcggcagggtctatttttccaatttttttggccgatagattatttccgtaaatattaaaaaaatctaaaaatgaaaaaaattccgtgcgttccaactacttgggccagaaccaaacgctaacccacagtcgaattagcccaactttaataggccaatacgctagctcgggaaggggtcgaaaagtccaatttgatcaaaaagtgtaacgacaccggcccacagtcgaagtggcccagttggccaacgcagcccacattaacaacgccaaccccaccagagcacgcgctgcctagccccaagtcccccaaccctcgccgccgccgccgccgcctcctcgcccccgaagcgtccccgccgccgccgccgcctccccgtcgggaaggatgaccctgtccatgaagccgcggaaggtgctggtgcggaaggcgatgaaagaccgcaagaagaagaagggccccaccaagcccaccccatggaagtgccccctctgccacgagctcttcctcggggtgcgcgagggtaaccgccacttcgaggagtgcgaggcggcgaccaaggccgcgcgcgccgccgaccagaggaagatggacgtggaacgcgctcgccaagaggagctcgtgggatccaaaaaggccgccccaccgaaggaaggtagagtctcgttttcgttcgcgttatttgcatcgcaatgcatggatgaatgaattagactttctggagaacaatcccgcaatggatggatgaatgaatgaattagactttctggagaacaatctgataaattaacgaattgaacccgcgtagttttcaggctatgaaaactttgctgcgaaattcaaacgaatgttccccaacatagataggaattccatgcagacatttttgacaaatattagcatgctgggtgtataaaatatatactgcactgagcaaatcttaaaaatcactcttttcaagaccttacatagttggacgcacctggacctgctgcaaagaattactagtgggttatatctgctgatttgttttagaacccatacatttacctttccgtagtacctggcaagcttgtgcaacacaaatttgcaaaccttctcatcgaatttgacttgcaaataagcctttcgtgccacctatctatagaaacacaattttcttcatgagacttatttttattatcaacataatgtggcatacactatactctaatggctcaagaaatcgttaaagaccatgcaagagtatcagagcaactttacatattgccattactgtgcaaatggaaaaaataccgttgcttaaagtgctgaaaatatctgtgcattgtgatataaaaatcaattaaaagtacaaaggcactcactattagagttcaatattttatctccaagattcagtctcaatgcacttcacaatggtattgcactcccaaacactttgcgttgttgaggagggctgcaggaat

SEQ ID NO: 64280 - DNA, 22138 bp, Oryza sativa
tgcgtgggcttcctttccagttttaagttaaagtcacccccacatatttccagtaataaaagttacatacataaataagattcccacgcaaaagcatgggctaccttcctggataactaactatatctataagttttgaacttataatacttctgaaattttgaacttctgtaaattgaagcgaattttgaacttctgtaaattgaagcggtgactaattatatcaattatatcttatctgcaggtatttgagagagtcataaagatgtagaaaactctagaatcaagttagcgaaggaactatcaactaagtcaggttctatgacttttgactttgatgttatggtgtgattgggatttgtaatatcatgcagtaccacacatttatcacagttacgccgtaaccttctgagttttataccagtcaccgcaatatcgtgaaaaccctgggtgtgatgttatatactcctttgatatctcgctacatgttttttccaaacctatttaagcaatactaaattcccaattatgttgctttggttataagcgtggtcttaaaaatacaatgttgaccactaatgtcaatcatagcatgtttatttgatcgatctgaaaaacttataactcctaaccgaacttacacatgggaattttttgtatatacgtaatttaagtagataaaccgaactgaaatacctatgttcaaaggtttagagctttatctaacacatacctaatatgatattaaggataagagcagatggctttgatatagagagaacgccataacaatcagcacacctgcacatcagaagatagtttagtgtgaagtgcagtggaaaatagctcaaacaaaatcaacccgcacagaatcatgtgtaattttaaaatactaggacaaatcaattaagcatccaattgtggcgtacctttactatttcattaacttattaaaatgctgaaggccagaaatgccaatatggaacaatataaacccctcaccagccaccagactaatgagtacccctttagccccagggaaataataggggaatccacaatacgttacaacatcttcaacctttcaagcacatcgattcaggggaattacatcacatatgagcatggcaagaaagccatgctaaatccatcttaacaaaatatttttgttattacaatttccacatgttgctgaagatgaattggctaaagctatgtaacatgacgtgattcaatcacttacaaaatgcacgttaggatgtcatatgggtacttattagcatgctagcctcctaagatcccagtctttcttttatgctcttaagtggaacaaaaagacatattggttcaatataagaccattaggcctataagactactactatacatataatagtgaagtgacccgttttaaaaattaggcttattcaaatacgatacatttgtatcatgactacatcagcaagaaatagacaaactatatttgcacataaaaatatttttaagaaaaaatataaaaacaaaaataactagattaaattttagaagaccacaggttttgaggcacgtgtaacacaaaacctcagatattacgatttgtttcaaggaaacccaggttttgaggtatagcatttcaagaaaccccatgtttatatcacatactgataattctattattatatataatatttttagtatatgtttgcattggtatgctcaaaatacataaccatcccgtgtacttcatatttttccttacttttgcattgtacgattgaataaacacaaccatactaataatgacatattaaccggtttacttatatagataaacattaatcatattaccataataatgcttgtaaaaatgaggcaaacatgcatatatatactcactaatatctcgttatttttttgcaattaatatgcataaatatattagacaaataacaatataagcttaaacatgagatttcgtggaacatttttccccaaaacctacggttcttcatcacaaattgtaatgcatgatgttttgtgttataagtgtcacaaaacctggggtttttgtgaaatttactcaaataactacatttttggctatcatagaagatccaatggacccgtattgcattgcgttggatgcaccgtcaccaagatcttgtttcataggaacaaacaaaaaaatagaacgatatttttcattgagaccaccttccccaagacaaaagagagaactaggaaatgctagactgtacgtgctacaatcgtgttctgccatctctaatcgctaagtagtacgtaagaaatgaaagtatatatgcccagttttataggataccgatgaaaatctgaaggttaactgaatgtaaggatttggtcgtaagggcctaggctaccaaatcatgacctaacacagaacatgaataacaaatagcttgacagaacagatcaaaaaaacaaaatgccaataaaggaacaaaacggcggcagtcaaatgcagagaacaagaaaataatttgtgacaaatgaagcctatcatcaaaacaataaattccacagtagacccaaacagagtgtcacccattaccattagtgtagtcgataaattttcttctgaagaagatgagaaaaatacatatattgtaataataaacacgtagaaaacttgagcacaacgcctcctgccatggctgataacatggatagccagatgaaagggagaacatcatctcgtcgaacccaaatctgcacataaacaaaataataataatttaccggatatgaaaggaaaagaaaagccaaactagttgaaacataaactaaggataaacttgaagggtcaagtgactttttcagagtaaaagaagtatactgtgaaacgtatgaccctgcgacttgttgagtaggagtgcattgccaaatactggaactgaatctcccttctacggttagctcggcagagaggggtagaccgggcgggtagtccagatggcttagatctagtctctccgttaaactcatcaccgcaataccatcgccgggagccgatttgcggcggatgcaaccgccggcaacggtgccagccgaagcccctggcatcgtctcgcctatagggagctgagccagccaccgatttcaacagatctgtcataaactaacaccgattagaacggatctgtcataaaaaatcattcatctggcggaaagagactaaccatcctgataatatccttggccgtgagaccgagtcagcgccgatagaccggcaaacttccgtctacggccaagtcccaagtcgatctggctccggacggatcatctagcccggggtatggatcatccatggatggacggcgacaaacgcgcgcggccaccgacgcacccggcgccggccgccgagcccatgtagacggctgagagttgaccggcgctcaggactgccaccggcacgcacaggcgccaaggaaccctcaaaccagacgctcgccggagcgcttacaagcgcggagtcgacgtgcaggtttcgtcgggcgggcgagcgggcggcggcggcggtgaggcgcggctagggctcgcggagtcgcgagaagagcacggcggcggctaggagttggagacagggttgggggtggggaactggggattccgcgtctatcgtttcttgacctcgcctcgcgtcgcgtcgagtatggacggtaaaaaacgtaaaactgcaggtcattggaacatgggccacgagtggactcctttttcgggaagcgtcacgtaccttttggctgtcagatggcccaggcccaattagattctctttttcaaagcaactgtaatgttccgctttttcaacgtgctttgtcgcatcgtcatccggccagtccacgtacaggaaattaaaatttccgccgtcctcggccccgtcacgctccacgccgcgctcgccggtgccggcgtgacaatctcacaatcctctcgagccaacgtacggcgtgctggtttacggctaggagtggacagaaaaaatccaaatcgaaagaccgagaccgagaaattcaatcatcaattcggctcccctctcctctcaggtccaaccgaaggagggaggggggatggcggcggctcccctcccctaccctcccagatctagccgaaggagggagggaggagggtggcagcggctcccctcccttcccctaacagatccagccgaaggagggaggggggagggtggtggcggcgggcagcagcagtgctgggacggcggcgacggcgagcctacgacgacgatgacggcggttgttgatggtgcccgtcgacctcgccgtacctgcacgccggttgccgtctacaatttgttgatttgttgctttcaatttgtatattgtggatttcttgtagatgaacttgggaatctataatatatgaatttgtattgtggatgaaatggttgattgtgtgcataagcttgggaaatctgtctaagatttggatccaatcccagaattttttgagtttgaagctgggatttggatcccttgtttcttttttttttgtttgggaaaaagggttttcactagcgggcctcttaggctaacggatgtaataattaatcagatcttcgctagtggtgcctctaaagggaccgccaaccaaaatccgttttctctagcgggcgtgttgcgctagtgaaaatcattatcactggcctttggttacaagcggctagcaaaaccgctagcgaaaaaccaattttggtcgccaggaaaaatgcttttcatagtagtgctagctcctggtcggacgtcggccgagtccgggtacactgaacacgatggtggcgatgcgccacgtcaagtggtagtgcgggaacatgccgtacgcgcgttggtcatacggtctggttggctgtgcctgacgcacacgtgatctctgacatgtgggacagtggggtcatgtatctaaggccgtgtttagttccaaaatagttcttcaaacttccaacttttccatcacatcaaaactttcctacacacataaacttccaacttttacgtcacatcgtttcaatttcaccaaacttctatttttgttgtgaactaaacacagcctaacttgaggaataggatttcaatccacaccggaccgaaccggcactttggcagtgggccagtcaagtgaacatggaggaaaatgctgcacggtgaggagccagctgaggagaagtgtagcgccttgcatggtgttgcaactaaggctctcttcgttccccagggttcacaactccccacactcgttttccacacgcacgcttttcaaactactaaacggtacgttttttaaaaaaagtttctatacgaaagttgctgaaaaaaatcatattgatctatttaaaaaaatagctaatacttaattaatcacgtgttaatgtgaatatcgttttacatgccggggaggaggggttccccaacacagcctaacctgccggacagcctgcagctgcatggttagcttgcttgccctgtgcgtgcaagcgagactgcggtgtgtgggactgtggcagtggcggcgtggcggcgtgcgaggatacgatgcgggcatgcagctgccccttcacaaatcacacaccattggagtacactattagagcgttcaggttcgtagtgcatgagtgcatcgagctgtcgttcgacctgaactcttcatgtcggtgtttatgtttgatttgacgccacttttgcgggtgtgcctaccaaattgaagaccgtgtaaccaaagatggtcacccattcttcagccccttcaagggttggtgacgtgggttgtcaggagagaaggcatgaggcacattgtggaggatgtggcttcgctgcgtcgttgcccgcaccacttgggaagggagacggagaaaacagagctcgtctcggtggctgaagtgggagcccgtcgtcccctcctctttcatgtccccgctctacgccgcaccgatcgaggagcttgccatcgtccccctctccacgctgccatgaaaagttgtgcccctgactccgcgcaaccgcggggctcgttgccatcctccgctgcccgccaccgacctcgtcatcgacttctgttcctgcagagagctcaacgactgtcgccttgatctggaggctgtagcaacggaggacgcttgcgacgaggaggacaagatggttgtggcgccctgatctggttgacgtcaaagctccatggcaaacctcgaggtggtcgccggagggggaggggaaggcaatagggggagtgggagggaaagcagacggaggggttggaggagccggcctcggcttgctcgccggtcgtgcctagcctcaatccacacccgccgccgaggccattccatggacaccaccgccgagacctgcctcggggtccttcgccgccgacgacatggggattggtagggagagtagaggcgccggccaggtcgtcagcatgaacagaggagagggagtggccatgaggataaagcagagaggggaagatggattttatcttcttttctggattctaggttgttgcaaattttggacctccacacaaattaaagaaaatatgagaactgaaaaaaatgctaggggctaaaatataaaattaaagtcattcctagagccacttacaatgtgaagaattcaaattttgtacacgtaaccctagcttacgtggcactccgaggctcctcgtatgagggcaacgtattgtgaacacccttataatgcttttgtacttcaggtgtacgataacatatatgaatattcatgcgtgtatttgcataggctcatttttctgaatgtgcaaatgagggcactcccaaccctccacatcaaccagttctcatgacatttaagtatattgccacataagaaagagccgaggtaagagagttaacgaggagaggagaaaaatgaaaaaaaaatcgtttctcatgtaaataattagctctacataaaaactaagaataaaaacaaagggatgcgtggataaaggagatactaaatgataggtgtgattggatgataatttattttcaagaaaccatccattgagttagtttctacaaatagtgtttgtacgacattgcaagaatgaaaactatttaatagtttttgagctaggattgtcctaaatgtgcccactatagaatagcttatttgcgagtagtaagagtgatcctcgttgaacgaacacatctcctaagaaactaataaattatgagtactatgctaccgaccatttttagacgaacgcatcaaagagcatgtataatgagaaaaaataattataccccggatgaaatagcggaactctctataaaacacgcatttaaacaaatttattacatatattttataaaacgaatcaaaattcaattgccagcgaaatcaacccagatactatagtccggtctctctgtcccccagtattccattgttggtgttccgcatcctaattcataagaccaaatgttcgtaatacttgcatcaagggtatttgagtaggacgatgactttggtacaaaggccatttccccttcgcgagtgacaagatcaacatgaattgtctcaggccaattgtagaacctcgggaggaaaactttgttctccatccacttaaatttgggcttctttattatcgttgtcagcgacccagtgaacactacttgaccatgcaggctctccaccttctcccactccattgtttcctcattaagcttcaaaacatggaccgccttcccacggcgttcaatgagtacaaccatcaacccatattggctggaccggagcaagtagctatcttcacatttgaacccaaagccgtcaggcttgtcaagaatctcaaatccattgtcatgcctgcaaggatcatagaccagcaacctcccatcttgagctagaagatatagcaagccgttatggaggaccgggttggtgtccggtgatacccgaatacgtggcaagtcagggtgatattccgtcaacttccaatcctcccactcaccactgctgtttcggatagagctagcaaccttaatggtaagaatcgcctcgacaccaaatagcctctcatcaccgtcagagacaacaaaattgaataatgcatgaggttttggtggcaacacttcaacaagggcgccagtgacgaggtcaatatcaaacaccaaggactggtccacgcacatactcagatgtcgtccggtggagcaacagatcttcgcgccgggcaccttgagcagtccatcgacctcgaaattcttgtcgtagtaagggctatagtaccggatgttggcggtgccaacgccggcggtgctgaggaggagcggggtgatccacgctgggtagaaggacgacagcgacacggcggagcgccattgccggcacaccaatgcggcgtttgggtggctcgaccaccgcagactccccaggatccggacgagcacgtccgtcgggagagacgaccagccccggacccgcgacgtcgacgcgacggcctccatctaggttgctctcgccactactatatgcacgtgaccggtgttttctgccgcttttctcgtggtgggtcgcgtgccggcttatgtatatataggacgcgtgcggggttattgcgagcaaataccaatcagtttaatgctatgtgcacgggagtcctcgccaaatccgtgtcgaatactgaatacacagcacagcgcagcagggcccatatccatcgatatcgagcccgcgagagagaaaaaagggaaccgcacgtaacgtaattatatgtacgggagccacgagcccgcacggtagctctgctgcacgcctgcactgcacgtacgtatggtaacttgcaacggtgaattgttccaaaaaaaaattgcgaaagaggaggatgcacgattactttactttagaaaaactttttttttaaaaaaaaggccaacggattttccttgtaaaagggtatcctttatgtgcaagccaatcacttcatatagatggggtacgatgaaaactgtcggaatcggtagtcctttatggaagtaaattctcggtcgatcgagaattaatggtcatatttatcaattttaaaatttgggtatcaatttataataatttagtgtcgataataggatcctcaaaacgttgcaattttacgactttacatgaaataattacgtagcactaggtcaaccatatatgaaaaacatgtgtagcactcggccaaccacagtatctctatctctactattaaaaaattaaatatgtttttgccagtattttggtacgtcatccgtgtttgagtaggttttaaagttcgttatcttttggaaatacaaatccgtatttgaatcagcctttaagttcattcagttttagaaatacaaaaggagtcgtataagaaaacttttttaaaaaaactcacgtactaatttgagatgaaagtcggactcctaattgcagctcataattaattttctaaaaaaaatatccaagcgaattcacacaatcctcccgcatcgggcgctcgaaaacgagcgttttaattaatacggtgaggtgagttgttggtacttagtgttaggaaacgatagacaaataaacgataaaaaacaatagatcaatcacagaaggcacgagattttaacgtggaaaaccctcccaaaacaggagagaaaaaaccacgggcgccagcgagcaaaatatcttcactatatctggggtgagattacaacgcctcacggtggcttaccagaggtatatatatggtggaaccctggaagggatgacgatccgtttcgtgggggctccgcccccgcaccccgggcgtccccaggtgcacggcccaatgggcctccgctacgcaccggcccaagcctctcggcgacgggcctccgctccactacggcagaagctggcctttattaagtgcaaataaatttgtatcaaaactcaacacttagtgatcttgaataacatgtgttgcacataatccaatttgatcataccaattttcatccatatacgtgcatacgtctctcaattcatctatctacttacatatatacttggtcaatttctatatatcatttacatgttttggtaatataacattctatatcatttaacggttgttaaaattgaacttgcaatcatgatttgcacttccatttacattgcgagcttaattgtttgcaacaataaatttgcacaccttgcaatgcgtggacataatactagttcaaataaaaaatgatatacatatagatatacgtacgatcataagattcgactaatgcagaccctgttttatatcccaccccaaaatttttcaccctgtcacatcgaacgtttgaacacatgcataaagtattaaatataggctaaaaaataactaattgcacaaattgcgactaatttgcgaggtgaatcttttaagtataattgctctatgatttgacaatgttgtgctatagtaaatatttgctaatgatgaattaattaggcttaataaattcgtcttgtggtttattgatggattttgtaattagttttttattagtgctcgagcaccccatacgacactctatataatatccaatgtgatgtgacaaaactttacacccttagatctaaacacccccgtagtatatgactagggctaagccttaggtggtgtttggatccagggacttaactttagtccctgtatttagacactaatttagagaattaaatatagactacttacaaaaataattcaataaatgaaagctaattcgcgagacaaattttttaagcctaattaatctataattagaaaatgtttactgtagcatcacataggctaatcatggattaattaggctcaatagattcatctcgcgaattagtccaagattatggatgggttttattaatagtctacgtttaatatttataattagtgtccaaacctccgatgtgatagggacttaaaagttttagtcccatctaagcagggccttatgttgcacacaacaaatgactgacgtcgtgatgaaacctcacatgtatttgttagcgtgcctcacgctgcaatataggctgtgtttagttcgtgtgccaaattttttttaagtacggatacacatttaaagtattaaacatagactaataacaaaacaaattacagattccgcctgtaaactgcgagacgaatctattaagcccaattaatatgtcattagcaaatatttactgtagcaccacattgtcaaatcatgacgtaattaggctcaaaagatttcgtctcgcgatttacatgcaaactgtgcaattgtttttttcgtccgcatttaatgctccatgcatgtgtccaaacatttgatgtaacgaaaaagttagaagtttaaataagaaagtttgaatctaaacacagccatagtcggacagaagtcgtatgtgtaatagctcttaatttgaatacctgtttgaaaaaggtactaaaaccatttcccctgttaagaatagctctttgcttttatcagcagaattcattcgaaaaagacatcaccaattgataattacatcaaataaaaaaaatcattggacagatcaaatgcctcctcggcaagctctttggcactttctttgcttgtcctcctacgaaagaaaccgcggcgcgccgcgtgcgccggcgaccgtggcgtgacaagtcagaaaatcttcatgttcctcaccgattgcggcagcttccacccgccgccctccttcttctgcgcgtcgcgcccgcactgcccggcgctcctcgcggcggccgcggcgccggcggccttcgacgccgcgccggcgcctgcgccggcgcacgcgtggtcggcggggaaccggtgcttgaggcacaccttctggccgcaccccttgcacccgctcgtgttggagaacgtgagcgtctccttgcaccgcggcacggggcaccgcggcttgcgcttcctcgccgggtcgcaccgccgcgaccgcgcgtgcgccttcagcacggcggcgtcgtccccgcccccgtccccggcccgccgctcgatggcgtcgccgcaggcctcgcagacgacgacggtgcggccctggtccgcggcgcgcgcgcagccgtggtcccggtacgtccggtgctccgcgcagaacgtcttgccgcagccgtcgcagtcgaaggggaggaagtcgagctggttgcagtcctccctgtcgcactgcgcccccaggtccgggaacgcctccgtgccccgccgcgccatggaaaatcgatcgacgatttgatcggttgccttgatgattccttcctcctcctcctcgagagctctgaaacgattcgcgttgacgagcgtggatttatagaggcgggggtttgccgtttccgattccgacgcggtttgcctttcttttccggcaagaaggttgggggcagtttggtccggattggaatagtccggtctgctctggaggcgcctttacttagcgaaggcggttttgggtttcggttagtttagtttagccgcgtcggccgtgacgtgtcgtgctgggctggtggggccgtgtggttggtttctttctaggaggaggagaccgagtcggatttgggggtgtttgggggtcgaaggcagcatatgtgagtgagtccggattattgagacggctcgtttagtgaaggcccaattaggtgatttctatggcccaaaattgcattaattgcagatttcaaggcgtcaatttctattggaataagttcaccggaggtccctcaacttaacaacgagattttttgaggtcctttaaccacaaaacccgaaacagagatgctaaaaaacaatcgacagtttttggggcaaaaaacagtcaaatgtaactataatatagttatagtgtaactaccatgtaattacactatagttacactgtaactatagtagttacactatagttattatagtgtaactgtagtgtaactacgttataatctctatataagttagatatgaagttatatttattattttaatatttatataaaagttatattatagttacagtataactattacaattatgctatagttagatttgaaagttttttttcccaaaaaactgtcgacagttttttttagagagtcccaaccagaaatgtgcacccctaaacttacacaaaccgtgcacacaaggtcatatgacagtatatgtgggtggtttcgctgacgtggcatcctagtcagaaaaataaataaataaagtacatggggcccacatgtaagtgagagaaaacgatgcgagccccacatcccttctttcttcccctttcttctcttctcttgtcttcttcgacgggtcgagacaggcggagcgacggccggcgagagcggcggcgggcagcgggcgaccgcggcgggaggtggggcgggatccgggacgggttcctcgacgggctcctgctccgggaggggatccctgcggccgacggagatgtcgccgctggtggcggaggagggaggacgcgatccagacgacgatggacgcgagcacctggtagtccgggaggaggtagtacgccgcggcgaggagcgccatggccgcagcggcgtaggcggcggcgtgggggagggagcgggatggttggctgcagtcctggacagggcacatcaacgggagccacgtgaacaagaccaccgcgacgagcagccacctcaacgacgcggccagtagcgcgaccacggaggacgacgaggtggacacggaggaccacagtgggcatgcgcggccgccgccgttctcccccgccgcccctgcctgcttcgcccgccgctctcgcccgccacccagtggcgaagccaggatttagagatggggggtgccatctacgagacatggtaattcacctaaggttcagtgaacagtgattttgtagtgttgatgcatgatcggtaactcgatatcatacatgttacagcgattagctacaagagataacaagaacccatatatcatgattcgccaatttaaaattcagtaatatttttaatatatggatgattgaacagtttgttccattaattggagtcttgcaatcacttctaaaatgataaatcagttagctaagtcatttcagaagtcagttgtcctatatcctatatagttagtctcatctgtaactaatgatataattaatagctaaattataagtgctaatcatccttgggagaagagaggggaggggaggtcacataggggttaggggggtgttggccctccctggcccctacgatggcttcgccactgccgccacccctacctgcttcgccagccgccaacgcgttcgcctgccaccgccatccctgcttgcttcgcccgccgccacagcgctcgcctacccccgccgctcatgcctgcttcgcctgccgccgccgtgcgccgtgctcgcccgctgccgccgccgctctcgccggccgtcgccccgcttgtctcggcctatcgaagaagacgagagaagagaagaaaataaaggagaaaagagaagaaaggggaagaaagaagggatgtggggcccacatcgttttctctcacttacatgtgggctccacgtactttatttatttatttttgctgactaggatgccacgtcagcgaaacctcccacacatactgtcataggactttgtgtgcacggtttgtgtaagttaggggtgcgcatttctggttttgtggttaagggatctcaaaaaatctcaagagtaaaatacaccgctggtccttaaacttgaagcgtggtgtcacttagatccatgatcttgtaaaatcgacattaaggtccatgaacttgtttaaatgaatcattgcggtccaaagcacatttgacaggattgaccgtcctacgtggctgtacagcgtggccccatatttgcacttaagcccctacacacctgatccaaccctccactactgctgttgaccgccgctggcttcacctgctcgccatcggctctactctctccctcctcctcctcaccaccttccctctcccctttccctttccctccggagacgcggttctcgccagtgagcgacaagacggcctcccacgccttggtcagcactcgcggacgcctcccggaccttcgccatcatgtcgcccggcgccgccgccaccgtcggcacgccctgcgccacgtcctccttccgccgcttcaccacaccagagatcgtcacccccttgtcctgctactgcccaatcgtcggctcgccgaaggcaagggtggtggaggcgtccgtgtcctgcgcggcgccctatgattgcaagctgccgccgacgcctgggatcacggtgccgatggactgcatcaccagctgcaccttgccagccacgacggtcccgacaccgacattgggtcgttcggcacatccacatccggcttcccgacgccgacgtgcttcgggtcatcggagacgctcatcgaatcgaaggcacggacgatgggcatcgcatcaatgtcctcaccttcctgtggcatgcgcactggttcatgtcactcatcctatgcgctgccacatcgcgttcatcctcctcgctgctgctgttgctgctgctcccgccagtgctgtcgccgcccttctccctgccaccacgccgccagcgaggtgtcgcgtcgcggatccggcagtaaggttggatgcggcgccgacaactggcgagaaggccagatccaacgttggcaactaggcggagctcgacatccatcactccggtggcgaggcgtcgcggcgcggatccggtgccgacgaccagcgagaagcgagaccggcggatctggccgtcagtgaggcgtggttctccccggtggtgcccctctcttcggcggcgatggaggaatggctccggcaagggcgtggggcggcgggaagggagactgagccaggccgtgactacggctgccttcttctccgtcgagctcccgacggctaccttgtcgagctcgagcccgacagtggcggcaagagctcgagggctcgcaggcatgatccacctcggtgacgacgaccggggcgagctcgccggccggctcacctgcagggccgtgaaaaaagagagaaagagaagaaatagaaaaggattttggggaagaagagggtggattgggcacggaggggtctaacagcaaatatgcagccacgctgtacagccatgtaggacggtcaatccgatcaaatgtgctttggaccgcaatgattcacttaaacaagttcatggaccttaatatcgattttacaagaccatggatctaagcgacaccacgcttcaagttcaaggaccgacggtgtattttactcaaatctcaatgttaagttgacggacctccagtgaacttattctattgctattagcagtttgaaaattgtttaggcccaactttgtgtccaaaaaatgttactccctccgggctgataatacttgtcgttttgaacaagggtgaggtcaaactttagaatctttgattatgaatcattttcaaaatatttgtctttcaaatatggtgaccacatgtatagattagtcttaaaaaatactttaataagatcatatatttgttaatacttttttacatattatgatagaaaatgatggtcaaagttgtttttcgaagaccgtgctcttgtccaaaacgacaagtattatcaacccggagggattagttgttagtgcttactctgtactagaggtggccaaacgggccgggccaaaacgggcggcccgaggcacggcggaacctgtagccggcacggcccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggttgggacggcacggcccgtttcatgagccgtgcctaacgggccgtgccgaaacgggccgtgccggacccgtgcccgtgccgtgccgggccgggccgcccgtttggccacctctactctgtactcgtactatggtgatggtgcaaatgcaacgcacggcaatcatgttacgtctgcgtgaatgcatgcttctgttctatctgcgcagtacaagtcacactatctttgtggatagaaaaaaaatagaagagatataaaatgcaagcacgtcaaagtataaaaatcacaaaccccatttctctgttatgaccagccatcttcgtggcatgaatgcatcctccttgccgctgaaaagtttgggaagaaaaaaaatgacattaccaacctcgaattaaggaggaaatccctaaaaatttcaaattatagatgcaaaaagggaccgctttgtctctccctccccccgtcacggccatgacaacgctcccatagtcccacatttcactggcactattcattggtgacagatgagaatcgttttcagccccttcattgctcgttgatgaaacgcccggggtccaatccaacaacgcttatcgccattcgcctcctcatccctccgtttcagcctcgaccatggcagccggtgcatgcaagacgcgaatcatatgctgctgctgctgctgctaagacagtcacacatgtttacaattccagtgaaatccggtccaaaatttgtaaaattcagacaactcggaccagttggaaaacacaaaaccccttgatttttcgatcaagttctaaaaaaaattaaaactaaattttaatttttttttcatgagatttatttaagagttcatcatttttttgttagtttataaacggttttcatgaaatctctggctagcatatacggaagcttgggggcaggtaaggtaggtaggtactccggaggagccgggcgaagggtcactactcacacttcactctcactctctcgtaccgaagcagtcacgaaagttgtcagcgtcatcacgaacacgcgacgacgcggacgccgcaacgacgagctagccggtgacctcagcggcgggcgcccctcgcgtcacccagccgctgaccaatctcgctctctgcagcctgcacgcgctccatgacagacggacggtgctcgctttccctacctttaccggccttgcgctcagcggcgggacacatctctgcacatggctccgcccgcataaatccaagcagaaaccaccacctcgttttgcctggccgctctgctcaacttccaagctccaaagttaagcaggcagctcatctgtttccaaaccaatccttagctatgctatggatgtgtttagctctaggatataaagtttcgatgtttcaaatcggatatacatacacatatttgaagtattaaatatagtctaataacaaaacaaattaatccgcgagacgaatttattaagcctaattaatctgtcattagcaaatatttactgtagcaacacattgtcaaatcatgacacaattaggcttaaaagattcgtctcgcaagttacacgcaatctgtgatattagttatttttttcgtttatatttaatactccatgcatgtgtctaaacattcgatgtgatatggtgtaaaattttatcacgggatctaagcaggccctatatgtgtgggccagccgaaagcccgaaattgaccattgccaggcgtcaatgcgactgtgaatccaggtactctacaaaaatgtcaactgttatacagtttattcgttagcaacttggcatggtcaccgttttgcctgtaataaactagtaactagaagtaacactaaaagtacagtaacagcaaggtaaacgacaacacttggcattacgcgcatcagccctgatataccaacaactcgtgaagactactactactacagctcgtgtactggattgcacggccgggcatatagcaaagggctaacttcctggcgcatccaaagcatgcttacccaatcgaaatgtaccctatccgttgcttacattacactacaaacaaagcagaacgaactgttcatcgtcggaggagggaagctaattagttgctcgtgtgatggcttacttaatccatgtttgttcagaatcttctttctttaagtacgtcccattcactgcctgtagtgcctactccgattgaccccttcacatgcagtgcatagcttacctaagcgttgaacttgcatgactgtcagacaaagttccaaatactcctgtcggtccaccttttgcattcttttctcgacgaaaaggtttttgtttgttgccgcccttcatggtcaggcgattggcaccactcttgagttagttttaggtgctagattccaactaataatcacccttttcttgttgccagatgcacacttttctggtatggaatctagcattttgccaccaccattatgtttgttgtgcatctgttatgaacttcctatctggttttgtccttgcagaaattcagattgggagcagattagcagctcctcaggttactggtatagaatatcattatacaaccaccatttgttaaaataggttgtgtttagatccaacttcagttcttttccatcacatcaacctgtcatacacacacaacttttcagtcacataatctccaattttaaccaagactgtgtttagttcagcgcaaagtttggattttggttgatccaaactttagatctaaacacaacgcaaaatctaaacttcgcgctgaactaaacacaactatgattaaaatccctatcaagttctgttcctgcagaaattcaagattcttcggccttcggagcaatgcgtcacagcgtcagtgagaaaagggtctgtgtcttatgacatgggcaacatccaggaatcaagtggtacacgggagaccgtggagaaaagggtcaggcttgcatatgaccctacaggaaatgtagaccatactgtactacctttggtaggggacaagcatggcctcgccgtccttgtcaaaaattttaaaaaaggataaattccatatgtagatccgtctatggacagctaggattgaattctttcatccaattatcaagcgctgccgaggtatcggcagccactgatttctttgattttccatgaccaatcaccaatgaacacatcggtttcatctacaattcaggtagctttctcactttgtacagaaaaaaaaagaacctgggtttgccaaactttcatgaaaaaacctgtgaaattatgtgttagcagcagcagaacagagaaaattcagtcatctgatgcaacaacgtacagtggtaactgctaagatccaacagaaaatttcacacaaagcaaatatcacaaaatagagtatcaagcattagaaaggtgctaagcactagtgtaattggattggatcggagcaaaaggattttgatcttatttacagatgcagaaattcagaagaatttcagacacatgcgtctttcttcctgaacaatgcctaagtttggaaagtacacacagaacaatgccattactctggcttgcaagcaacacccgccacacgcgcgtcgcgagccctgtcaactttacacatccgagcacaaagtgcactacacatgggagctcgccggcgccgccgccgccatggcgacctcgccggcgtcgaccagcgatggcagctgtcgcaatccgcgtacctaattgcctcaactgtctaatggtgtactaggtattcggtggaatcaatcaatcacacggtggtggtggtggtggtggtttagaattcggccgtgttgccgcacgacgaggacccgagctcgcgctgccggcggcggaaggacatgaggccgtcggacacgatgctcccggcgcagtcgtcgccgtcgccgcactcgaggctgctgccggtcaggtcggccgcgtcgtcggcctcgttccgcatggcccggagcgtcttcctcgccatgtcgcgccgcacgatgcccggggcgcactcctcggcgacgcggcggagggccgcgtccgcgccggcggcgcgcgcgaggccgcggaaccggaggctgccacggctcatggcgtacatcgccgcgacgcaccactcgtcgagctcggcgctgcgggtgtcgtgggagaggatggcggtgactgccgccacagcgcccgcgtccatcaacgccgcgcggtcctccgtgcacgctgccacgttgcatacgaccatgagcgccagcctacggatgggcatccgctctgcggtgctggacgcgacggcgaggagagcctttggcgcgcccgggaagcgggcgatctttgactggttgacggcggcgagggagaggtggtagagcgccatcccggcgtcgcggcgcgcgggcgcggcgtgggcgggggaggtgagcaggtcgaggaggggaggcaccgcgccgagcacgccgatggcggcgcggttgtcctcgttcagggcgaggccgaagagcgcgccggccgcgtgctcacgggcctccggcggcgacgtgctcgagcggagcacctcgacgagcggcggcacggcgcccgcgcggacgatgcgcaccttgttcgccggctcgagcgtgaggttcaccagcgcggccgtcgcgtcgacacgagcgctggcgtggcgcgggatgagcagcacgcggcggagcgcgccgagcatccgcggcgtgcagagcgcgcgccgccgctccgcgctctcccgcgtggcctcccggaggccggcaacggccaagaccacctcctcctcctcctccgcatccatcaccttggcaaccaccacgtcctcgagcggatcaaccgccatctccacctgctcccggaccgcatccttgtttgtcccctccttcacgggcttcacaccaacctcgt

SEQ ID NO: 64281 - DNA, 6522 bp, Oryza sativa
gcgcgcaccaggtcccaatcgccgccttgagcgccgcgttgggtatcaccgcgtcggaggcggaccccatcccgggcggcaggaacgcgagctccgcgcaggcctggaggcaggcgcgctcgtacgtctgccccgacgggaggatcaccgggtcggccatgagcgcgcccaggatcgagcacacgaactcggccggaggcgcttcttcctccgcaacaacaacaaccgccgaacgcgcaggcgagtggggctcggggtccggcggggaggagggagacgacggcgcgctgcggtggaacggcagcttccagcggcgagggcggcccgcacccatgaaacgcgcgcgcggctgcgggggtggtgttcagcggcggcggtggcggcgaggggaggaggagctagaggagctaggaggtggaggtagtgatgcttttgctgtggcggccattgggtctcggggggtttgggtttgtttttttatttttctcttttggggttcgggtggtttgtgggtgccttggctggaactgaggtcagtgtgtgcgcgcttctcctcggttttatgcggagacaaaccttagccaggaagggatcgcgcgcgggcgggtgggtctccgtgtcgcggttttttgcggtggatttgctgtgattttggctgcgtttcacggtgggagtacggggcgggggtggtgcgccgcgcgtttgttcagcggctggggtgggcgtttttttttttggccggaaacaccggttgcttggttggttcagcgagtgagctcaggcgagtgcgccgcttgactgacacggtgtctcgtgcaacgcacgaatgtggtgtaatagaagaatatgaaatcgctggttgacctgacctagcaagatcgttttgcggcgagtcgtagcacacgatgcgtctccgactcgtgcacatctctatcagaaaaccgaaagaagagtcagaaaaagaatgaggctcccatcgttggatggtctaatcagtcgaaaaagccaaattttaaatttttaagtttaattttgagattgattttgaaatattttcaacgtactttcttttccaacattgatttttaaatcaccaaaaacccatttataaaagttttacctataaatttatttttatttcctactatggggatctgatcttatatcaactgccatttcttaccgatgagggtctcaccgtctcagggaagacacgtcaaacattttccctttttctctcggaattccggacggtgcagaatgcccaccgaacctcgtgagatgcggcttgctgctgctgccccctcgtttcactgttcgtgccagccaaacttccccaaggcgcacaccacaaacgtgagatcgttttcaggtctcgtctgcgagctcggaaagacgctgcgctgagccaatttgctcggcgtcgtggacgccgcggacaaacgcctcaacgtccggccgccagagagcgctgccctgctgcccctgcaacaacggcgaactcccctgcgcacaagaagacgatcccatcgtcctcaattccacaggagaggaattggtgccgcgtgtgaaccggataggccgagtcaaagcaaagctccatcgatgtctgcatctcggggaatctgacacatgtgagcaatgactcgttatcccctcgcaaaatttttagtattaaatatataaaataataactaattacatagattacgtgtaaattatgagataaatcttttaaggctaattgctatatgatttaacaatatggtgctacagtaaaacatttgctaataatggattactcgcagtttacaggcgaaatatgtagattttttattagtctatatttaatatttataatgtgtgtctgtatatacgatttgacacgccaaaagatctaatcaccccctcggtggagtaccggagtagctccctttgtttatgtgtgtccgtcaatccgtgtgtgtagccgtgtgggggatgtggctggccgctggtgaattgggctagtgtttttttttaacttttttagtgaaggatatttttacccggtatatacatccaactggatatatgtagtctttttaaattagtaacctagcttatcaaataaggaacttaaccctcaaataactcaatctgaaattcgcttatacgaagatttgaaatcaagactttagaatgctaatcagttcactgcaccaattgatatacatcccctttcacctggtaaatgaattgggcgagtgtcggggtgtccgtgtttatcttcggtgtcttgcttcgcctggtaaatgcactgtcacttttgtcgctgcttgaattctcttctgctgcctagctcgctgatcaagatcacttgctcaggctctctgtttatttagttcccatatactttttcctaaaaacatcacatcgaatctttgaatacatacatacataaagtattagatatagataaattaaaaaactaattatacagttagggaggaaatcacgagacgaatcttttgagcctaattagcccatgattagccataagtgctacagtaactcacatgtgctaatgacggattaattaggctcaaaagattcgtctcgcggtttccaggcgagttatgaaattaattttttcattcgtgtctgaaaatcccttccgacatccgatcaacgtccgatgtgacaccaaaaaattttaatttcaaaaaaaacatgccctcagtgtcaaagactggctgagccgtggcagattggccgatcagtgtcaaagtgttgctatgtgttgagattgggaataattaattatttatcactctcacaaatagttataaagaatttatcactggacccatatattatagacacataagggctcatatatcatagacagcgagtgacaaataataaattgtcacatcttaaagtggcaaaaagtttgtgtttagttcagcgcaaagtttagattttgattgaaattgaagatgatgtgactgaaaagttgtgtgtgtatgacaggttgatgtgatggaaaaggactgaaatttagatccaaactttagatctaaacacagccttaaatgtcccgcaaagggcattaagcagaatgaaaacccaccgcatttctacccaaatcgagacatggttgagcggattgttgctatcattatttatttaattgtagagataaattaaatatcataataaataaacttaataaataatataaaatagatgttcttagcaatataattacagaagaaagtttttatagaaaatgtatttttagagcttgagtaaataatccgtttcaacaatccgacaaataattaaaaaaggtagggcattagattaggatgaaatccaagcttaggacagctatatatatcactcaactttggtgcttagtggcccaaaatataatatttgcttggagacaaacgaaaatttaaccccatccgaggtacagtttggtggcattcatgcaagtataagcttagtccattcctaatcaccaacccgctattaaactgttagtagcttcggttattaggtcactaacctgtcatggcggtggctacattgtagactagtttaatttacacaatctacttaccaagtaccaactgggtagctcttgtctcttgttatgaagtacatttcttttgccacattttataaaaaaaataatgatggcggttcatggcataatgatgaggccagactgttgttagtatgttaagcattgggcattaagcaaaatgaaatgcttaagagttaagacagtggcttgaaagatgaatcaaaatttaatctcatctgaggttgtgaggtggcattcatgcaaatatcaaaaattcagtccatcctattcaccaaccaggtattaaagtactgttacaatcactattattggttactacgacatcagtagtacttaggttagtaactcggcatgcatagcacatggctatgtggtaagattagtttaattaatctggattgcaaaagtaggctcccgtcctgattctttcccccgggtagctcttgtctcttgttgtaaacaacactaatcacttgccatcttccattaaacaaacaaatgacggtttcataacataatcccttgtggagatgtgggcactaagattatatatacacacacatatgcaacaaagtattgttggcactgaagagtgcagcagcaaagacatcggtctcttgcgactttaagcagcctagatagagggtgccttgcagagaaggtttattccttgggctcagtagaagtgtagtagaacactagaacatgttctctttttttcctttcaccaacaaaaggtacaccctctggctccacatgttttctttctcctttgttgagtactccaataccccccctcatgttcttctgttcaatgctctggtcattgaaatacgcatatacttacattactagtccctaaattgaacgtacgtgtgtgggccaagagaaacatccggtatggtgatctattgatctgggtgtattgtgacacttcaagcgcctgcaaaaaggatggctgatgcatatatttatgttgcaacttgcaagttgcatctccctctcttcaaaattttagacaactaggccttgtttgaagtagtttatagagcggattatatctatttaattgtaaggataaattaaatagtttaaaaataaacttaataaagaaataagtagtccaagtaatacgacagaaaagttggttttttagaaaatgtaactttatgggcgtggatctatagtaataatctggtgaagtagctaaaaacgtatttttagaagcgtgtttgtgtatttgcattgtaaatgttctaagacgatatgttctacaatttactaactacttcctccatttcacaatataagtcattctagtatttcccacattcatattaatgttattgaatctagatagatatatatgtttgaattcattaatatcaatatgaatgtgggaaatgctagaatgacttatattgtgaaacggagggagtatttgtgattgtagcactgatcaaattttacatttactcattaatacttgcattatttcagttctcaaaaatgaaacagcatgcttatgtagcatgctacataccccaattgcaaagagtggcctcatcttgatgcatgcccatgatccgacgttcttggaacaaacgcaaaggacacaagaatgcatgctcccaatctcccatatgccgagttgctgatcgatcaatcaacgatgtattacacacatcaacccagcagcacgccatggcgaacgctggagattcccatcatggcttctctctgcaacttggaacacatgtagccattgcaacaatatgtttgtgggtgaaggggatcattcagattccatcaggctgaaagcctgaaagctaagctatatacctgcatagtatgatgcaggctcgtttgcttgcttgctagatctatagctagttcacatcactgactgatcgttatcagtaacagaaatcatttcacgcattgccgttctgcagccgcaagtgacgattaattattgcatgtgttgaactccgactctctcctggatgaagcactgagctgaagaaaggcagatgcatgcaaaagcaggcagggaagaaaaggcaggcaagagagagctttacaagagccaggtgcacgctgaatgatatatgcctgaaaagtttcagttgttcacaccaacatgtggtaattacgaatgttagtaattagtatcagttgttcacaccaacatgtgttaattactacttaattactagtagtttcctttcctctcacaaatccatccatagcatcattcattccatcactgcaacatgtgttatttttgactgaatgaaatgggatgtttaacagttgaatagtaatagaggaatgattcgagggtacaaccaaataaattaactactatagagtttaaaaatagatttgaaataatattttaaaaatatatgtagaaagttttttaaaaaatcgtactacctccatttcaaaatttagttatttttagtacagtagcttatcttaaaatgaaactatttttccacctatctcctcctctcaactaatcacaaccatctccttcatctactttctctttttaactaagcataacattttttctatcattctcacatacttttttaatacatgtgtcaatctaaaaatgcttacatttcgagtcggaggaagtagcgtttagaaactcgtatagtgtgtgttttacttgtcatattccatcccattataaatggggaaaagaacaaaccaagcaagaatctgacaggatatactgtgtatacctagtgatttcttcaggcttcagaatcttgacagatattgcagtagacagtagtgcattaatctacgactttgtttgcaaagtgtcattttttgctagataatgtaatgcaaagcgacttgtacacacctgctttggataggaagagggctgcaggaat

SEQ ID NO: 64282 - DNA, 1096 bp, Oryza sativa
agtgcatatagatgaagtaatgttttctgaagtttatcgatgaagtattgtaatcctaaaacataaaatgcaaagtacatatattacaattcttgaaaggaagtgaaaaacaagaagagaagcacaaatccaatagtaacgatagcaaggatattgttttcctgcaaaggttgtgataaacaacaataggagcaataaagtgcatcttaagggagaacctgtctttccagtagctggtcatatgttccgcgggttgacagctctgatccagtctttccattgccatatacttgatatggcaagggtgagcttgcatcagttgaagcagcatcaatgacctgctcattttcatatttatacctagaaaaaaattgtataactggttaacaacaacacaaagataattaagaaacttaaatttgagtccatttggtgaagtagatcagaacacattttgactagaaaatgaacaaagcatttctcattagaaatgtaatatagcaatatttccattgcagcaaacacctactaatttttttacaaatctaaagcaagtcctgaacaaaaactaaattcactataatgtacttgtgtatgcaaaattccaatcataggattacattcaatagaatgcagctagtacatgcgagaatgatccagaagttactaaagaatattttacacgtaaccatcatcatgatggtggaaagtcaaattatttttcatgtgtattcatgaaacagaatgcaacaactgaaaatagatatagaatggtagtacctcaaaagttctgcatcagcacgtatgtcaatcttgtctgtttctttatgtatgagtattttcatgcgtgatgtgtatgtaatgattgattgcagcagtaatgaaggattttttagggaatccaatgccacagctttaacatcctgtggtatttcaccatccagatcaatgcccaactttgctgcatctaactgggaacttgaattgatgccacttccttcaaatgctgggaaagagcttcgaatcatttcgatcatatctccagcaagagtttcacatgccttccgaatactcctttcacgtgaggtctctacaa

SEQ ID NO: 64283 - DNA, 844 bp, Oryza sativa
caactgccgtgaagcataagaaaccactttgccatcctgcatcaacacacatcctagcccctggcgagatgcatcacaatagacctggaaatctttcgtctgatcaggcaggattaagaccggtgcagacaccaaccgtcgttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgatcttggcatatagctggtgctcttttaacttttcaagtaccagccgaagatgctgctcatgttcttcctcggacttggagtagattagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacaccgtagctcctttcaactgatcaaacagatcatcaatccttggcaaaggatacttgttcttgatggtgacctcattgagtgcgcggtagtcaacgcacatcctcttggttttgtctttcttct

SEQ ID NO: 64284 - DNA, 1510 bp, Oryza sativa
aatggcatgaagccagtcgtgggcctcgattgggttggtggtgcttgagaaggtgggcggcttgacacgaagaaattctaacaatttggactgaggaggcggaggaccaaattgcaggttctgctgctgcggctgtgcttgctgctgcacctgctgcaacacctgatggtactgttgctgcatctgttgcatcatcattgtcatcatctgagtctgattgttcaacacctgagcaattgttgggttctcgggcggtggggacggactgttgtcagatgcaccgttggcacgtgctccattgatcggctcttcgctgccactggcgttgttggagtcgcgtgaaccattccttatctccatctgaggggataggtggaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcatttttttttttaaaaaaaaaaaaaaaatccgatccgaatgaacgaccaagatttttcccgcaaaccaaagaggcaaaactccaaattttcccaaaacaaattccaagtgcaaaaaggcatatgcagatgaaaaaggggttcagagggctcttaggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttataaaaaaaatagaaaagattacaaatgcagcggaaaagataaaagcgagctaaaccgggaagcttgacttcagcagcgggtgtctccactccacaggcaaaccttgacggcagcgacgaaaccaacttcgataaaacagctccaactaggaagatcttcagctctggtgtgggggaaaagagagcaagactgagtactacccactgtactcagcaagtcataccggaa

SEQ ID NO: 64285 - DNA, 793 bp, Oryza sativa
cattggtaaaagattgccatcatcgagtttggtcattacataaagatgctctaattttctaattgtgttagctacaacgatccatagaaacattatcattgatatgggtacgcttgaaaaatgtcaattgtcattggattatttttttacccgttgcaatgcacggggcatttttactagtatataataaaagaacgaaaatatgtctcaccacatcccgttcatgctttctttcctcgtgatctcatttttttctttatctttatctttacatacatatttaaaatatttgtagtgtttctattattcgtcactgtctagcgtacatcgacggttttcgtgtttctgcattggcgccctagcagcacgtgcgagcttgattgcttccaaaccaaaattcaccgcttccacgtcgacggtcaatcatcccatgtgtcagaatccaataggctccacacgcatcacatccgatttgccttcccatgccaagcaattttgtgaatctaccatttaaacgatgtcaaaggatcgccaactcgtgaattaggaaataacaaagtcactaatataacaaatatacaatagtaacaagcctcataatccatatgacaagtggacccataataattagaaaatctaaattaataattaattaaagtaggtccattatgcacccgtggattttatatatatatatatatatatatatatatatatatatatatatatatatatatatatatatatatatatatatatatatatatatatatatatatacacacacacatgg

SEQ ID NO: 64286 - DNA, 2823 bp, Oryza sativa
ccttcctgcagaaaaatcggacatgcagacatacagtaagccaacaaaaaatccaggacaacacgtagaaccaatcggagcatcaaaaagtcagagattcgctgccgttcgaagaaggaaaatttagtccaatcaaattaagaatccacaagcgctgacgcactaacagggggtgtttaaatccagggtgaaaagttttggcgtgtcatattgaatttacggatacacatttaaagtattaaatgtagtctaataattccgtatgtaaagtgcaagacgaatttattaagcctaattaatccgtcattagcaaatgtttactatagtaccacattgtcaaatcataaagcaattaggcttaaaaaattcgcctcgcaaattagttgtaatatgtgcaattagttattttttagcctatatttaatacttcatgtatgtgttcaaacattcgacgtgacaaggtgaaaaattttagggagggatctaaacagggctaggtgaaaaaaaataaaagtggattctctgaactcaagaaagattcctgtagagtactccctccatttctaagtgcttgtttaagccgtgtttagttccaaagtttttcttcaaacctttaacttttccatcacattaaaacttttctacacacacaaaactctaattttttcgtcacatcgttccaatttcaaccaaacttccaatttcggtgttaactaaacatagccttagttcccaactttttcttcaaacttccaacttttccatcacatcaaaacttttctatacacataaacttctaacttttttattcaaactttcaattttagcgtggaactaaacacagcctaaatatttgacaccgttgactttttatcacatgtttgatcgttcgttttatttaaaaaattttgtgaaatatacaaaactatatgtatacatataagtatatttaataatgaatcaaatgataggaaaagaattaataatttcttaaatttttttaacaagacgaacgataaaatatatttaaaaaaatcaacggcattaaaaatattaaatttttagaaacggtgggagtattggtgttggtggctgtatggatgaaaacggatcggatacggacggaaactagctttatcatattcgttttcatatttttttcggaatcggaatcggaatcgaaaactcggatacggaaatgaaatcgaatattatcgaatacagatacggagcgaatacgagacggaacgaatacggtagcggatatttatcggtatataaaaaacccctcaaattgagtttcttgatcaaggaagagatatcgcttattattttagttcaacatctccaacatttatatcgtcaattttgtagacggtcccataaccctatgtgaaaatcgattttcatggctattcctcttacagatacatatgcaaatatgattatcattttctattttcaagaccttttactagatgtataacttacttaccattgtataaattggagaagttatttattttacttcacatcttcaaaacttgtaatgtttgttttatactttaaatgctttcaaatacaaatgttataaactacaaagtggtagatcccgttgagctctacaactttgatatggaacacatctccatcagatgtcgtttgaattgtagatctgagattttgtaaaaattaatatggtatattataatgaatatttagactccttaaatgacctcaaataataaaatagtcaataagaaagttgtagatctcatcgagctctacaatgttgatataaagtttgtcgccatctgattccatatgaaaaagttatgtatatatacatgttttttctaaactttgctcaatgtctgcggatatctgaaaaaaaatccggatagtttttccgaccgttttctgattccgacggatagtacccttactgtattcgttttcgtttccgagaaaaaaaaatccgaattcgtttccgaatccgagaatttccggatagttccgacggaaactatccgaatccgaaaaatggtccggacggacggaaactatccgaaccactttcacccctagctggctgtgcttgctccagatctgcaccatgcgacacagctcccagccgcttgatgccctccttcctgcccacgacagcaaactttgcaactgcgctcatcacatgctccgctcatctacagataaaaaactattcagagatcatcagcacaagatggtttcgtggtgtagttggttatcacgtcagtctaacacactgaaggtctccggttcgaacccgggcgaagccaagttaactttttttttccttctttttatcttcagattcaaatcaaccactgaattcaaactttcgttggaattcaaactttcgttgtttttcctccgaactcactgaattcaaagtaactcactatttttattattttttttatcttcagattcaaatcaaccactgaattcaaactttcgttttttcccccgaactcactgaattcaaagtaactcactatttttcttcttttttctcttcttttttttaatcttcggattcaaatcaaccagtgaattcaaattttctttttttccctccgaactcactgaattcaaagtaactcactaattttcttctttggattcagactagctaactgctgaattcaatcttctgttttttccctccgaattcactgaattcaatgtaactcattattttcttcttcgttctttttatcttcagattcaaatcaaccactgaattcaaactttcgttgtttttcctcgggctgcaggaat

SEQ ID NO: 64287 - DNA, 7421 bp, Oryza sativa
attcctgcagcccaatcttcgtttcttccctaataaaacctggccactgtttctttgttggtcctgtgagaaaagaaaaacaacagtaacacaatactcttaataccttttggaatataaattcaaccttctcactctaacctttcaatttttatgctattgtcacagaaaacatgctagctcacagtacggagaccaataagaaaggccaagaatattcaactcttcttgatcctaagtttgccccggtgctactatttgttgattacaacttagatgatacacacgatgaggtcaactccgaggatgaagactactccatagaagatgaagatgaagagttagatcacgaggatgataattcatttgacgaggatattagtgacaacgataaggatgatgataaacttggagaggcggcaaatgacatttgtaaaggagattataatgaaaacaatgaggatgctgggacagaggaaagtgacgacaccgatgaccaagaggaagatgtcaccatattcttctacagtatagccagaaaagaactattatgcaaaagaggtgatatattcaattgccactcatactggagaacaccacagggctggttgcttatggtacaccttgaatcacatgaaacattcttatggagtcctttcacagatcaaaggatcaatctacccttggatgaagatagtttccttacaaataatgaggtcgtttgtttgctatcacataaacccacttatccaaattgtgttgtgctagtggtaaattgtaggaacacatcattttggtattgctatcctcaagggcacacatggttcaagcatgagtaccagtcaagtatgatcactactcatgaaaaccgtagaaacgtcattctaacaatgaaagatctcactgcagttggagggaggttttgcacatatttaagtaaggagaaggcaattgtgacacttgagttcttgccaaatccaacatttacaactacgccagttaaggatgcatcagatccaatttattggtacaccacttttactaattgcttgttagaatcttgtggagagttgttcatgttatcatttaaacatccagtggtatgtgctcagaaggttgtgcagattgaagttcataaactcgatttatctagaagaatttgggtgaaagttaacacaattggtaacaaggcatttttggttgagtgtattggctttggatcatcgctcactgcagaagatgttggattgaagagaaactgcatttattttgtgagacctaatgataagggtttgtatgtttatgacatggaacgaggaactactgtaatgcataatccaggggcagacctaccggataacatgacacttcagatcgtggtgcctccattttgaatcgttcacgctggacatatgtttccccttgttttgtttaataatgttctaatgatacatcttgaatgttggttgtttaaattattgaatatacatttccctttgttattttttcttttattataaattataagagaatatatttttttcttttattataaattataagagaataataagtgatagaaaagtactccctttttaacagatgacattgttaactgtttaattgtgtttgacaattcgtcttattaaaaaaaagtaagtgtcatctttttttaaacttttttcattattattgaagaaactaaacgtgatctacatttttacatatttacactaaatttttaaataagatggctgattaaatgttatgctaaacattaacgggttcatctgataataacggaggtagtattagattggacaacgtgtataacttttttacaattaattttgagctttggaactattaataacaaaacttttcttttaaaacaaagtgaggtgcaaagtattatgtatatgaaataaggtgataacgactggttaagaataatcctcgtttcatttccgtgttacataatgaaatcgtgggaaatcgtgcaaatgtctagcttgagccgagtgtccatgttttcaaataatctggcacagccatagtgctctttgatctccatatactacatgactgtcacgagtacaacagcgattttcccgtgcggctggaatcggtttttgcgggcggatctttcacccatctggaatgaggtgtctgcgaagatcccgattttcgcatgcgagtgacgcatacgcacgggaaaaaaaataaaaaaaaaaaaagcaaaaacgccatcaccaccgtcgtcgtcgccgccgccttgcccgaagcccgccgccgtcaccaccgttgtcgtcgtcgttgccgccttgcctgaaacctgccgccgtcgtccccgcggcggcaggcgacggatccggcctccccgcggtggtcggcgacggatcagctcccctgcatcgatcgacgtcttcggcagcatggaggcgcggtacctggcgccagatagggggagctggagatcgatcgaggaagcatagaagcaacacggaagcagatcctctgacttaactgcacatgcagttgagtcactgacatgtgggtctcacttttctatgggccacatgtcaggcagttgagtcataagagccatttctaagcaacacgtagtatcaccatcgctgacgctcgctgctgcatgcttggtccgtgggggtaaggtacgacaggatgccggagttgtggtgcattctttcacctcctttgcttgtcgcgctcaaggttatcagtgtaccggtttgtactctagtatcttattataatattacgatcctatcaaatcaaaacgataccgatctcatctaatatcttaatttttatagtatcatgatcttactattcatttttatatgatcctacgaaatattagtatcctgattctacgatcgctacgatcccgaaatattcacaagtcgatgtaaaggtttgtgtgggtttagtgtttgaccttggcccttacaatgtgtgtaaacaatatactcctattaccatttaaggttgaacatggaatatatctttttctttttcagaattacatggaatgtatctgaatttactgtgtggacatacccttgccatgtttctcaagtcaatgtatgaatatgcccttgcaagtactgtatttttttttcatatttttactttttaaatataaattgtaaaaaacatgccttccacgtgcattattacgagtctttatatatgtatatatatagtctgaatctgttgggtgtgcctaaacttcatgcaacacattttttagccaaaaaccatcggatttcagcctatgagattaaaaccctatatgattaagacaagaaccacatggagtagtaaaatattaattattaataagttgtggcataacttaatttagtcaaaatacaaaaaaaaatccattttagagaactaacaaacacaaaatttacattcaaatatagaaaaattacatatgtaagtgcagtgtaattatactacatgtataatgtaactacactgtaaacaccaggtacatactgtaaaatctgtaattccatccgtgcgaaactgtatacagcccgcggaccgcggcagacgccagacgcaaacatgcaagtgtgaaacatgaagtgtaaaagtgtaaacacagcaagcagcaagcagcgagcagcggtggtatgagcacaggcaacggatttaactggacacgaatcttatagcgaatccaatggccataaaactgactgctatatatggagccataaatctggcgacaaaaatatagtaaaactgtttgtcttatttaatagcaaattagtgctgtgcgttacaacgggaatactcaaattttatgagatgattaacttcactttaagaaaagagtaaatttcataaaactacagatatcatgatcaaactatcgtaaaactacatatttaactcgatgtattacaaaactagacatttaaaatagggtgtcacaaaactacatagttagtaacaaaattatcataaaacgatttagaacaaatttagtcacaaaactaacaatagtgctagagatttaaactttaaaatatgtaattttgtgataactttagtattaaacatatagttttatgatacttaaccttaaatctgtaattttgtgataaatttagtgctaaatctgtagttttgtaatataatgtcttaaatatatagttttatgatattatgatcaaaatacccttagttttgtaaaatttactcttagggaaaaaaaaatctgcagttacaactcataacttacaaagaaatcaatccaaacgtaggtgtcggatctacctttcatgacataacagtaaagcaaggaaagaaaattactataaccgcttcaattcaaagtaggatgctctgcaaaaaatatttcgtggtggatgggactgcatcatcaaaagtcatgaaaaaaaatcatgaagctaactcaacaactagattagctcaaatcccatgataaaatgcttaaaatgaattaaaaatatgcaactcaatgagctcaaatataaggtacataggtcaaaaatcaaatgaaaaagggataggttcttaatcttataacatgaacaattagatagttgaataggtttatttcgataattcttttagaaaaaaaaaggtaatatgattgattagctactcctcctatgtttttttttattttcttcatactttaccggaccgggatgccacattagtgaaaccaacttcatactaccaggagatctaatttaaactagttttctaagttttttttttctggggggggtttcaagatttttggtgttgtagttcagggatacaatttaaacccgacagaaagataagggatgtaaagtggacatattcgtaacaaaaaaacaaaacaaagcaaattttacccaataggcccaatcagctcaactaaaaccaacactaagggttccacccacaccatctacgccgctgcctcagctccgcatcacgcaccactgcctatccccgctccacattgcgcgacatttcattttctcctttgttctgtgtagtgccgtcgtgccccaccgcctcctcttgcgcgattccgccccgccccccctcctcctccatcatgatatcgtctcctcactggccatccctgtccttgtccttgccctaccagggctccgacgctcattgtcgctgcctccacaagtacctctacatctagtggtgatggcaacggaggaagggagccagggtttcagcggctggtagctgatgatgtgatgacgatgatgcatctcatgtggcttgaggtataacaaagattttttttaaggaatttttggatttgcattttagcttcggttcttgtcttttccttgtggtgttatgcattcgatttggttgtatggaagctatgaaacatttattttggaaagtgcttatgtaagattgggttcttatgaggattctgttgttatgattttttccctttatccgattctgatgatacgaaggaactaccaggattaggggcgacgggtgcaacacgtgcgacgggtgaaggcgcattgtgatggacgaaagcgtattagtacgattggaaaattatgaattttaagggatgtaaagtggacctatttgtaacaaaaaaaaaacaaaacaaagcagctctggcagcccaactaaaactaaccctaagggttccacccactacatctatgccgacgcatctcccccactccacacggcgcaacactttctcctctgttccgtgtagcgccgccgacccaccttgatccactgcctcctcttgcacggttccgtcccgcccctacgccctccaccacctcctccccctcctcctcctccatcctgatatcgtctcctcgccagtcatctctatgcttgcctatgccctaccaggggtccgatgatcgttgtcgctgcctccacaagtacctctacatctagtggtgatgggagcagaggaagggtgatgagaacaggggttcagtggctggtagatgatgtgacgtcgatgatgcctctcatgtggatggaggtataacaaagattgggttttcttagggaacttttggttagctttttagctttggttcttgtttttcccttgtggtgttatgtatccgatttggttggataaaagctgtaaaacacctattttggaaagtgcttttttaagattggattcttatgagcattctgttgttatgatttttccctttctctgattctgatgacgcaaaggaacgaccggtattagggggcgacgggcgcaacatgcatgacgggtgaagccgcaccatgacggatcgaagcgtattagtacgatcagaaaattatggattctttagtagatatagatgtgataatcatgaaaataagggtatgtttagcacagctcgagctcttgaaattctaccaaacagtttcagttccatctaaaatgagagtggaactgggggagcgctatcacaaaacgaactagagaggtggttttgggtttaggctgctccataactatactccagacctagggactgtttggtaaagctctaactcctaaatttatctccaggagttgagtctggagtggagttgttgagctatctaaacccaactctacctctctagtttattttgtgagagcgctttactcagctccactccttttttttaaactaaaccagcaggagaactgtcaattatattttcaataagcaggagtaaaaccctagatgggttacaagaaaagaaaaaaaaaacaaccaccggctggctgaataactacacagcacatgccataactcactaacaactgaaaccactaacggagcccaacttagggtatagttaccaagcttgaccgaaaagacataggggttctgactttgcaaccgtgtcattgttgccgagcttgctgccaagcgacagagtagcaccgacttcaaaccagatgcatcatccaaaccaagctcgctgccaaaatgatcaagtggcttcgactttccacgatgaacttcagccaaagccgcgtaagcgccacatcctattcacagccaacaacaacacccctagaaagagaatgtagcatgtcatcgttgcccagctttgtcaccccgacgaaccagctctgactccacctagcaaaatcaaacaaagagcgaaggtcgcccaccgcaaaacaaaaggtgggaccagaaagcgaaggcctcgtcaaaacctaggatttaaaagcttcgaagccaatgcatagaccatcaacgatatccttgcacgaagaagtctctacaaagcgatgcccccaagctggacatgacatagattgccgccacggctcgtcggaagctggagtaaggttttcacccagagagcggtaaggacagtggggctgcaggaat

SEQ ID NO: 64288 - DNA, 9349 bp, Oryza sativa
cattttttttctaatcaaatagataatccacggtagtaatcaggcgaataatctttttctaaggggcccgtagtttggtttggtcttttatgtgtttaattggatgttatttttactcagtaaattcattctatgtttattgcgtttgtacctacgtgttgtttttaataaaatctggccagtgtgtctttgctgtcctgacggaaaaagaaaaaataaaaacaataagaatccttaaattgtttattttccttttaaaatacaattcaaccttttttttgttagtaagagcatgttgtctaaccctcttatttattcaatgatattagcacacttggctcatggtagctcgttctttttttttttaaaaaaagaaaaacaaagcagtctaacctttcaataaatttctgcagcactgtcacagggaaaaaaaatgctatcccacagtatagacagttgtaaggaagaccaagaacatctagctcttctagatcctaagcttgccccggtgctactgttggttgcttaccgcattattgatacagacgacaagggcaacaccgatgatgaatattgtcccatagatgatgaagaggaagaattagatcacggggatgaaaattcacatgatgaggatatcgttgataacgataaggatgattgtgaccttggggatgaagatgacaatcacacgtgcgaaagagattatgatggaagcgatgatgctggaacggaggaaagtgatgacagcgatgatcaggaggaagatgacactcttttcttctacagtatagctaaaagagaattgctatccaaaagagtggatgaattcggcatccacttatattggataacagcacaaggctggttgcttatggtgcaccttgaattgtatgaaattttcctatggagtcccatcacaaatcaaaagatcaacctacccttcgatgaagacaattttcttgcgaataataatgtggtcaagtgctttctatcacataaaccttctgatccaaactgtatcgtgctagtagtaaattgcagggacacaatgttctggtattgccatcctaaaggagacgtatggttcaggcatgagtaccaatcaagtatgattagtacaggagaggacagagaaaatgttattgcaactgtgaaacaccttacggctgttggggggagattccatgcatatttaaatcaggataaggcaattttgacacttgaattcctgccaaagccaacatttacaactacgccagttaaggatgcaccagatccaagttattggtgcacgttttctacttgtttcttgttagaatcaggtggagagttgttcacgttgtcatttaaacatccaattgaatgtgttgataaggttatgcaaattgaagttcataaactcaatttatctcaaagaatttggatgaaagttagcacaattgataacaaggcatttttggttgactgtactggctttggagcatcactcaatgcagaagatgttggattgaagaggaactgcatttactttgtaagacctaaagataagggattatatgtttataacatggaacgaggaactaccaccatacacaatccaggggaagatctaccagataacattgcacttgagattgtgatgcctccatcttgaatccttcatgttgtacatatgttatccttttcttaagataatgttttaacggtatatcttggactgataagttctttaaatcactttattttttttcattttcatattttttattaaattaagaaaataataataagtaatggaaaaaatagattggagaatatatgtatgaaatttcttataattaattttaagtattggaactattagtaaaaaaaaattttctttcataatcttttgcagccgtacatgaactatttaaatttaaagaaaattaatatattgtaggggcctcccatactgttttccaataaaaaaataattgttttttatgaggaatacctctattactgtaaagttatgattaatatttgtgatgaacaattcgctatgcaaattatttaaccaaagaattggttttatagtatgtgtgaatgttggtgtgaatgcgtgtgattcatgtgggttaggttgtgatatctgtacccagaaacgattgttctgtctgattatgtgcagttggcttgaggtccgccttggtcaattgtgaggatcgggacaatgctcagggagaagcagaggtctaatgtggttaggataccatgtgagaaggtgactagagttaggattcttcgaggtcaacttcggtcaacggtggggatcgggactagtcgactcagggaggagttgaggtctagacgatcaaggataccagatgacgaaattaggtacgagatggcacatggcacatgacacatgatggatggacatcgtgtgggagagatcttcgcaacgggtttcacgaggtgtgtgtgcaagtttcggtgtctgcgaaggagattggaagaaattcgagaagagtatatggtgctacagatgggtgaggtactgtagcatgcagatacgtgtgtttacatgtgagcagtatatatgcatgtatgtatgcgtgcccatgcatgtgcatgtgtggctcagtggttctgcatgttgatgcggggacgtctgatgggcgatcgcgatccagcgatcggtcccgcccctcatttctccccttcctcctccccttttttttttcctattacagtacaccacacaaaaattttaaaaaaacaaaacgttagaaaaaatttatgtacaaaaaatttgaattcaaattcaaatttgaatcgggtacgtaaacttttgacttataaactttggatctataaacttgtctataaactttaggcctatagaaatactatatatgaaaaatatttaaatttaaattcaaatttaaatcggaaatttgaattcaaattcaaatttgaatcagatataattcaaattcaaattttaaatcgggtataattcaaattcaaatttgaaatcgggtatataaactttaggtctataaactttaggtgcataaactttagatgtatagaaatactatatatgaaaaatatttgaattcaaattcaaatttgaatcggacataatccaaattcaaatttgaatcggatatataaactttaggtctataaactttaggtgtataaactttagatgtatagaaatactatatataaaaagtatttgaattcaaattcaaatttgaatcagatatataaacttttgacttataaacttttggtctctaaactttagatgtgtaaacttggtgtataaactttaggtatataaatttactaaaataggaaagtaatgcggtgccaaaaaaggaaaccaggtggagagagggagggggagggggagggggagggaaccgatcgctctgggcgggcgagtgatcgctcgcccagtagcatttccggcgggggagcgcccgatccagctccgcccgcgccgggcgactggccaacagcattatcgaatactccgtccatccaaaaaagacaaaccctggtttccgtgcccaacgtttgaccgtccgtcttatttgaaaaaattatgaaaaaaattaaaaagacaagtcacgcataaaatattaatcatgttttatcatctaacaacaatgaaaatacaaattttaaaaaaaattcatataagacggacagtcaaagttggacacgcaaacccagggtttgccttttttttttggacggagggagtacataattgtttagaccaaaagaattcctcacttccggtccaagctctgacttcaggagtgccaacctggttgtgcagaaattgaatccaccaacctggtcgtcttgctggtcagcttctcgccagcctggccacctgcatacaacccttcgcgcaccgtcccgatctcagccatggacgctcgctccgccgtctgtcgccgcttccatgtcctacgcaaatgctccggcgcttccccattgtcctctggcctctgcatagaattcctcctttcctagctcaggccaccgccctcacttccatttgtttcctacgttgtcacgcccagaaattctcgaaccagaatttctaagctgaatgtgcattaaatccctgtccaggaccagccagggtacacaaacgacaattgttgacatacagatccacgtcttataaaaaaaatagaaaagattacaaatgcagcggaaaagataaaagcgagctaaaccgggaagcttgacttcagcagcgggtgtctccactccacaggcaaaccttgacggcagcgacgaaaccaacttcgataaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacaactgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaacctaaagctatgccaatagacaaagtctaagtaataatgtgatccctttttgtgtactagttgaactaagcatggctaagcatttcctaaaccaacatctaatcattttgatacccaggttatcaatggcatagggtaaccaatatgtggctgaggaataggacccatcccacattacattgtaaaagaatgcaacatttaatagaaatgcgggatatttgtaaattgggtacaatatgatcaaatgtaaagcatgacttgccttgctctcgcactgacgagacctcagcaacgtcttcgagaaaccgtggatcgacgaaacggccgaaacctacgcgacaaacaaagcacacaagcaaaacaggctataagactactgaaacaggaaacaaaaccatttttaatggattctttgcatttttcttgatttactgagacttgaatggacttaaacggagctcggatgaattacttatgaattttagaagataaactgtgtttattactataaaagaaaagccttaatgtatttattgcgcaataagtcccagggctgacgtcagcaaggggtggggcggctgcgccgacaggcgggccccactggcagcggcacaaggggagagggagggggcggctggcatgtgggccccactgggcagcggcacagggcgggagagggaggcgccagccgggctcggctcggcctcaaagccgaccggcggccaaggcgaggcggcggcgaggcacggccaccgacggcggtgaccggcggtgcgggaagcggcggcgacggccgaaaggcggcggcagcggctgaaggcgacggcacacgcgcgaaggccggcggcgcacacgggagagggggaaaaaggaagggggagaggggattcctcaccgatgagcacgacggccggcgcgaaggaagaaagcggcggcgacgaccggcgatgccgaggtgcggatgggcggcggcggcacgctaggagaaaacaaagaggggttaggggtagggagagcgaccacggcggctagagcagccggccggagttgggtggaaatggagagctcaccggcgtgcgagggaaacggcgcttcggcgacgattggcggcaaccgaatggtggccgaggtgcgggcgggctcggtgagcgcgacggcggcgactgcgcggcacggcggtggctatagaggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcgggccgggagatgcgggggaatcggcggcgacgtgggcgcgaggtgcgggcgcggagtggaggcgcgacgtggagcggagaaggcggcggcgcggcggattcggcggcggcatgggcggttggagcttcggctccagcggccggaggtgggagacgaccgacaggtggggcccacctgtcggcgtcccgagagagaggagggaggggcggcttgggccggcccacaaggaggagggaccgcgggagagggatggactgggccgacggcccaagaagaggaaaaaaaaaggaggaaaaaggaaaaagaaaaagaagaaaggatttttcctgggattaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacatacgtcaacatgcatgcccaattcctcagctgcgcgctctttgccagtacctgtcgacccgcggcggcgcttgcagcacggctgtcccaggggcgtgcgctccgcccgcacaggccccctagacccaaaactctaacattatatatacaacccaataagtaaattggtagctgaacttgttccaaaaatcttttttttttcacatcgttaatgtaggatcgaatagcaagaactaagccaaccagagaggggtgaatggttgtagtacccaaaaccgaaacttttagcggaattaaaagttaccctcgaatttgatgaagatcggtctgaccggagttgatccgcaagtttgaccgtacctatgccgccggtttgaccagtatagatcgtttggtccaaacgctcgcgtagcctcctccttctctgaccagtataaacttgcggccgaaatgaccgatgtgacggcagtcagggagccctgcgcacgcacctactgctagcaggggaggtggtctgcgaccgccccgtctaatcgccattaatgaggggctttttgcctcgcatttgagctcggaccagttcttctcgcaccggtccgtatgagagatccccacccaacggtgggaatgaatggccggaagtcgtcgataattaagaaggaatgtccgcccgtgtctctcggcgtgatgggatgggcccatgccgcggtaaggcgcgcgtggctccacatgtcggaagacaagacaagcattaattgcctgtaaagaatattttccttacccttgaagctagttttgggcctttgtggtaaccttttaagatataaaaagaggtccatgccccagtggagagaggggcgaatcctagagaagaaaggcacttttattctcccacctaaatcaatcacacacaagagtagggtattatgcttccatagcggccagaacttgtataaacctcttgcatttccatcactctcgaggggcccaaccccctctgcctctctctccatcaactctcagacctacaaccgtgcccctggactgaactagaaagggggtccccacggtcccccgcttgaggagttcacccttcgacatgtatggtaggaggacaaaacaggttggcgtgggagaggatgggccggattggtttggttggatggtttgggggcattcttgaaaactttttttacaaatagacccgtagaaaaacttatttcaggagtggttccttttcacggcgccagtgtgattggtgccatgatcaagatggcgactccaatgtcattggtgtcaatgacctatttgtataaaaaattaaaaataattttcaaaaggactaaaatgcaaatatatttcttccaaataggtccttgacttcattggcaccgtcgtccaatatgacaacgctaatgatggtggcaccgagaaaagggtccatcctagagtaagtttttctagtgtatttgcaagatgaacttattcatttaatttgataaagaaggggaagaaaaatgtcatgcagtttggtgctgaagaaaaaaaattaagtcgttcatttagtctgagggggtgtaaaaattttgtgtgaactaaacggggcctgaatccgaagaagaaaataatgagttacattgaattcagtgaattcggagggaaaaaaacagaagattgaattcagtagttagctagtctgaatccgaagaagaaaattagtgagttactttgaataaagtgagttcggagggaaaaaaagaaaatttgaattcactggttgatttgaatccgaagattaaaaaaaagaagagaaaaaagaagaaaaatagtgagttactctgaattcagtgagttcgggggaaaaaacgaaagtttgaattcagtggttgatttgaatctgaagataaaaaaataataaaaatagtgagttactttgaattcagatttgaattcagtgagttcggaggaaaaacaacaaaagtttgaattcagtggttgatttgaatctgaagataaaacgaacgaagaagaaaataatgagttacattgaattcagtgaattcggagggaaaaaaaacagaagattgaattcagcagttagctagtctgaatccgaagaagaaaattagtgagttactttgaattcagtgagttcggagggaaaaaaag

SEQ ID NO: 64289 - DNA, 903 bp, Oryza sativa
tatataagaaagttttaatataatgaaaaagttaaatatgcgaacacggcccaaatttataggttctatatccgatatctcttccacaggctttattttcctttttatacacatactactacctcagcggcgtttatgagttctgattttctttttttgttgaactggatcgatggaaattctgaactttgtacatttgtgtgtgtagttggtgtgctaaaattttttcaagtatacggacacacatttgaagtattaaacgtagactaataacaaaacaaattacagattccgcttgtaaactgcgagacgaatctattaagcctaattaatccatcatttgcaaatgtttactgtagcaccacattgttaaatcatggcgtaattagactcaaaagatttgtctcgcaatttacatacaaactgtacagttggtttttttgtctacatttaatgctccatgcatgtgtccaaatatttgatgtgacggtaaagttggaagtttgaagaaaatatcttgaattgtagtactacgttttgtgttctgttttctgggctcccgatgcattgaataagtgaaaaaatggggttgcaaagctgaagctaaaaccttgtaatcccttgtagaaattaggatatatatttttttgtcggggaaaagttaggatatctaggaagaggactatttttcgaggggatagggaagaggacactgcacacattcttttccccctcttaagttcatacgacttgtgacagtgaacttaggctgtgttcaggaggtgagttgggagctcacctcctgcgcacgtaaaacagagcaacacattttcttttgattaattaagtatttacctttttaaaaaatagtttaatatgattttttaaaagcgggctgcagga

SEQ ID NO: 64290 - DNA, 1847 bp, Oryza sativa
tcaactgccaatcataaattcataacatagaagaccccatgactaattaattatgaggaaggtcataattaatggggataaggttggaacagtgagatgagaagacagatgggaggtggtattctgaatttctgatgcgagtctagtggagcttacagggatcgcaaactatcattctttaaacttcagtgcctattcttttaaccagtgtcattcttttaagtaaatgtgtgcatcatgtcaatactcactgctgtcatcccaaagttacatctttcgatgaaatgtgattatattggtagaacataagagaatatccagtgcatgactatattgttctttgcatctactgatacggaaaatatacaattgccaataaatgcccctaaatcttgcttcttgcaaaagaaaaacaacaagacagatgacaatggcatcagaacctagtctattggctaagtcattgacattgtaatgtcacaagggaaatctaatgaaatatcttggttatggaagtaacttgcagaaaatcaatacatctgttttgtaatagaaaatgagacagctaagcgcaatttgcaatttccctccaaattaagcaagtgtacaaggatatatacctcaagcagattgtacctctccagtagtgttattcttggcaaaacacctattgaaagctttactgggataagaaacttcaaaattctcctataaaattgagcattgatcagagttcgaacaggttgcatcataaattatatgctagaaaacttcaaaccccatgtaatacaagtacctcaaatttgactcatactgaggattacagtgcaccaaagcataagttagcttctgatctgcctgatttcaatagaacaaaaccagggaaaaaaaaaactttggtatcagtggtctcatcattttgtgtgcaagtaccacaaccatgtcgagagggagagagagcttacaacaagaaagttctcattaaacacctctaatctgccggtataatacatataagtgacctgaaacattatgcataatcaatagtttattagaaatggcaaggtaattgtaagtctttaagacagaaacagttaccagatttttgctaatcttaccttatctttcactggaaaatcttcaaaatcaaaattcctggcagtttcaatacttcttatgacactgcgacaaaggtgaactgttccaagctgcataatttaagaatattgttatatcgaagtatcgaactatagagtagatacatgtgtttgtgcatagtacacttcactatataaaaaatatatatgtattgagagtaccactttacaagaaaataatccttactctgaagtaaattttaaatagctggcaggtaacatagagtgctccaatgcgtttaggccctttaacctgtaaatttggaaataaaatagcttcagaacacaatccagacaagcataaacataatccatgaaagaacaagcacaaagaaaattttctgtgcaaaacatcatggtttaggttgcaactgctaaatggtagtaaggaactatgagccagaacatctctaacatcaatgttacacccataataacaaaaggcaacagaactcccttcaattcaattatcgtgcttacgcagctacttattaccactcaagaaagaagaatcattttagagtttcataccgcgagtgcaccgaaaaccttcatcaggaaggacccagcagactgcagcttgtcagggttcttcccactcgttgcaagctccctatctgcctacacaaccaagcaaacaaacaaagcttccattaggcatgagccgaaaattttcacattcacagaacc

SEQ ID NO: 64291 - DNA, 4062 bp, Oryza sativa
attcctgcagccccgcggaggagcggggggaggaggtcggagaggtgcgggtagcggtcggcggcgaggcgcgggaagtccgggaaggcggagagcgcgtcggagagcggggcgggggcctgcgcggaggagacggcgaggagggaggcgagcgcggcgccgtccgacgaggagacggagtccgccacgcgggagaggtagtcggcgatgcggcggtgcgcctctcccatgctcaggtacgccgccatctccggcgcggcggctgcggcgccgccggggggtagggttcgtggtttcggcggcggcggcggcggcgatggcgtcggagtcggacccgaagaagggcggtttctgatttctgaagggtggtgacgatcgccgatcctggccgtcggatgggaaatcgatgcttgggggtagttttggtttttggaagcgatatcagatggatttgggatttgatttgcagtagataaaaacattttggccgacattttgataattgaaagctttattgttgcaaatggtagtatacaagaggccaagagcagagaaaaagggatttaacggcctgttcactttgacgcaaaaaaaaaaccttaccaaaatttagttgccaaaattttggcaactatgccaaaattttagtaggatttcttatatagttactaaaatttggtagcaaactaaatgtagacatttttttgacaatattatcaaaatttggtaaggttgaaaatgacattaaagtgaacaggccctaaaaagatagacatttctcagaaatttcagtaactatgacacaaaataagaaaagttatatgctaaccgacaggaaaccattgaaattaggatatgaagatgtaccactccatatgtgatactcatgtatattttagagaggacaaaaataataacgtagtagttataaaaagccactgttgggattggaaatacatcaacaaaagaacactttagctaggtcattctgtaagtcataaaattctgtttttctcactgcatcatgacacaagagtgcgaggggatggtttgtgccttctttttcatggtttaggtactcgcttttagtaggttttttttctcgtgcaatactaatttgatgcactacaccatattcacatcaggagtaatatttgtgtgatttgccctcgctcgcatggttgcctcatattggttagactatatatttgacggtcccattatatttcttcagttttcattggaaagaagaaattttgtttgttgaatacacgctccattcattcttccattcctcttcttgtggccgatacattttcgattgttatcttttagtttccactgtcaacttatcagtcgtattttgttatatgtatgacgaccttgttgttctcttctagcctccaccaactatgtgtatttacacctatgctataattttgcatatcaccattggttattgctaacattagccggttcttattggcgacaaaagtttggcacatctaatacaatttcggttaattgtccggtctatgccacagtgttcagtgttcgatagtgttgcaacttgcaagtgatcatcaagacgcaaggggagcaaggattaatttggaaattggaggaaccggccagacgaccactgtatcgggaagaactcaccgttagcttgacgaatggctgtgtagacgtttggtcggcattgtatcataatgattagaatgagaactgaaaaatcaggatttatctccatcgtcccttgtcgctttggcttggtcagagtgtcaagaaagtacatgtatttttgcttgatcttgctagatctcccttgtcgcttggattatcctttaatgtacaaagtcatatgtcaatagaaaagacaagagaaactagatatgaatgcctttttaacactaactaaaccaaacatgatgcacgtacggtttataaggatttgcaattttatcctaaatcaccgagatagattaaataagttcatagcgcaatatcatgctaacacatactgtataaatataaaagactttgtatgcgctcttcaaatcatgtctatatgactatatggagatagatgaaatatgaagaagagaagtcttttagattcactagcacataaaagttacctgctatcatactttttcatctccctttaaccaaattataagaagctaactaaaaatcttcaacgtttttaattaaaatcaatgttcaaagttaaaactaataaaatctatgaaagttactatgatgttgtggcctctcaggtccagttgctgatgcaaccgaataggtaggttttgtagtgcagcctagaacactacaagttctatcgaacaatcccatatgttaaaaaagatacattatttaagataacccaaacaaatgtgaacaaaatatcagatacaaaaaatgcagctaaggcctggtttagttacccaaatttttttcccaaaaacatcacatcgaatctttggatacatgcatgaagcattaaatatatattataaaaaaacctaattgcacagttagaggggaaatcgcgagacgaatcttttaagtctaattagtccatgattagccataagtgctacagtaacccacatgtgctaatgacggattaattagtctcaaaagattcgtctcgtggtttccagacgagttatgaaattagttttatcattcttatctgaaaaccccttccgacatccggtcaaacatccgatgtgacactaaaaaattttcttttcgcgaactaaacatgcaccaaggccgagtttagtttcgaactttttcttcaaacttccaatttttccatcatatcaaaactttcctacacacacaaatttccaacttttccatcacatcgttccaatttcaatcaaactttcaattttgacgtgaactaaacacaccctaaagagcgaaaaaagtttctacgtgtctcatcgagcttataaaaagtctttgcattcacacatatttctctccaccaaagtcaatcaaataaatactcatcatccattccgtgtggaaaagaaaacaaaacaaggaacggccaccaatcattccaacgatatcacatcatgcaaccaaacaaaatcaacaaaagcagaaaggacatttctcatgcattcactgtcacaacccataaggccataataacctgcttaaccacaaaagaacagtatagtctttcagcctctcctataagtactccccaactcctcctcctcggttttcatgccacgcttttcaaattgctaaacaatacgtttttttttaaaagtttatatacgaaagttgctttaaaaaatcatattgattcaattttttttaaaaaaattaactaaaacttaattaatgacgtgttaaacgctgcttcgttttgcgtgccggagacactcccgaacagaggctaatagctcatccctgcatcatcatcatcatcatgatcatcatgaatcaatcacccgccgtccgttgcatcggacggcggaggatcgccggacgccaacccggattcaaaacctttccgctacattgactgaccgctccacccccctgcaaaatccccaaactacccctctcctcctcctcctccttcccttgtctgaacggggggagctgtggccacacctctccccccacctcctcctcctctagggtttcctcccaatcccctccatggccaagaccaagcagggcaagaaggacgtcgaatcctacaccatcaagggcaccaccaagatcgtccgaggtacgggccgcttctcgctttcttcatttccggccaagatttgggtctctttagtttcttcatgagggtttgtggtggtggtgtggaagtgggggattgcgtgctgatgcgggcgtcggacacggagaaggcgccgtacgtggggagggtggagaggctggagacggacgggagggggagcgtgcgggtgcgggtgcggtggtactaccggccggaggagtccagggcgggaggaggcagttccatggcgccaaggagctgttcctctccgaccacttcgacaccca

SEQ ID NO: 64292 - DNA, 2466 bp, Oryza sativa
cagggtgcatgaccatctgaggtttctttagaacttgatgctctgtgcctaattattctctgcctttctcaaacatatagtataaagtgtcagttacatggtcttctgcggatgagatatatgactcaaagaacactttagagctcatattgctgatggaacgtgctagtttctttagtgattgtagccgcttttacattattgtcttgagctctgttttggcaattggcaatttggcatgtatattgttcttttgcttggatttttgaagtattggcttgggctctgtttccgtatgggatacattgggggtgaaggtgccgttcgtgttctacaatatttgtatattttgtctaagaagagtttagaaactgacatgagtacatgactaagaacttttcacaattcgtgcccttccctaatccccaataaatgagtgacgcctgttggtaatgaaactgtcatctcgtccatacatcagtggcaagtatctaacctacctaggatgatgtcaacgaatgcatacatggtgtatgaagttgtaggcatttaatactacatgaatgcacaaagtaaacatcattacaatcattgatcaatttacatacttattgatgtttcacttatatctgtcctgatattatgatagttatctttctgttttcctacttctgaaagcaaacctatttgaaacggatgaatgggtgattcctgtgttgcccttcagagtgtttgctgcaactaacatgctgcgttctgtcgtatttcactgctcaccaggttgtctgctgagcattttttttgcgtgtacttcattgttagatcagtcaactgttacttttctttaaatacaaaatgtttggcaacataaatgctctattccgcatgcctatgtgttgtcatgcactcatgctacacagtttccaatttgctgcaccatttctccaattttttttcttgtttattattgaatattcaacttttaacttgtgcaggttccatccatcttgtatgggaatgaccattgagcaggccaaaaaattagatcatttcctgtgcgcagattgtgtcaaagaaaatggcacgaagagaccttcaaattcatatccagcatcatcaaattctgattctaaggttggttacttaacctctatctcttgactgactgtctaccgatgttctgtttgaagataacttatctttaattctttaaaactttaagcgcagtagaaatttgatttcattgtaattacacttaaaaaaaaactagtgtcttgtttttgcttctcaattacacaggtcattatttgatgttgacagagaaatactcgaacttttttttcaaactttgctgttatgaactccctgaaccgatgcatgcatatgtggggtcttatgttcttgcatgtcttatccttgtcaaaactaatccacagtattgacatcaatttatcgttttcttcattatgatttttcttgcaccttatttcccacacaagtaagttgttgagcattatgttttcaatttcctatggacatttgtattaggaagaaaggctatacacattgcctttgcacaacatcaatgatgttctttattagcatcgtactacgctgttattgataataaattaatttatggtttggaaaagcaagtgtacactctaccattcgtgtttccaagcttctctttgaaaatatcagtaaaaaccttgcaaatgaatcatatggaaacagcagctagttttgtaacctgcaagatacattttttccacccatcagcattttcgatgggcatttcactcagagtaatttcaatatataaaatttctctcacctaccaactgcaggttgagccaaaaaagcggaagaggtaattgctgtgacacgagccatccgtggtgaggagatgcactgtttatggcgtcagctcttcattgctggtgcaaagtcaaaacgtggagggtgtacagtgcagatgaagagctaggctaggtccaagatcgcgttaacttatcatttgcccgaatttgggaacgtttccatcagtctaggcaaaagaacgaacttcattgatgctgttggctcgttcagttgtagccagtgtggactggatgagtgtcagcgtgttttagctttttgcctggtacaggaaaacgttcccagcgtggatgatgttgatgatagcttaactgtagtttcataatttgggtgtccctgagttctgtgacctgtttattgataagtgaatgccgcatgatgatgctgttgctgcaaaattgcaatctttttagtcgatggctcaatgccgagtctacatgctgaaattcacattgtttactgggaagaagtggactacgcacaactaagggtgtgtttgaggagatggggaagatacgcaaaacgaggtgagccattaactcataattaattgagtattaactattttaaatttcaaaaatggat

SEQ ID NO: 64293 - DNA, 1008 bp, Oryza sativa
cagtagagatgcggcatatggatggcacagcagatggatctctggctccagctcgtgcagttaacaaagcagcatgtttctctgcagctgcaactgcttctgatcctgtagcaccattggagcccaaagcctccaaaagagcctgtgaaaaagaaaccacagcagtgacataagagattgaaggagtcagcagatcagaaacacatgatggctcttatagccttcattctgctagcctgctcgctaagacagttaacactgtaatgttaccaacctgaggagttgctggcaacctgcataagctgttatccaagctctgaccaaacgcagacaattctcgctcgatgagatcccttgagttagttgacatgtctaccacagcattacaagcagggatgattgttcttgacgcatatcctcttgcagataatggctgttgctcccaaaatgttgatgcctcctatatatagcaagtttggcaacatctttcaagaagtgatcatgcccattgtattcaattattgagacatatatcaagagtaagaagagtgtaagacccaaatccatgaatccccacctaagatatttctaatagctcctagtttcctatggtgctaccttcataaagctgccaagccactataatgaacataattatgacttgagctcactacgctgctgtattagatggaaagttactaaaatggcaaccagtaaccatgctggaaagaatgttgataagtaactgcttctatttctatattcatgtctatatctaaaactttctttaaaaaattgaatagcgaactaagtaaagagctagtaaggaaaagtacaaaggctccagactaaccatattggcccgcagaagagcattgtaaatgcactcaagttctgatctacgagcatcaaattcttctattttcttccactttttcttcaaggaatcttccgcttctttccactcagcacataacttgtacagacgctgtacctcagaatcagtgt

SEQ ID NO: 64294 - DNA, 2677 bp, Oryza sativa
tcaatcctcaagtgggttcagtactctgaactgtgatatctgtagtactatacacttataattagcattggttcttcaggttaattttgtatcggttggagaccattgatctgagaagaatgacaaatgatgaaaagattgctttctggatcaacatacacaacgcattgttgatgcatgtaatgttccttctcatttcaaattatgcacagtgaattgtaactgctactgttctgcctactcattctctgaagtctgaatataatgacaattggcactaacttccacaggcatatctcaagtatggcatcccacagaaccatctgaagaagacatcacttcttgtcaaggtaaagtgggacctcactcctggcagaatcgtcaaaatgacctcgagaacaagtaaaagttttttttccttcttgatcttgttctgagactgtctcgaaatgcttccttcaggctgaatgcaagattgccgggagaaccatcaatgcagcagtcatccaggggttggttcttggatgtagcactcactgtccaggacaggtatgtgtgtgtggacatcatttggtcaagaacctagtgaagaacagaatgttcctacatagtacttgatgagatgtttaaacacaaatttttaacctgaatttttgttgatccttttaatgcaagcagtggctgaggactttgcttcacccaaggatcaaaagcaaagcgagcaaagcaggaggggaatggcaagcctttgccatccatcaatcggagcctcttttgcgctttgcgctttgttcaggaagccattccgatcccgcggtaaaaaaaaagaacacaccatcccatctcttaattttttcacctgacagaaacagtaaccaagctaggcatgccatttcctgaacactctaaatctgaacttctgaacttctgaacatgaacataatcctagtagagtacagtacgcatgtttctcaaagtgttaaagctatccatgcaaagcaaatcctgacatgacacaatcatgaaagaaacttgacaagtagtatatctcctctcttttctttctcatttcttcacctcgatatgagctacctaccttaattacctagcagctgctgctgctggaaacttgtaccatggaatgtttcagcagcagcagcactgcatccactgcactttgttcatcatcatttctgcatcgaagtaagcatactccactacagtagtagaagaggaattcatgattggtgatgtgtgttcatggcgatggcaggtgagggtgctgagcccgaagcggctgtcgcagcagctggaggcggcgagggaggagtacatccgggcgacggtcggggtgaggaaggagcagcgggtgacgctgccgaagctggtggagtcgtacgccagggacgcgaggctgtcgccggagaggctcgtcgacgccgtgcagaggtgcctgccggagagcctgagggcggcggtgcagcggtgccgccagagcaggccggcgagcaaggtcgtcgagtgggccccctaccgccacagcttccgctacctgctcgccagggacctcgccttcccccacctcacctagctcaccgatcttggcgtccgccatgaatggcttggcttgagctgtgtcaagctgagtctgagtgagtgagattagaagaagatgattagttcatgtgttgatagatttggttctaggatgttacacctaattatctaggattgtgtttgtgtgtgtggggggggggggggagagagattaattgagctgtgcagagtgtgatctgtgcgcttgtaaagataaaattcttttttatttttgtagatacagagaggaaaaaaaatagaggaaagttgagaccaagtgtcagttcagttcagttcagttcaaatctttaatctgaaactgaaagagaaacataagtatcgtttagttcagttccagttccagacacagttcagaaattcagatttgaatatgcaaatcaaagtcgccccctttcgtttcaaattccttctacgatctgtgcgggtttcgtggtcaccgccacatccaataacatgacatgcagatcctctgcagaattgctgaaacagtaagcaatggataatatgagggtccggatccacacaataggttgagttctttgggttgtgtttcaagtggccaactcaccttcgtttttctcgtgcacgttttccaaactagcatatacttaattaatcatgcaccaaacaaagaatcatattaatacatttttttaaaaaaaatagcatatacttaattaatcaatcatgtactaataagtcactctattttatgtgtgagagtaattagcttccaacgataagcaaagaacacagcctttagtgtctactactacatcagcagtactgcagacaattgaacacaaaatatgtcgtgcgcgctcctgctgatggtggcgacggtggataggaccttttcgtgactaaaatgaaaaatacagggactgaagcttagggtgatctaaaactctaaactttccatcacatcacatcacataaaaacttttctactcacataaactttcaactttttttccaaactaccaactttccccaaacttcggaactaaacacagccttaaaaatccaagagagggatgataatgaaaatgttctgttc

SEQ ID NO: 64295 - DNA, 8057 bp, Oryza sativa
ttcattaacatcaatatgaatgtgggaaatgctagaatgacttatattgtgaaacggagggagtacatactaaatgcctgaacaacttgctgccactcccaggacctccaacaccaacaaagatatgaacgagagaccattttgagccagattgatcgcagccgaggatgtcttcttaacaagctcaaagaatacaaggggcaggactgtgaagtaatacatgaggctgcttcttttgctggtgaaaaaattgaacatgatgatggtctcatgctacctccgtactcaaatcatgtcaccaattcgtttgttcttgatgatctgtatcctccaagttacttggccaagttaaagtgtatgcacaacggattgggttctggtgggactaaccaagatgttacaaagacaaacaggctggagaacaggaatggtagcatgccaaacggcaattcacaaggaggaattagatcttttgttggatggcttgctaaaactgcagtaatggttgtaggtgctgtatctatcatgaaggctgctggttacgagccagtgataggaagacacagcataaaattggatatggcaggtttgttcagtaaggaggcaaccagtggaaaagatcaggctactgtccaatgccctcctggtaaagtaatggttctcgaagatggcagggctcactgtgttgtgaaggaaagagtcgagatacctttcgacaccaacctcgcctctccaaatgcaagttatgggttaggctgaaattgggcttttgtcaatattaggatttagctagtctttgaggccctttatatgatcttctgtagaatgtgccgagcacacttgtctaaagattgaagcctatgtattatatctatctatgatcgtccatgtcttgctaattgccctcgttggtgaactccatcagtatgctgctcagttgataccagtattatgtcatcagcagtttggtttcatgtgttgtgtatgttgtctcttgtattggtgatgcggtggagggatagatggcgattttactctctccgtctcaaaaattgagggattttggttacagggtggcatattctatgagcatgttcagattctaggatgtgtgtcattcaaccaaatcttttatattttaggataggacgaagggagtatgttagtacctgtcattgtatgtctatgtcaggtcctgaaggcacggcatattgaggctcgaaaagggccaacctgtgccttcgaagctgtgcaacaagaatctgaatccagcacaaaatttctcaccaggaggaaacaaggtagtagtacatgtttctgacgatcctttcgaggaatctcatctcttcgctgtcatgtgtcgtagtagaatcgctgtgtgaagcacaggaaattaagctgtttgctgccaacggaatgaagctgcgtattacagtacttacatacaaactctggtgcgcatatgctagctgcagaacagcaatggcagttctttttttctgaacttggttaatttttatttccaaataacttattccatttccaagtgaaggaactaagctagatggatgaacgagtttccatcaagttacagcacagttgacaggatcgatcgagttatacattgttttgaacagcaggtaaaaactcgtgttgctttgcctataaccttaagcatgtggacttgcgaagcactagtaattaaaccgatgtccaatggattagtgagtagagagtatatgggcctggctaagtagcataggtagatttagaacatgggccggcgagcgcatctgatggatgatggatggggaattccatggatgctcgctagcgatctaggctgggactctatacgtgcatgcctaattgggagtaagctagtaataaatactatctccgtccgacaatataatgaatggttatatagagaaaatctcttatattctcggatagaggttgtagcggattaattttcatatgaaattaaaaaataatcataaatttagattgtatcactaaaaatctataaattcgaagcataaaaatttctctaatccatacatgaaaaatgccatttaagcactgtagtggccaaaaaaaatcagtagcaatcattaagcgctatagcgaccgctaagtttctatatatcatgtttaatctgtcgcctctataatattgttattgtgattgctatgaacactatttattgggagcaatgagaaaccgtgagaaataaaccacttgacataaaaattaaagcgggttgctgcatcgtctgttcgccgcaccctagctaagctaaaccattgatgccacgaccgatgtagccttcaattcaggcgcgggcagcatcgatcgtgtgatgtccaccgcaaacacgaaagaaattaagagatctatagcaatgttgggagtgatatataggcagcatgcacgccattgacctgctgatcgatcagatcccatatccgtgcaatgcaacaacttgcaaaagtggccgtggttcacactttcacacaccacaaggccggccggccgtccgtcggttcacatccccgtgtgcctttgcacgcgcctactcgtttcgttccataaaagtccaaatgtaaaactgaagaagatactataatataatacaaatatacaacaaatctaaacttcatcttaattttaagttggtttttcttttacggaaaaaagaaccagacgagacatgctcgctcagctgtaattacaggtcgcttttgcgtgacctcaccactgacgttaccgctgtatagtaccagcaacaggtagccgcgttaaagcaaggataataataaagccaactgcttactatctatcagctcactcatatagtggttaactcttcactataaatatatggtccacctgtctatctcacatattttcttggttcctgtgcctaagccggctgtaaacttacagcccgcttctcatctctcccctctcctctctcatccaattcagcattcagtcttcttatagccctctattatacttgacctcaccactgacgttaccgcttcaccagcaacaggtagccgcgttagagcaaggataataataaagccaactgcttacttatagcctatctatcaactcactcatatagtggttaactcttcactataaatatatggtccacctatctgtctcacatattttcttggttcctgtgcctaagccggctgtaaacttacagcccgtttctcatctctcccctcttctctctcatccaccttagcattcactcttcttatagctctttattatacttgctcttacacggtacaaatcgcgcgcctcctggctagtagctacgactccatagctgcagcctgcagccttgctgtaatagccagcagcagagcaactattctacacaaaatcgaagctcgttataagaaaaaacggttaataacgaatgaaaaacaatttactttctccatcctaaaatataaatatttttagcattgtgtcgagtcaaacatttttaactttaactattaatagcaaaatataaaaaaagatcaatcatgtaaaattgatgttactagatttatcattcaacaaactatcataatatgtaattctttttatttaaaatatcttatttttatagatgttgttggttaaagtaacgtctcgaagactgtatagaagtccaaaaatatattttaggatggaaggagtatgatacagtgtgtcttaacgagccgtaacgatttaaaaaccaacactacgagataaacttataattaaaaacatcaaaaatcaactcttcaaaacttaagttttagaaattaaatcttagttgcgagtgaataagctgaagaatctggcaaagctaccaatgcccatcaagctggacaccacacactgttcaactccaacacgaaaacgccggccttttcatctcctgctctgcttgcacaccgctgtactcagcacgcgaatgaaccgtgtggaggaaccaagacgccgaaaatgtcgatctccgtgtgtacttatatggattatttgtcaggcaaatgaaagtgatcgatcgtcagatcgcgatggtttttcacgtactttaattgctccctgaaaacgatcgggagattaattgatagctgcagcgcgctaattaaccctgctctgaaaacgaacgatttggactagactatatcctctgtgatcgatcgattatcccacccaattcagcatttacaatgctcttcttttggcacatttttcccctcaaaattaagacgatactactcttaataattaaaacatcacaaaaagagaaaaaagttggactcactttctaggtccttccttggatgactcgctggttcctccaattgatactaaaaatattacgtatacaattactaatttgaaacacttcctgtttcatcacaacttttgtctctacgtgtcccgtcaatctgtcatgatgcgctgccctcaatttttggagtattagctcaaacaagacgacgaaattgatcgttgtttagtcaattgtcttgtagcactacaggtttctttgtttgttcagcatacaaattattgggtttcaaaaaaaagcatacaaagtggagtattgctaggtatggaccagtattttgagaggttgagacaaacacgtggagaaatcaagcgccggagaatttctattcacattttttttttcatctccatactctttatgttcaaacatcaactcaaatctatcaccaacaaaattcctactactaattcttcgagaggtaattactagtaatttgcagtgctaatcaatttcctcatcgatcggcagcatctcagccgatgatatcctcgtccgtccgatcgggatccgacggccgagcagcgccgggcccaccagcagcatcagaggttttccactgttcgcgtccttgctggctgttcccatcggagtggttcgacatattttatcgaatccagctcgcatttggagatcgaattgggggatttgaatccccaaatttggtttcgatcgattcagttcaattgtgtcgtcgtctcgctcactcggtgatcatgtcgagttcgggaatggcggtgagatcggtagcgaactgcctccccttcccgccgccgcggcgcgccgccaccggccgccgcttccccgccgccgccgccgccgccgacgcattgctcttgcagtaatcagacgcgtcgtactcgtactcctcctccggcggagcgaacacgagcggcgccacggacccgcgccgccgccggccgccgccgcatccggatgtggtgctgctgctgctggcggcagcgagcgcggcggatgccttgacggcgagcgccgcgacctcctcgcggcgcatcccgcgcctccgcacctcgcccgggagcacgaagtagatctgcccggggcggagctccgcggcggcggcgacggccgcgacgggtccctcgaagcccatcttgtcggcgtcgcagaggaagaagcgccgccccacatcctcctcctccccctccgccgccgcgacatcctccagcacccgcgccgccgtcgcggggcgcgggtactcgcgcagctcgcccgtcggcagcagcaccatcgccgtcgacgccgccatccccgcctcggccatcgccgccgccacgccgctcgacaagcagagccccatgccgatgcgttggtagtacaagtagtgtgaggaggttgaggaagaaagaggagagagcaatggagattgatgggtgagatgagatggcgatggagaggtggaggtggaggggcgcggctttatatacacgggggaggaggaagacgagggggttttgtcgtgttgcttggagaaggggagcatgacagcctggcggtttgctggtggggccagcgcgcgcgaggaatcggggatttttttttcttttccttttttccttttttgttttttttaccgttttactgctactgctccggtgtgtaaatacgtggtggatacgaaggttgcgtgggcggcacgtagcgtagatggcggcgtggcagcaaagggtgccaaacatagagagctttaaattacactgaaaataagtaaattcattatacttaattttatatatgcgtcgagaataaccgaggtagattagttagcgaataataactgaggtggttaacttaggtgaataaaggtaaatatagcggcagtactaattatcctccaaattaagcagctgataattaagatagcgtgcagtaaaaagagtgatgcatttggcacaagacactaccaacttttatgctttgaagatggctatacgtatgaaacgtgtgtatgcaggagcggatccatgcctcggatcatccggcccatgcatggtccgagtcctaggattgaatgcacattatgcaatataaaattttaccatgttcattcaagtttatcctaaactgtaatgggttggccgagaccttgggtcaagctaggctggatccgttcccaaatctatgtccgactcaacaagtatatagatatggctgttgttttcgtaaactcatatgaagagaaattgaacgcatgaattggtggattagacgaggtcggatactaaatatataaggtatagttgtatgtgtagtaggactctttatgttcgaattatggccctgtttagatttcaacttttttttctttaaactttcaacttttccgtcacgtcgaattttcctacacaacaaactttcaacttttccgtcacattatttcaatttttttaaactttaaattttagcatgaaactaaacacagtctatatgtgttaaatagagtaatgggagataaagccgcgctagctagctagcttttgtaaaaacgaaggcgccagtatattgcggtggtgctatacatgctacgtactgctacttcctccgtttaatattataagactttttaggattgtcaatatttatatatatgttaataaatctagacatgtatgtgcctagattaattaacatctatatgaacgtagacaatgctagaaagttttataacctgaaacggagttagcagctagctactcagctactcgtccggctttacaaaagaaacgtggaaataccatggcacttgctttgctactccgtagctagttgactcgtaaaggatcagcagatctcaaatcgtatcacgatcgatttttattggggcaagcaaggttcgtcgatgtcgtcatagtacgtagcagtacgtactactacaagtatgtgtatgcacagttgcacactctataactataactagctagggatagtagttgataaaaaatggtgtcgacatatatacatactccctccatcctaaaatgtttaacgtcgttgactttttttaaaaatatttgaccgttagccttattcaaaaaatttaagtaattattaattcttttcctatcgcttgatttattgttaaatatatttttatgcatacatatagttttacacatttcataaaagtttttgaataagatgaacggtcaaacatgttttaaaaagtcaacaacgtcaaacatttagggaaggagggagtatatatatatatatatatagtgggaaatggaaaaaaaagaaaaacagtgggcacaacaaattgcgcgatacaaaagtataaacacgaaagccgtacgtgtgtcaatagagcctaacgagctagtaccaaaattaatggggagagctaaggtagcagatagatagccaaattggaggccagtcaggacattcatcaatgtcgatcgatcatatcgtacatggttttgcagaaaatcgttggcgttgaagctagctataagctagctacgtactgtacgtacataccctagccaaaaggtgacctgaaagcaccataggtatacgtagttcgtgcttgcagctggtgtggtttgtttcctcgggagcagaagtcactagacgatgcagctagctagttgagaaaaccaggtcaatctatctctatcggttcatggttctttggttcaaccacggtcgaagcgatgaaccaga

SEQ ID NO: 64296 - DNA, 25716 bp, Oryza sativa
taatacatataataaaatatgtgtttaaaagttaattaataacattatctattgaaatacagagagagtatttaaatctggtccagttttttcaaccatatatggatccgagtggggacgagacacacggtgaagcaaattgtgtgcatgcatctaaatatgatatggcgcaccaatataatccatgcatgcaccaaagtgggtactcctatcaaacacgtcccaaggggcatgccgcatgcacgagatctaactatgcgatggagccatggaggggacgacggccctgagacggacgcgtggcggtgtgcatgtggaccttgagatgcagggtcacgtggctgcccccgtggcccccgccctccacgctggcacctgatcgatatatcagtgtctctgtgctttcaatgcttttgtatatattggtcctgcgcccacaaaaattcggtgcattcgaatattgtggttacataacatggatatgtgcgatgcattcagctaggtctctgctgctgcatatgcatatgcatatgcttctttcttttcttcgaggtgcgctgcattcggcgtgctatagctggcacgtacttacgttagttcggtcactgtggcctaccactactcctgctgtgccacgtatcagcatgcaattgcactagctcatctgaaaacaatgttatgttcaattgagctattcatttaatcatgggaaaagaatacttagaatctgtttaggatagataagattctaaaaacaactgattgatatatatgccaacttttaagaatttggattctgacttcttgttttctttttattctaccactacagttaacctaataactactccagcatgtacgctaataccctgcgacactgcgtgtatagttaggtcgcagatcgatcgatcttcaaagttgaaacttcagtcaacaaaaaaaaaaggaaaaatcgccggtcacatggtgaggctccaaaaatgaagggcatccatacaaatgtacaatgctatgctagctatagctaccttatccatgttagtcctacatactaacatccatgtgaccgtgcctttgttattttacattgcaatcggcaatagctcgcgtgtctctgctcgcgtcgcacgaagccgatatgttttatataatctgtctatcactaatccaactactaccacccaacgactttatcgatcccatcaaacagtgtcccaattagtagcagtaataacatactcaatataatgttcaattgtggatgacgagacctgatgtacagtacaattcatcatcatcgatccggaatatattaaaaattctaaaaagggagttcgagagctccggattggaggaatgaaaaacatgtgccaataattgtaaccctgctgacccactgtagcacgcagtacgcgcgctggaggaccactgttgatctgtcggcccctgcctgcaaggccaagagaggccaccaataattccaccaccatacaatgatacaaatgcatgtactattatattgtgtatatatacgcgtgtccaggtgaatgaacacaataatattctgaaaacgaattaaatatcccctccagacacgcgcacattttaaaatttaattttcaaaacattaggctaacaattattataatataaattaatttttgtttgttgaaataatatcatcggattaatatttaaatttacttttgtatggttataatattattaaaaaaccttatatagtatacagttaaatattagttttagagattgtattaaatttaatcatatcttatattatactatttcttttttaaatgtacgatgttattatttttaataatatctaaccattcgtcttattaaaatctaatataaatactccctccgttttaaaatgtttgacatcgttgactttttaacacttgtttgaccattcatcttattaaatttttttttgaaatatgtaaacctatatgtgtacatgaaagtatgtttaacaataaatcaaatgatatgaaaagaataaataattacttaaattttttgaataagacgaatggtcaaacatatattaaaaagtcaacggtgtcaaacattttgaaacggagggagtatataaaaagtataagttaagattatattttgtttgaggataaaacaagttacaataaaataaatgatatttataaaattttttagtaagataaatagttaaaacatatattttggaatggagtaagtattatataggagtacgatccaaaaaatacacgcagaaaagcagatcgatcgatcgatcaataatttcattcgcaggtaaagcggcgtgacacgtcgacgagcagcctgcaaagcaggcgacgtccgtggcggcgtgcatgcagctacgccaattaacgccaccacccaatgcgcgccaattccagattccccgagtggggcccacatgcagtagggggggtctagctagggggacgcggggggcgtctcgaccatgttcggccacgtcgtcgctgggtcacatggaccggacgcgaacgcatgggtccgatccggtcacgtctcgtcccgggagtgtgggactcgggcctgggtccgacccagggtggcagtgcatcgtgccaacaacaataattgtgggttggatggatggatatgtccaaaggacatgcgtgcatgcaaacgttaggcaaaaaaagaaaaaaaatagaaacaaaagaaagaaatatatatgtgatcgagcgtgtaattggactgtcatgtcgaattggtacgggtacaacaattcgtataccttttgtatacgtacataacaaaaaataaacgattttgctaacgatcactcgcgtgattttttttctgacatttcaccttttttttcaggctcgtcagccggcgcgtcggacaccagcacgtcggccaccgtgtcggagaagcacgatgacacggtggcctttgaccgccagccgccggtagcacggccaacactgatcggtgagagacatcgtttctctcagaaatataaaattacagtcctatataactaaatttatatttgtaaattcagttaatttgacgtgtaagtgcactgtaattttgataaaaataatatgtaagtaaatatgtatttattattttctttaaaatataaaattacagtcctatataactaaaattacatttataaatttagctgagttgacatgtaagtgcactgtattttgataaaaataatgcgtaagtaaatatgtatttattattttatttaaaatataaaattacagtcttatataactaaaaattacatatgtaaatttagttgatatgacatgtaagtgcactgtaattttgataaaaatattgtgtaagtaaatttgcattagttattttatttcaaatataaaattacattactatataactaaaattacatatgtaaatttagttgatataacatgtaagtgcactgtaattttgataaaaatattgtgtaagtaaatttgtattaattattttattttgtagtccgttggatgtaaatccaaggaaagaaaaaaatctgggcacccgagtgatgcataggcggtcccaaaaataaatcgtaatgtggatgattaactgtagcaacaaccgaccaatatatatcaatcagtcaccctaatcatgtattgcctcatgcattttggctacgcgtggctggctgtctgaccattcaaagatactgtgactgtgtgcaagcgtgcgcatgtacatacgtgcagcttccgtgaacgtacatacagtagtacgtatatatacgcgtatcaatgtatgccattttgtatttactagtatggagtagcattctagcaagatccagtcgatttggttcagggaaatctccgacaatatatcgatttggtcctagctcgttcaacagctgctaataataataataataataataataataataataataataataataataataataataataataataataataataataataataataataataataataataataatttttaattgttttaattttgatttgcggggagatgctcatgttatgacttagatgatcattcgtgtttatattgtttggaatatttgtggctagctagctgttggatctcccgggaataactttttttttaaaaaaaaatgttcgggagcagtaagtgagagaatcaacactagttagtaggagtgtgtgtgtatatatatatatattactctctccgtcttataatataagggattttgattttttgtttggaacgtttggccactcgtcttattctattttttttgaaatgattatttattttatttgtgacttactttattatctacagtactttaagcacaacttttcgttttttatatttgtaaaaaaaaattgaataagacgagtggtcaaacgttgcaattaaaaactcaaaatctcttatattttaggacggagggagtaatatgattaatctagagctagccagctacccgatcgaatccaacattatgttgtcctaccacctgtacgtactccctccgtccaaaaaaaaggcaaactctgggtttctgtgtttaactttgaccgtccgtcttatataaattttttttataattcgtattttcattgttgttagatgataaaatatgatcaatattttatgcttgacttgtctttttaatttttttcataatttttttaaataagacggacggtcaaacgttggacacggaaactagggttttcctttttttggatggagggagtagttctgtacatgcgtgcatggataattaagcaagaacaaacaaggaaccttaagaattaatcagcctagatttattttaggaataggttagttaacacatgatggttgtttaatccttgtgcatgatatgggtatcccagtcgatcactaatggtttagattagttgcatgcttcctgttgttagtggcatcatctggtagctaccagttgttagcaatggttggttcatcatcatatcagatcgacagagtgagcagcaaagtcgatctagctggtagtagtgctaatcatctagcaaagcaaaagatagcatacatacgtgatctaaatctgtcaccagaagatagtagtactactctagtatcaaacagagcaggatctaaaacaaaaatcatactgtatgcattattatgctgattaatttggcctggttatttggatgcatcgaagagtccacgagagcgggagacgggcctggcccattgggccccaaagtggtcgggcccataggagggtcgtggcgtggcgtgcccaggtgtagcgcaacttgcagttcggcaggtagctgcatcgggccgcgggcgccaccacaaccagcctggaaagcgcatacacacgcgagtacgcaaaacgctgtactactatgcagctacagtgcaaatgcaaccagaaacagacgggttctttttttaaaaaaaaaaagaaaaaaaaagcagaaacagacggagatgctcatctactctacggagtatagtgtactcctacttgccactagtgtggtacgtagttttatactttattgttgaggggaataccacgtgtggtatttgcaatatgctgccaaacgacaacggaagtctgtggactgtgtggcatgtatgctgaccttttgttttgcttcactacactcgcaacaaaaaaatgtcatatttgtttggctggaccgccgtataaaagtaaacgagacagcaaaaaaggattttatatttctactctataagcgtcatgaaagtaaaggccgaaaagaaagataaaatatctactggttaacgaggatcattcttttgcggtgaatgcttaattaagtatttaataactactggcaaaaataacttcttatatatcgcagaatcactcacatcagtgtcagtaatttgccctatgtttttagatcaagatttgagctccatatgttcctgtaaaatactaaaattacgcgaagatatcagcttcgctacactcggccttcgttcaaatttcagcccgttaggcttcgtatgatgcccattaggcccacaagatcgtatgcgaagccatggcccaaaaggcccacttatattaatctcaaagtattctaaaaaaaaaaggaatagtattcgacgaatccccagcgacatgagcaaccattgcgtcggcggcggcgccgccggagtcgatgacttgacggacgacctcatcgccgagatcctcctccgcctccggccgtccgagccggcgtgcctcgtccgcgcctcggccgtctgcaagccctggcgccgtctcctcaccgaccaggccttcctccgccgctaccgcgatttccacggcgcgcctcccctgctggggttcctccacaacgtcgccggcggcggcgaagaccggtacgtccccttcaccgcctccccggtctccccgccggacatcgcgtgcccttgctgggtcgccctcgactgccgccacggccgcgccctcctcgacgagttccccttcagcgccgacttcaccgtgtggcaccccatggcgggacgacggcgccggctcccccggccggacctcccctacttcatgtcctacgccgccgcggtgctctgctccgccgtcggatgtaaccacctcgactgccgcggcggcggccccttcctcgtcgtcgtcgtgggcatcgacgagccggagcagcagaactcgcggccgtgggcgaccgtctactcgtcggattccgattcgtggagcccaacgacctccgattacctcaacctaaccctaacccccaattgcgacgtcgacaggaagcccgccgccctcgtcggagatgcgctccacttcgcccttgcggaaggttctggaatcatcaagtacaacatgggagagtgctcgctttctcggatccatccacctgttgtgtacaagggaggcattgtggtgatggcaatggggggcaatctgctcgggctcggcggcatcgagggttccatcctctcaatgtggtctagtgatgtgagcctggatggtggtgtcagatgggagaagaacagggttatcaagttagagagcttgctaccaagtatcgattgcgtagaggcagtagcatgtgagcttgcacaaccagcaccgattggctttgtggatggtgctgatatcgttttcgttagaacagatgctggcatcttcatgattgagctcaaatcaatgtgtgttaggaaggtttgcgagagaggatacttcaaagccgtcttcccctatacgagcttctgcactccaggtacttgactctatcttgatgtaaaatttcgacttctacatgtttcttaggcacgattcaggaatagtttgtttgtttgctttcaaattggccgagtaataaaggaatatatttcaccagaattggcttggcctaaaaatgtgttcatcctaagtggcagaccaatcccatcacatcgatgaggcgcagctcattgtaccaatttccatttgaatgaataatctgttgagcaagcttttattgcagtgaatatgtgaataacaaactaatgagtgacatgggtgatgcacacttgaatggtttgatttgctacgttcattctgcactagtttttctacaagttggtcacaatgatgtgatcagcctattttaaggtgtgaaggatcgccatattgaattgtgacatttccctaacatatattgatgatttcggttgacagcatttattttttgtcactttgaacttccttattatagtttgaacttttttttagatgtgtaacctaagttcgcacctttatcactcaaatctgggctctgccactgcttgcaggcgtccatctccagcaaaacagagttcagttcagtaggaagcggttgctggaactaagagaaggcgatgtggcaacaggtatgcaatccaacggcaagagccacaaggggcgacagccgtgacggccaaagaccacctacaaggatggtgctggcaatgggcagcgagctctgcagcattttgttgtctgcgtcagagtaaaaatggcagggaaatgtttggacatgggagagagccgattgcttcttcccatgtgagtgaaaaatttcatttcaaatatgcacggtttgcttgcatttcaactaaaatgtgaggtacttcctccgtttcacaatgtaagactttctagcattactcacattcatttagatgttaatgaatttagatgttaacaattagcccaaaagcctggtacaaggattgaaagctgaaactgaaaggtgtgtaactgtgtaacgataagcctagaagtaaacatgaaccatagctctgaaagtcatggcttggcacaaatggatggagggaagaaacacggttggtaaggctaaataactgcttccttagaataactgttggtaaggccaaccgtaaacaaaatactattgttttttttcctctctgtatctgagagaacttagaattctacatttgtagtatcataaaccatcttttcaatttttattcgaaattgtcccttctttattcctacaggccctgtgccttgatgaggggaacctcatcgttgttacgaggctgtgtttatatccagtggagaaaagttttggcgtgtcacattggatatacagacacacatttgaagtattaaacgtagactaataacaaaacgaattatagattccgcctgtaaactgcgagacgaatttattaagcctaattaatctatcattagaaaatgtttattgtagcatcactttgttaaatcattgggcaattagacttaaaaaattatctcgcaatatacacgtaatctgtgtaattagttttttttctatatttaatactccatgcatgtgtccaaacattgtgacatggtgaaaattttttgcgtgggaactaaacagggcctgaactccttaatggaatgacacaccatgcttttgtgtgtctgtgtctgaactccttaatggaatgacacaccacacagacacacagtacacacacaccaaaaataagaaatcgtctcttcatttagcagtgtaataaagcactcacagcaacaccaaaagaaatttctgaagaatcctctcaacctatcaaatttcttatgactactaaccaagcagcaaagaagggatgcatcagcttcagtcaacagttttgcacatcactagcttcaagtaatcaaccaagaggccaacagctagaggctcgatctgacgtattagcataatttggacccattttgtttgctaaattgatgctataattgttggagatggcaatttgtttctatcacgacctgaaaaagatgcagaaaagttataatcgttttacaaccaatattcacaaagtattttgagagagcattcctactactgacaaaaggtaccaaaaacaagcattgtcaacagacagaaaatgataacagaacaaaatatcttgcccattctagttgatcctcgacaagttaaagtacccagtgtcacatatacttttccccaagcacattatcatcaccgttttgttaatgttgctgaattagtattacttatgaaccaaccatatcccatcagttttagcaaacagccagaacgtcttacattcttcgacatcctgaagacattgtgctagttttgcaaattattacagcttgacagcaagattgacatgaaataaagtgaaaacaaccaacttgaactaaggccaagatcagcaaagatgggatgcatcaccttcagtccagagttttccatatcactagcttcaagtaaataaacaagacctcctaggataccaacaacaagacgcttaattgaacccaacagattagcaaaatttggacacattgtttgctactagtttactgctgcaattgctggcgatggcaatttgtcctatcacgacctgaaaagggtgcagacaagttataatcgttattgtcaacacacaaaaaaggtttatcagaataatatatctgcccattctagtggatccttaacaagttaaagttccaagtgtcacatatacttctctcaatccattatcgtcgcccattctagtattacttgtgaaccaaccaaatatccaaaaaaatgttttcatgtcactctctgaattctgaagcatactgaatctagtactgaatatcaatgaatctctcttttatcagtgttatcaattattttcagaactttttataactatctgattgatgctaattatgagccaaacaagtatattcaacattgttttcatgtcaccgtcagaaacatactgaacattcttttttcctttcggaaggtctgagacacacagaaaagatatccctgaatcacgattggtgaattgagcaagaggcatgctccattctgaaactttgaactgaacgatccccaaatcctaatgctagcaaattggtaaaggatgtacctggaacgaagaagctcatgtaggggaagatattgaagcatctgtccttctcccacagcttgctgatctgcagtgacttgagctccatcctgtagtcgccatgaatggtgtggaggaagatgatgtcggtgccctccgcgaagccaaccagggacagcgagtgtacaggatcaaagaaggggagaacagcgtagaggtcgatcacattgcgccgcacccaccctgcacccgccaccctcgcccagaggtggatggaggcctcgccgtcgaagagggcgagccccagctcgccgtcctccgccgtcatgaggagagcgtcgccgtccccgtacgccaccggcgggaggatcaccgagagttccagcttggtgaggtcgtagcgcaggatggctttgccgaagtaggtgaggaagtggaccgcgtctccggcgaggacgctgggcttgctttcgagttcgagggaatcgtcatggtggacggtggaagcggcgtccatgtcccggtctcggacgagtaagaggatgccgacgcgatctcctccccgtcgtcgtcctcgtcgttgccgacgaagaccaagacgaaggggcctccgtggcagtcgtggtggtcgcagccgggcacggcgcagagcacggcggcggtggcgaacgtgcagagggtgccgtagggctcgcgctgccgccgcacgtcgccggtcatggggtcccagatggtgagctcgacgttgctggactggaagagggcgcggccgtggcggcagtcgagtggccaacaattcttgtgctccagttcggcggggcggaacgcggtggtcgggacgaactgcgcgaagctggggacgcggcgggcgggttcgtcggagacgtggtggatgaagcccagcaacggaggtgctcgtcggcggtggaacgcgcggtggcggcggaggaagacggggtcggagaggagacggcgccagggcttgcagacggcggaggcgcgggcggagcacgagggatcgtccggcgggaggcggagcaggatctcctccacgacgtcatccgtcaactccggcggcgccatgccgccgcgcggcgaggtcaggcgttggattccagatgatttggggaagagaagggttgtatgtttcagcttagaccctataaaactcgatatttacgactacggctgtgtttagattcaaaaaatttttttgaccaaaaacgttacatcaaatgtttggacacatgcacgaagtattaaatgtggacaaaaaaaatcaattgcacagtttacatgtaaattgcgagacgaatcttttgagtctaattacgccatgatttgacaatgtgttgctacagtaaatatttgctaatgacggattaattaggcttaataaattcgtctcgcagtttacaggtagaatctataatttgttttgatattagtctatatttaatacttcaaatatgtgtccgtatacgtaaaaaaaaaattgtccaataaactaaacacggcgtacatacaccaacacaggcaattcttacagcatcaccagccatgcccttattcaatccctaatcttattcttttgggattttggtgaaaaaagaaatccaacagctatcctattttgatgctaatattttgaaaaccatatcatcacatccatcgctctcttcatttgagggggagcgatgtggcacgcgcgtcccggtggtgtggaaagaaaatcaagggggagcgatgtggcgcaagcgtccgggtggtgtggaaagaaaatcacaatcagggatgaggaggaataagggggtgtttagatctaggggtgtaaaattttagcgtgtcacatgttgtattacatagggtatcgcatgggatgttcgggcactaataaaaaacatattacagaatccgttagtaaaccacgagacgaatttatttagcctaattaatttgtcattagcaaatgtttagtgtagcaccatattgtcaaatcatgtagcaattaggcttcaaagatttgtctcacaaattagtcgcaatctgtaattagttattttttagcctatatttatactttatgtatgtgtttaaatgttcgatgtgacatggtgaaaaattttagggttgaatctaaacaggcctaacttttagttggtagtttactatgggtttcactttctgggttagagattcaattttataagatcttttggaaggatcacttttttgacatactaccttcgttttttaatatatgacgtcattggttttttttgacaaacgtttgactatttgttataaaaatatttaaatcatgcttaaagaatacttgatgataaatcaaattacaataaataaatgataagcatataaaattttttgaataaaacgaatagttaaacgtataaaaaaaatcagcgatgtcatataaacgtattaaaaaaatcagcgatgtcatataccctattaaaaaaacggtgggagtatcaaattctgattagcattatcaaattcagatttttggagattgatgttacctattccgttggtgatgctcaaatattagtattaagaagccatttggaaaatacgccaggcagtgaagatcacccagcaaacaaaatagaaaaaaggaaaacgagaactaaacttcataatgtttaacgagaactaaactattgtatatactacaccaaaaaatttagttcactagctatagtttaatttgcttttttcgttgcgagacgtagaatttgaaatttgaacttatatgtttacgaagtgatatatcacatattaatacatcttttcaaattttttcataaccatttaaatgacatgtaaataacaagaaaatatcccttcgaggatcaaaatccactcccataaaatagagggagtagtaaattttcaattataaaattaatttagtactcttaatatatatctcaaatagttggagctagcaaatttagttatacctcctgatgcctctcaaaggagtcaaggacgtacagtaaaaatactaaaatgacttatcaaagaatagagaagtttgagaagaatagggactgaaaacttctccattggtcattgcattaaccaagagtattgcattttcctcatatcaccaatacatccaagcagaaaacataaacagctgaagcctcaaaacatccgctcttgaggatatattccctcctttttcacacattgtctatcggcgcgtgagtgacattgtttgccagccagattaatcaattacagtgtaattgctgaaggtggcaacttgcctttttgacgacctgataataaaaaagaaaaagaaaaaaaatacagtgacaatacttaaccaaaatcactaaaaaagaaacctacttactccgtttcatattataaattaaactttctagtattgtacacattcatatatatattaataaatctagatatatatgtgcctagattcgttaacatctatatgaatataaacaatgctaaaaaattttataacaatatttaataaaatcattgaatcgaacatatgagtcgatcgatcatgtacctgggagaaagaagctcatgtaaggaagaacacaagaggcgtagcactcgtccaacaccttcgtcaccttgagtgtgctgagctcaatctgctggacaacctgggcaccatcatacgtagtgtccacgaacaccatgtcggtgccctctgcgaagcccaacagacgaggtcgcatggcgtcgccgggaatcacgaggtcgaggtcgatcaccctgagctgcacccacgccgccgccgccgacaccggcttccacgaccagagttggagggagtgacctgagaccaagcgggcgagccccatcccgccgtcctccgtcgtcatgaggagatgattctcaaagtcgtcgtcgtctatctccggcgaggcgatcaccgtcaggtccagcttgcgcaggtcgtagcgcaggatgttcctaccgtgccaggtgaggaagtagacggcgccgtcgccggcgaggacgctgggcttggggaagggttcggcgttgtggtggcgaacggtggaaggcgcgctccatgttccggtctccgacgagtacagccatgccgacgtcggcgacgtgatctcctcctcctccccctccatgacatagttggcgacgaaggccacggcgaaggggccgccatggcagccgccgtggtcgcagccggacacggcgcacagcaccgcactggcttcgatgttggtgcgcaaggcaagggtgtcagcaggcgagcgcagccgctgcacgtcgcccgacatgggatcccagacggtgagctcgtcgtcgccggagtcggagacgcaccagatgtgcggaagagggcgcggccgtggcggcagtccatgggcttccagccatcgtggtcgagatcggcagggcggaatgcggtggtcggggcgaaccgggccaagggggagccggcgtcgtagatgaagcccagccgcggaggtgctcggcggcggtggaacgcgcggtagcggcggaggaagccggcgtcggcgaggaggtggctccagtgcttgcagacggcggacgcgcgggcggcgcacgagggatcgtccagcgggagacggaggaggatctcttccacgacgtcgtccattagctccggcgccggcgccgccatgtcgcagcgaggagatccgatcagtataccgaggaacggaacctattgacaaattttggactttcaggctttcacagatctcatcttttttttaagcagttttttttatatgcaatattttctcgatccattcaggtggatcaatcggaactagagtagagataagatttatctcctcctagaacccctatacatataaggacagagtgagacatctaaagttgtcatgtactccagacgagatatataatgaagacatagctcttctctatatatattttcattgtctacttctgcaatgttcttgagggcaaaaagaagggcacgggtgttttacatcatctcacgtctctactactatagaagggatagggaacggatccggtgatccgctaatagacgcgtggtttacaacatgttatcactttaatttgactagaaaaaatacccgtgcgttgcaacggctgaagtctattttaattttattattgttatatggtttagttaagatgaaattcactgtgggagttcgcttggatatataattttttagaaaatcatcagctgcagttaggagtccgatcgtctcaagttagcatgcgagttttttttaaacatatttcttatatgattctttctatattaccaaaagtaaacgatcttagaaactgtcacaccccaatctggcatcgccgtacaacggcacctgacaggagcgtgtcgtaggaaaaacggtatgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagaatgcaaccgacgacgcagacgaggaaacaccaacaacagcagcagcagcggaaccaacggactaacacccaacactacaggcgacggctgggaactaggacgaaaccctaatcttcacttcacttcatcttcacttaaaggcagaggaactatatatatatttatatagagtaagggtgagtactttcgtactcagcaagtcacaagaatttaggtgtttaatgcaagcttggaagagaggcaaggttgttttgcaaatcctttgtttgaaatcatttttgaaatcactaagtgatttatttctttttaactttgggtcgaaaggagactttcatctcgattcgacttaagagatgcttttcaacaactcaattgataatgtaccgacctcctgggtcagatcattacttctcggctctcggagccatttcacttgattaagcggctcccagagcctttttcattttctcggactcccagagtccagctgcccagtagcacaacaatctgcttccactcaggaagcctagtctatgatgcccgcagacatcccgaatcacacagatttgtttccgaccactcaggtcatccatctgccacataggctgattctggtaacgattcccacaccacaacaacttttcacaaagcacatgcaatcaaatctacgcaacgggaaccacctcacatccgcccatgaccgtgggcacagctgttcgaacagttagttaacctctgcagagggatacactttacccacaagacacgaacttactccagacactggacgatgtcagaggttcgcgacaaagcctttcccaagccgacccagggatacctcatgccacatagaaggatcaaatcctcacataaacataggccattttaggcgttcacaaatcaaactccaaccacctcgatcggtaattcaacaagcttctcgttcttacattaccaggaacccggtttggctccaaccgaccccgccccggcgttcccaactattggcatgcgaggtttccctgaatcaactagttatttagccagggtgtcccattccaccttgtggttgcactttgattatgttcgatgagtttcccacaggaatcggtccttatatacgaatacgggacagtgccacatagccacaacccccgcatcgcgagttttcacaattcattttattttcaaacacaccgacaccacatgtcgggttttgaaggcttcacaaacccatttcccaagttttcaacaaacaacggtgtatgtgggatatttggtatacgcgctcagagagcacgaataccgaggtaccacaagggtggagcaacaaggaatcagggtagtacgacctacggaaattagtgcgactactgggtaggtccgtcggtttggcacgcaaacagaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccacgatcgacgaaaaatccggtaaccgcaactatacgcaaacaatcgaaaacctaaacaaaagaccaaaataaaggtcctatttagactaaataatagtgccattaaatagatctcaactttacggaaatactggaagctgaacggagtcaatcggacttacggatcgagatatatgaatttcggaagctcgaatgggattttccggacaaggaaatgatttatcggaattttctagattacgagaaatggtttatggaatttatagaaataatattctcaagaatattattgatggtcattgatatgagggaccaaaggaaatgattcatggaataaagaattgatttatggaacgagggaaaaggatttaataatccctttggaaacgaaaaggaaggagggatgtcaatcagacttcctcgggcggcattggtgtggcccaaggggatttgcatgcgcggccgagctgattgggccggacgcgggcgctaggaggcggcccaatggggctcgggtggggagagagaggcggttcggtggaccggatccaccgcgtggggtccagggacggggcccacatggcggcggcctggtccacgaggaataggtgcacgcgagagccgcggggtgggtcgggggaccgggagaccttgaccggtctctgcggggccgggcaggtagacgtggcgtccacgtggacagccacgttggcacgggcgagggaggaggccgggcggccgatccgacggctggcggcgggcggcggcgaacctggaggggcggcgtgcactggaagcaagcggaggtcaaggggaactagttcaacggtgcggatcatggagaggaggcgcgacggcgggatgggtggcacggcgcgggcgcggccggcgaggcgggcggccgcggcggcgcgctgggaaggttcgagggggttcggggatggtggcggcgccgggaatcaaggagaggagggaggctgacggcggaacgcaactgcgcacggcggcggcgaaaaaggcgggtggcgagggagcgagaggaaggggagacggccatggcagcgcggcgcgtaagcgagtgggaaggccggcggcggaaacagagcaacggcgacgacccagctccgtaatctcccgtgtaaatgagcatgcctagagaatttatgccgtttataggggagaaggggagcggagctcaccgggaaggaaggaacgcgccggcggcagggatgtcctcggcgggttcgacgctgaggcggggcggatggcgttgtccgctcgtggcaggacggtcgccgcgacgggagcggcacggcgccaagacggcgcggccggggaagaagagaggggcgcgaggatggggcggtcggcaccacggagtgtctcggcttctcgcgcttgtcggcagaaggagcggcgacagcggcgagcagccaggcggcaacgatggcgcggcagcggtggagagtgaagcaggagggattgagagggggctcggctttatagtggaggcgatgtcggtttgggaggcgtgggcgagttggttggtgctcggctggtgatcacgggcgacgcgagaacggcggacgacgaggatgcgttgggcggcgaaggcggtggatcggacggcgaaaatcgaatcccgggagcgggaggagctgcgcggcatggtcaaagtagaaaaggagggggaaaagggagctctgctccttgccgatttgggcgtgcaaaagggaggagagagggcgcgtgagagaggcgctctgcctctcggttttggaagcacgcggcgtggtgcgacagcggtagcaggactgtgggggtcggcggcagcgcagcgcatgcgtggcagggctgacggcagcggcgttcgggcgacgaccaccacaagggcatgcgcacgtgggaaacggcggaggcggcgaaaattgaatggcggcggtgggagggttcaaaccgcggcggcaggaatcggcaaggcggcggtggtcgacaggtgagagagagaggaagagagatgacgctctctcgggcggcgcacatgcacagcacgtgcaaggaggagggaggagataggcagaggggagatgggctagggggaacatgatcggcccactaaacttgagggaggcaaatagactttttcagagggattgaatggttgaggttagggtttggattcgaattcaaaatttgatattcgaactcgagggtttagggaggaatcaagggagactcgaggagaagtcaaggaagagattcaaaatgagattttgatatttttgggaacggggacatgtatttggcgaggatttcaagataggatttgaatttcggaatttcatttggagacttgaatcggaattggaatcttgaggtgggcgattttgatggcgacgagagggaacaacgatggagattgaattgagatctatggcacgacttaaactcacactcaaagaacgaaattttcgcaattaggattttgccgaattagtttttaatgtctgacgaaaagcggagcgttacagaaaccgactcaaatacaaatatgtatttccaaaagcaaaaaaaatttaaaaaccaactcatacacggatgacgtaccaaaataccagcaaaaacatcttcaatttttataatagttctctatatagattaaaaccaaaacataaaattaaaaccgactaaacagggatgacgaaccgcggaaaaatcttcaatttttataaccgacttaaacacggatgacggaccgcgaaaacatcttcaatttttataagggaaaagtacaccgaaggtccctcaacttgtcatcgagttacgaaatcgtccccaaaccgcaaaactgggtatataacatccctcaacttacgaaaccgttcactttaggtctttcagcggttttgatcccggttttgtctgacgtggcggctgagtcagcgtgggacccacgtgggctccacatgtcaggctgccacgtcacacacccctctctctctctttctcctcctctcccttccccctttctctctcacttttcacctcaatgggcatccggccggcgggtggagagatggtcatcggggcaaggctggagaggatgtccggtagccggcgatgcgggagaaggggagggtggcggcggcgggagcacagggggagcatggcggcggcggcggcctccggtctccccgtcttcaacaccgagtgccgccgccgttcttctcccctgccggccaccggccacgccgtgaaccaccaaggtcggggacgcggcggccaagcgtggaggagcgaagggtcgaagcgaagcccgtcgatgcagcggcgaagaggaacccattgaggagtgctaggaccacgtcggtgctgacgtgcacttggtctcagtgaagaaaacggggaagccgtcatccccgtagccaggccgcctccacggcgcccgctccacctccacaaccatcgctgcgacgcccgcctccatgccaaccgccgcggcgcccgcctccgcatccaccgccgcgacgcacgcctccgtgccaaccgccacggtgcccgcgtctgcactcaccgccgcagcgcccggccccgcctttgcctctgcgcccaccaccgcaatgcccaccgtggcacccgtcgacgcccaccgctacgtcgcccggccccgcctccgccgactcgtcgccccccgcagcggcgcccgtcgacgcccaccgccgcgtcgcccatccctgcctccgccgcctcgtcgcccgccgccgaacctcctctcccaccttgccccgacgaccctctccccacccgccggctggctttccgttgaggagaaaattgagagagagtggaggaggaagaggaagggagaggagaggggaaagagagagagggggtgtgacgtcgcagcctgacatgtggagcccacgtgggtcccacgctgactctgccgccacattagacaaaaccgggatcaaaaccgccgaaggacctaaagtgaacggttttgtaagttgagggatgtcatatacccagttttgcggtttggggacgatttcgtaactcgatgacaagttgagggaccgtacttttccctttttataatagtagagatagagatagagatagagaagagaagagaagagaagagagagatttgctagctcttccaggcaggcggcccttggctgggccgagtgagagagaggggaaagggctgggctgttgaggttgaggcccaagcggagggggaaggaaggggagaaaggattgggctggggagaagtgacggaggtagtggaccggtgagggaagtaaagggaagaaggagatgggttggagtgtgacccaattgcagtgttccttcatattttccacagggaattgtttggtgaatgtttgaatatttgttgagaggagatttgcacgcaaattggatatttgagttccaataattccaggatctcagaggagagaatttcagctgtatttttgtggtatatagaataggatgataccccataaataccatcagataagatgagttcacgccggcaatcctctgatctgtttgtgtacaaacaacattgacagcgatcgaatcgtaataggccttgcaagtttagcaacgctgatacggtatcactggcagatttcaaacggggaaatactatgatcagatacaattgagttggatggtagtccaccatgaactcactcaacaatcaagtcaaccatcaatttaagacacggtttgagctctgaaaaggtaaaaggttcatgcaatccctattggcagttcttctgagaaaatggacatgcagcagtacatattaagcaagacaggattttggcaccgaatagattccattaagttactacctagggtaaaatgcattactttgatacagaatcatcgccctcttgtgctggggtatgaacatctgagttgttgctgctatcaccttttactgagagcgaatcagctgcagctctcttgggaggaggttcagcagagattggcttgatattagcacgtttgatacctctaccaacaaccccaagatcggttacagtgcttccagtacttccggttgtagctgccgtagacagagttgacgaatcaaagccgttgcttgatccagccatctgtgaagaagaattgaaagaagcagccgctggcattgtgtcagtagcattctgttcaccacctgcctttgaggcaatcctcttcataatctcatccataacagagcttggggtagacattgcttgttccaagtcttccagctgaattcaaacaattcatacatattcaagaacaaaatgaagttggcaatgtgaaaggcgtatttgtatgaagaaaataataaagcttattttcacaaatgaacgtatttagcattcatatatgaaagaagaaaataagatggcaatgtcaaaggagtattcatatagacaaaatcaagtttattttaccttcttctcaagttcactcaaaatgccactgagctgctctatctcaccctcaggagcggacttttctgagcctccatcagcagctgatgcgttatcatctttaccagccaacaaagcatctttgtcattttttaggctttgtatgcgtgacttgcataatgaaatagccttagcgcaatatggaattgcatctgaaatcttcgacaccaactcatagaccaaacatatgcggaagtttctaggactgaattaaggcaagcaaaggaataaaaactgaaaataaaagatactagtgtcacctttcctatgaactggataccacagttcatgtccacatttagacaaacacgtacatgtaagaaaatgaaggtaaccatgcagatttgggtggaactcccattgaaaatatacatgtataacaatatttaaaacacaccttcagctgcctaactctttaagtcgagaaggatgcaggttgcaggcactacagcattgggttgcaaatgttgttttatacttgctatatggcagaaggatgcaggttgcaggcagataatttggtagtattatgtttaccaaacaatacggcatgagagctattactctgcgacgatgagggtatagcaagttctccgatatggctaagctttaaagtagtcaccgagtgagttatcaatgtcctctgaaaatgaaatatggggcattagcaccaaaaccatttaccatcaaaactagagagtaactaagatagtggagacagacctctttccatggagacttcagctagagcagaaaagatttttgctttctccaaagtgtcatctgggctcttctcaactatagcccttgcaatatccaacattttccaggcctgatccaaatcagaatcatcttcatctcccaccatctcatcatcatccttgtcactgtcaccgttttcctcctcttgaccttttccagttgagttttgccctaaccaaaactatatcagtacttaccacagaaaccaggaagaaaagcacatggagtgtggccatcatttattatagtacaatagcaacctgctacagggagcagttagatgcatatagatgcacaaatgatcccacccaaccaaatagtgaccaataagtttgttcaattaaaattaaactagtaaggtttcttatagaaatgcaagaccaattatttaatcttgagcaaagtaagaagaactatttacattattgcacgctactataattactcaaataaaggaaactcgtaaatttgcaaaagcatcctgtgcaagtgcttaatctgtttaagctgccatttctattccaagtgcacaagtaagaaaggaatacagataaataaacctaggtgtattcaaaatatggcctggccatataatggttttttacaaaccgcaaaacattttttctgcctctggaatcacgcattatcaatagcacaaaatataattgccctttcagaccaaccaatatatccactgtgaccaaatggcctcctatggaatgataatgataatttgactaatggaggaaataagtctgaacactttccaaaaaataccattactttataacaagaacatattaatgatattgtttttatgcatagtatataagaacagggtaagacaaaaggccataagtgtacaataacaactacataggtacatggtacaataatggtataccttcttcagcatcagctttatccgtggatggagcatcctcagtattgctaccgggggtctttgagcttccactatcatccttgttagtagtactcttcatggactccttattagatgaactcttgggaacattacccaaaggatcagcctcatcctgagctttgtatagcaaggcacatccatacttaaaatatgtgctaacacattccggagcaagttctccatgatgtgcaaccctgatgacaacaaaaggcataaatttgttagggcgcaagcactgaagttatagtacaagttcattgagacataatgtaaactgagatggatcagtagttcgagattggtagctgctctgtctatttaccaagcacaaccacaaactaatataacttgacctcagtgaaatatttccaactagtcagtagtggagcagcatacatacatatttctgagatatcaagaattgagtaatcgcactttgctgctatggtagtcgcaattcacacacaataacaagagataaaacaaactcctagctagtgctatcaattaacacgaggctaagaggagaattgactgattcctcaacacgatagcccaatccattgcgccacgttgataaacaagagaaatccaatcgccaatcatggcctccagcttgctgtagaacctcataaaccctacccgactcacctccccaattacacaagacaaaataacaaacagcttgctgtagaacctcataaaccctacccgactcacctccccaattacacaaggcaaaataacaaactccacatgacagcaacaacacaatcaaatccacagcatcactgaaccaaatattacgttattcccccacatcgaaccagccaggtcgggaaatggaaccgtagaagcggagggggtgtagcggagaaagcccctcacctgatctcgagggcgcggctgaggcagtcgacggcg

SEQ ID NO: 64297 - DNA, 3668 bp, Oryza sativa
cactatactacatgcgctttcgcatgtttcatttggaatggattccaaggacaaaatttgtgagaattttatgcaaatttgatcgatttctacgctaatatttcatatagaaacttttttttaaaaaaaaacaccgtttagcagtttgaaaagcgtgcgcgtggaaaacgagggagaggggttgggaagaggctcaaacgaacacagccttattcagtttggcaatgttctggaatatggagggatgcccaaatttcgccaaaatactgtatctttggttcatctcaaattttcagatgtctttttttttctgttgatgtttgctttgtttttgaataaaatttggtggattcaaataggctgctaaatcagatgtgaaagttgctcatggtttaggactggaaaaaaaacaaaattaaagatgtcaacgcaaaaaacgtgttgccaacttgcttgcaacgagagccaacacgggagtagaactgagacatgtatctcaaagtaatagcaaaatcaaatcaaattaactcaaattcctatatctataagagatctcgaataatctcatccatgatccatatatacatctcgttcgctgcagcgattatacatatcaaaagtataaaacatgaactaaaaagaaatactccaatttggaatataatcagtggccgaagcagtcgacgaggatggacagggcggtctctgcgcccaagccgccgccgccaccaccagccgccgagctcgccggcggcggcatggcaccatcgccgccgccgccgcagtcgagccctttgtctgacaccgatccatcgcttggcggcgacggcgacggcgccgatctgatggcctcgaggatctttctgcagctccgtatcctcccggccagctccgacgaccaagcatccatcagtctcgatgcaagctgaggagatcgaattttgagctgaattagcaacaaaagatggaacttttgagccggattcgagcttcttctcgggctctccctttctttttcagtacaggagggggacaaagaggaagatatgaaagcgtggtcggcaccggcaaagcaggaggagacatcagacgggtggatttatacaatgagaggagaggagaattgaagtcagagaaggcgaatcaggggacatgcctctggttttggagtagtttagcccactgaatgtctctgaattggaaatctggaagtcttgcacgactttttgatttttgatgacacctacgtggacgatttccaagccaaatattctactctctacttgagttgactgttcatcggtttgcagaaatggaaccaatgctttcgattgcattgttcttgtcgtcgctgcaatgttttcagtacttcattcagtatatagtgcagaagagaatgtgctgctaatctcatcctttctttgatcttaatcagtctatatgtatctagcagtgcaaattgattgattatctctttccctattacttcctgatggctagatgtacaggttcaggttgtcggcgagctgaaacctacaagaatagataggtttctcttctgatgttcacaaggaatcaagaacagtggcgtcgatcacaatcttcgccgtgcagaggacagaggttcctatggcttgccgtgcccgacctgtcggagttcgtcaatttcatgggattcggtcagattcatcgggtaaattgcatgcgaatttgctccctgatcgattggttgcattcgttcgtcttcaggaaaagaaaagaaaagaaaaaacaatcccctcttatggaatcaccgaactcgccacgctctgctctctatttgtttggctgtcggaatatttatctccgaccctcctagtagaattctttttaaaaaaaaaacaattataggtgctcttatgcagaagtgagctgcgcgaaaaaaaaataaaatgaggcactcttcttctgctgcaggtcgccctgggtgatgatgggtcgatcacaatcttgctgccgtgcagctgttccaaaaaaaaaaaagagatttggatggagagacgttgcttcaaacatttttcaagaagaaatagtgagtgtgttgggaattgagccgcttgtcgttgcatctcccgtgcagctgttccaattgcgccaccggagtcggcaagatggtttcgaccacgctaattgggttttggtcgattgcatgcaggattgctctctaatcgattagttacattcggttctctgcagggagagagaaaaatgaagcgataaatcatcgttccactcaaaaaaaaaaggtgagggttagaggagtcggagttttaatctccgaaccccttggttcggttttttctttttttaagaaaatacacgacccattcgtcggcacgtttcctcgccgatcatccatggcggagccgccgacgtggtcgctgccgcagaataatctgggatcgataagctgcgccggcgagatcgcctgggcatgacgtttccttcctcgatctgcatggagcacgagaaaaagaacggcaaccttccttctcctgcacaagcaacattactggaaagtgctagttataatttgtttcattttccagggaatcatcatgatgggagagggactaatcaagtcttttattatcttaatgaactcttgatcaagtcgtacctcggtttagaattttttttttcttctagaagggccgtgaaatatcagtgatagaagaaactagctagaccagtaaaacgttggacttgttttcagaattttcatgccattgactgtgcatggaaatctgaaatgccgggcaacaggttgagtacgaaatagtaacagccaacaggttgagactagagacataaactatatatcaatatcatcatcacactttcaatgatggcaaaagattagacaagaaaaattcagataaaaagaacgattacccatccagtgaacggatttcttgcgtaatatttcaacaccatgttattaccagcttgcttatatgctgagctgaacagactgtgcttcactttcatgaaaccctattgtacataccaagttattgctggcttagaaattaagactgaacaaggctcatttctcatcatgaagaacttcctatccattccccttgttaccctcatcgatctctcttacatgatctagaattctagaatggtgttggcgctaactgcacttccttctctttctgaatccagtctacaattgagcgctgcatctggacaggcgcacgctcaacccacaacttgaggaactcagagatcacatctgcccggctctccagatcaagttcctgtcgtctcgacacagttgcttccctagcagtgctcaatgtgctcggcatattcattctcgtcttccccaaatgaaagaatgcagcttcatgttttgacttccagagaagctggtgtgctgttgcttcagaattctgattgatgctacctattgcctttggcagcatgaccttgtctagctgttccagggtaatgtttctgtgataccaaggctgctcctcgccattgatcacctctactgcagaactctcagctgcaggcagaaggtcatttgaagagctatgaggcaaaaaaagaaccccaagtttcagatgtgaaggccttcttggataacatctttttcctcgtacagctgctct

SEQ ID NO: 64298 - DNA, 16484 bp, Oryza sativa
gctgccactcccacacatgctctgatcttgatgtttgcagcatattgggtttgggcggaaccacttagtagctataccatgaatgttgtcccaatggtatgaacgataatgtgacacccaggagaagtcttgtgtagggagctgagcaagttccttcctaacagtttcagttgtagacttgaaatgaggggtaaaccattgcaagcacttaattatagtgccaattatgtttgtactctctgaaatttgtagcatcataccgaggaaaaagttattctcaggtgcactgcaatcgttgtaaacaaagatcaacttagcttctactcctcgatctgcaatgtcattgggccgtatccaaaacaaatgctgcttgtttccctgcacaaatttgtactcaagtgtttcaccagcaagaaggtgcccgataagagggtcaaagaacaagtaacggcgaggtgtccctccaaactccagagatttcagaaagtcatcagctcccttagcaaaccactcaaatctttgaacagttgatctacttggctcgtcgatattgccgtgaaagatggatgatatcagtgatttggtggcacaggcaattcgcctaggaaaggaggaattccttacttgctgttccttctcctcttcttcctggacatgctgcctgcacttgcgtagtgtgtcatcacactcttcagtagcacgcttcagcttcttctgccaacgcagcaacggctcactcgtgatctgccacttactggatgtctcaagtgcaagctccaacttgatttgtgccatctccagcctctccatcagctcgtctgcacttaatttttgctcataattgtcaatcatgccagatatgattttgttcactgtctcggtaacaatggcagaactgactatctctcccatcttcagtgatcaatccgcaagagctgcctccctgatcagcacagagcaaagatgtatcagtacattgatcatgatgcctaataaaatcaagagatagatcagtgaattcctgataagtactaacgaagtgcattgttgaagcatatgcaaagcccaacctttctgagttgaactagtaggaagtaatggagctacacaggtgcaccagagagtacccggcagaagataactggattgcatgaattgcacgaaagtataagacttcaggcaggaaaaatagcaaattacagttgggttcttctggaagttaggctggtctaatatggcacctgttgagaaaactattatcggtgactttcaagttgatttgtcacacacagacaattttaaaatcaaaatctgctctcactgactgtcccaatcttgcggactagctactgaagaaaattctcctctcgtcactgtaatcatttttcttattagaaactccagcttcttgtcttgactcttgactgaatggaatctgggaatctgtaaaactatattatcggcgacttaatttgttgggtctgagaaaattattatcggcgactacgaattatagctgggaatctcgggttatgttgcttgtgtagtgcgagtgcctctcccctgaatagaacagcagtaactaaaatcaagctggtcgcgagaggcgaggaaaccgagccgtaccttgatctagcgcgccgtggccgccgcgaggaagcggcggccttcttccctctccgcatcgccgggtcgccgcacaagcacgcgtgtatggtggcggctcacagtggaagcaacagcggcatcggatcgaggaaggaaacgccattatggcaccgccttgcgccgccgatccacgagtgggcgcggcctcgctgcggacccttcggcggcagagcaatccccatctggcggcggagaggccccgtccggccatggcgtcagtggcgtgcacggtggtggttgccatggtggtcagcgactcagcgtggagacgaaggtgtcgatgcggcccatatgtgacagtgaaaactcggacaagcccacagaggcccaagtaaaggcccatgggctgcttaggctgcacagcggccttcgactgcgttcttttggagggcccaagtattaacgcatggttaattagtattagctaaaaaattgaaaacatgattaatatgattttttacaacaacttttctatagaattatttttgaaaaaaataccgtttagtaatttgtgaagcgtgcgcgcagaaaatgagtcatgagaggcagaggttgggaacattgagcgaagaaaacaaccttggcctactgcagaagttggggcagaagcaacactggagtgctagttctatgttaggttgtttaattcggttcatttaccagtagatgatcatgatgggactaaccaaggtttcggtatcttaaaatcttgatcaaatgaaagcaacctagaccacgtaaaactttgtctatttgaagaatttttcatgaaatgagccaatgactgtctgatcacctgatataccatggaaatctgaaatagaagtccacagggtgagacatgaaaaattcagataaaattcaatcttggttgcagcatatacgtgcaaatttcacataaaaaaatattgattacacatccacttttttttacacaaaaggtagagagactctaccttgtaaccattgtattaatggtggtcaaaccagatgagatctggtaaagccaaataagagaacaacaggagcattacagggggagaagaaggataaaaaggagaaagaagaaaaaaggaaaacaggagaaaatacaagatgtaaagcaggaagagaaaatacaaaaaatacaaaaataatacaaaaatacaaaagtggagaaaagagggtggttaatcaaatttgaccacccaagcagtaatgtgtgctcgaaggcaaggcttgaggcggtgctcccataattgcagattttccttgatcagattcaacgttgcggaggtgctttgctgagaagaattgaaggtactgtggttgcgggccttccaaaggttatgcgaacaagcagcaaagcaggccggagggagtagaatatttcctatccattactttcatttccccttgttaccatgatcaatctctattccataatcttggtggcaactgtatttcccttcaaggccttgtttgaatgagcttatagcaacactagcaaatctccagctcgcctaaacagcttatattcttcctccaggttaagaaattaagtagccaccaaatctagattttatgaacctagtaaccagaagctaggtttcaccaacttcctccagattcccaacagctacatgctcatcagcaactttttagaatctccagcttccccaagtagggcctgaatccagtccacagctgcgaactgcatcatgacaggagcacgatcaacccacagcttgagaaactcagagatcacatctgctcggctctccagttcaaggtgatcatgttgttgcaacaacgttgatttcctagcagtactcaatatgcttgacatattcattcttgtgttccacacatgaaagaatgcagcttcatgctttgacttccacagcaactgatgcgctgtcacttctgcattctgattgaagctatctattgcttttggtagcattatcctgttaagcttttccagtgtaacatttttgtgacagtaaagctgctcctcaccattgatcacctctactgcaaaactctcagtggcaggcagaaggtcggttgaagaaacatgaggcaaaaggaatactccaagtttcagatatgatggtcttctgggagaacatatttttccttgtacatctgccctctgtttgttgcaactatattggaagatttggctctccaaatacacttcaatgactggttctagagaaacatcacaaaattctatcttgtccatgtagccactactacataccttatgaccatgcttgcaacacagtgggtttgggcggaaccactcagtagctactctgtgaatgctgtcccaatgaactgaacgagaacgtggcacccaggagaagtcttgtgtaggtagctgagtaagttctttcctaacagcttcagttgtagaagaactgaaataagggctaaacaactgcaagcacctaattgtagtgccaactatgtttgtactctctgaaagctgcagcatcataccaagaaaaaagttatcctcaggtgcactgcaatcattgtaaataaatatcaacttagcttctactcttcgctctgaaatgttgttgggccgtatccaaaacaaatgctgcttgtttccctgcaccgatttgtactctagagtttcacctgcaagaaggtgcccaataagggggtcgaagaatgagtaacgatgtggtgtccctccaaactccacagacctcagaaagtcattagctccttctgcaaaccactcgaatcttcgaacagaagatacagttggctcgtcgatattgccgtgaaagatggatgatatcattgacttggtggcatgggcaattcgcttaggaaaggatgaattccttacttgctgttccacctcctcttcttcctcgacacgctgcctacacttgcgtaatgtgtcatcacactcttcagcagcacgctttagcttcttctgccaccgtaataacggcccactagtgatctgccacttattggatgtctcaagagcaatctccaacttgatttgcgccatctccagcctctccatctgctcctccgcacttgattttcgctcatacttgtcaaccaacccagatatgattttgttcactgtctcatgaacgaccgcataactgactatctctcccatcttcagctgcgagattagcctccctgatctgcatagagcaagatatatcgaaacatcaaccatgatgcccattaaaatcaaaagatagatgagagaatttctgataagaactagcaaagcgcaatatcgcatcgttgaaatatgtaaagcacaaccttcagagaatctgagttgaattagtcgcaagtaaatcgaagccacgcaggtgcgaccagagagtacccagcagataataactagattgaatgaatggtgagcatcaaagttgatgactttggggagaaaatacgagcaaagcaaagctgggctctcatggaagttaggcgggtcttgttgaatgtatggtctaataccacacctgttgaaagttgagagcacactgctctcattgactgttcaatcttgcagcgtggctagttattgaagaaaaactgtcctcgtcactgcgatccttttcctaaaagaaagctctcattgactgtccaatcttgcagcgtggctagttattgaagaaaaattgtccccgtcaggccgtcactgcgatccttttcctaaaaaaaaaaatcctagtgaaatcagttccggcttacttgtgttgactggtagggatctgggaattcgataactatattatcggcgacttgaagtcgtcttttggtctgaaaaaatcattattggcgactacgaattatctgcgacacgttgcttgtgcagtggactaacctatcccctaaacagaacagcaacaaattaagctggacgaaacagatcgcgggatgcgatgaaacctagccgtacctcgatctcaacgcgcctcgccgtggccgccgcgaggaagaagctggcctcctcctctccgcatcgccgggctctcgccgcacgagcacgcacaaatggccgcccccacagtggcaggctggcagcagcagcagcggatcgaggaaggcaacgccattcccccggaccaccttgcgccggcatggcctcgcctggatcgttcgtccgcggcggcggcggaggcctgctcgcgcggtggacggcggtggttgccgtggtggtcggagtggagagtggagagacgaagggctttggtgcggcccaagtgatagtgaattagtgatagctcggcccagtccactgaagcccaaatttaagcccactaactcatgggcttcttgagccgccctaggatgtactttcactaccagttgggccgaatgcacaacccattcgtctacaccatatgtctccttccttcggatgtgtctcaggagaggaaaatatacaccaaatgatacaagtcattagcgattgattaattgagtattaattatttaaaaatattaatatgattttttaaacaacttttatatagatttttttttaaaaaatacaccattaagcaatttggaaaacatgaaaaaaaaaacaaagtttttcttcccctttcttctcggaactaacacagccttcctcgatcctacagaagcagcattacgagatgctagttctatgttaggctgtttgattcggttcatttgccagcagatgatcatgatgggaataatcaagtctccagtatcttaaactctttgatcaaatggagactagctggaccatgtaaaacctttgtcgtgcttgaagaattctcatgaaattgctgtctgatcatcacctaacaaatagcataataaaaagacaagttgcttggagatctgaaatactaaaaggaaacagggtgaggcatgcaaaattcagacaaaatgaccgattacacatcaaagcttcaacaccatgttgagctcatatttacataccagagcaattttatggttcttgagtaggtactatgaggtaccattttttctattataaatttggtacctcttggtatctaggtactatgatgtaccaaattttacactaaaattttggtacctcatggtacctccttaaggaccgtagaattgctcttttcagaatctccaccaagtagggcctccctcctctcttggcataagtcggtctggcttaatgcgttgtgtatcgaatattcttatcttctaatatattaacgtgcaatccttttgcgcgttcgagaaaaagccaaatagggcctgaatccagtccaccactgagaattgcatcaggataggactaccctgaacccacaactctagaaattcagagatcacagctgcttggctctccagctcaaggtcatgtcgttgcaaaaacgttactcattcagggcttgaggccaccgtcgtctacctttacacccgccattgagtcggcctgcaccttgccatctccgtgcccatcttctccacgcacaggtaggcgacgccatggccggatctccagaacacctcatgcgccgcagcctcgtggcacaggcgatcgacggcgttcggcagcagctcctccatctcacgccatccaacgttagtgcgcaccgcttgctcctccctcccgtcgatcgccacgacggcgacgctcttggctccggacggcagctcctccggcgaggcgtgcggcgcgaagacggccgtcacctgcagcagagtcggccccgagcaacccatgttggcatgaccacatgaacatgaatatgatgaagaagacgatgttctcttgtgtcgtgtagcagagacatggcgttgcacgaccaatttgatcaccggctccgggaatgcacctaacggctcaaccatgtcactgcttctgcggcgaccatggtgctcgtgttcttcttcgcagcatgccgggtttgggcgagcacggtgagtttcggattggtggattctcgagtactctggatcagtagaagcaacaaacgggaagcagtagaagcctcgctggtggaactgagcgagctcttgcctcacagcttcagtaacaggcttgaaattggaggtaagcttctccgagcacctggccataatcccgaccacattcgtgcttgctgtcacccgtatcaaaattccgaggaggaagttttcctctggcctctcatggttcttgtactgaagaaacacacaggctactactcctcgctctgcaaatcgtagtggccgtgccgctaggtagtacccacttattccaggaggattttcaaactgcagagctttgccggcaagaaggggacctgtgagaggatcaacgagcatgtagttgatgctgcctatgctgccgaactgcaagaatctcaggaactcaccggcgccatcagcaaacctttcaaacctctgaatggtcgaggttgtgattaggctatcaacattcttgtcgccggagaaagaggagaagaatgatcttgtctcatgggcgatccgtctggggaaagagcatcgcctgatctgctgctccatctcatcgtcttccatggcgcgacgcttgcatctgttcatgacttggctgcactcttcggaggcgcacttcagcttcttcctccaacgcagcagcgaggcatctgtgaccggcggccactttccggacatctccagagcggcctccattctgatgtgtgccatctccagcctctccaggccatcttcctcacttagtttccgtttatgcttgtcgacgaagaaggtggagaccctgctcacagcctcgccaactaccgcagaagcaactacttcagacatcatgatgttctgttgattaccccagcctggttataaaaggggatggaaaggtcaggttacaacttataattgttcactacagaaccagagatacggaagtttataagaacttagcaattagcacaaaatgtactcacctcaataagctgcttgaaactagtgctttggtcatactgcaatattgtgacttgtcaagagcataaatctgtttggtgaatatgggggttcagttttcttcacaatgtcaattggacagtgaaaggtccttaagtaacatttgtaccagaacacacgttgtgacatagacatttgataattaattaatgtgatcgtgaaagcgatgacaagtcttcccttcatactgcctgtatttctccaaatactctatcactgaatcaacttttgagtaatacatatgttcaggccaagaaaattgcttgctgtagttgtttaaaaaaaaaggattagtcttcctctgtggaaggatccatcaaatatataaaatgaaataactaagcaaaagaaaagtctaagattgaacgatatattctggtgacaaactgattagtctcaatagcagactagtcagtcaatagcagactagtcagtcagaagaaataaggtgcaccgcagctaaccgtaaagctttgcaaatggactggaaattattctgaacaactgtaatggaatatctgtctagttgatgaatagtcttgtgttggcttggcatgtccaccactcaccccatccacgggctcaccaagtcaccaatcagtttgttcaccttgctgctctttttttgcatcttcctttgcatctgcgtttcagcacatgacaaagttagaataaatattcatgtgttttctagtttcattttgaaattatccaaaatattataattttaaaccacccagaggttatcgctgtcaaactgggaatttccagtaaataagccatactggatgaaaataacaaaataaaaagaaagtgcatgggaatatgagaaagcaggcaattgagtgagaaatgataattttcttatagcccacaatcatgatagactcatgtaaattcaaatgaaaccagacacatcgaatgagcaaggctggtacattagacttctagggcaagaacatcatgttatcaccatttgccaacataactgacgagacaaacaacagcagtatatgtagaacatttcagatgaatacactcctaagtacttagaaaccaactccctacatgttacttttctcccccattcttttaattttaattatccctgtttcccttctagtccctattacatcatctaaaatgtcagtagaggacctgctactttcttctccttccgaatccagtcaaggagtgagccctgaagccggacaggtgcatgcacagcccaaaggctgaggaagtcagcgacctcatgtctgtgattgtgtgtccggcgatcatgtcgtcgcaacatctttgctttcctggctcctcgaatggttctccgtgtgctccgcatgttcattgttgccttcacagcctgaagaaatgcaccaccatgtttagacttccaaagcatctgatacgctgttgcttttgcattctgacgaaaacaatctacagcccttggcagcatgaacatttgtgtgcaagcaatgttgctcgttaccattaatcacctcaatcacagtactatcaactgctgggaataggtcttctgaagagccatggggcgtatagacaaggataacattcagatgcggaaattctttaagtgaagatttaccctcaacaattgttccctgttctctgaacccaggaggtgaaacttggcacagtaaactcacttcaatgatgggttctagagaaatatctgttaattctaccttgtgcaagttcccactaccacatactttctgaccatgatgcttgcaacacagtggatttgggcggaaccattcagtagctatactatgaatgttctcccaaccgtatgagtgagaatgtgacaccctggagaagtcttgtgtaggtagttgaataagttctttcctaacagtttcagctgtagactcaaaataaggagtaaacaactgcaagcacttaattgtagtaccaactatgtttgtactctctgaaagttgtagaataatatcaatgtaaaagttgtcctcaggtgcactgccatcattgaaagcaaagaacaacttagcttctattcctcgctctgcagagttattgggccgtacccaaaaccaatgctgcttgtttccctgtattgatttgtactctaacgtttcacctgaaataaggtgcccgataagagggtcaaagaacaagtaacggcgtggtgtgcctccaaattccacagatcttagaaaatcattagctccatctgcaaaccactcgaatctttggacagaagatctacccagctcatcactattgctgtgaaagatggaagataccagtgtcttggtggcatgggcaattcgcctaggaaaggaagaattccttacttgttgttccacctcatcttcttcctggatatgttgcctgcacttccgtagtgtgtcatcacactcttcagtagcacgcttcagcttcttctgccaacgtaacaacgggccactagtgatctgccatttattggatgtctcaagtgcgaactccaacttgatttgtgccatctccagcctctccaggtgatcccgtgcacttgattttcgctcacaccggtcaatcaacccagatatgatcctgtttaccgtctcttgaacgatagcagaaccgactatctcttccatcttcagtaatccttccctgatcaacacagagcaagatatatcaatacatcgatcaaaatatagatagagttaattgcatattggaccggctttctttaccatggtcgcagcttggactaggaacaagctattattttcactttgggctagtaatttttacaaaatgttacacttaggacctagtgttcttcttccagctctgcttcctcactctctctaccttcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctgtatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccgcatgccttgtcttcatgggcccgtcgccgtgggctgtctccatcttgggccagtcaggaccggccatgtggcctcctgctgaccgaacacccgagccggacaggccggttggcctctcttccagccagcccacatgcagtcatgcatggtattggaccatatgcacgtatgcactgccgaagcatcacaagctagctagctaatcaactagctgcccatgcttgcatatgcacacactagtgcatatatgcaagctcttcttccattcaccattttctttgcgcacccggcacttgcacttgaccttgcaaagtccgttgcaaagacctcctcatacggtgttcgtccaccgtgtgcaaccttgtgtccaatcttgtcacccggtatccttgatcgctttggacctcaactcctccctgagtctagtcccgatccaccgttgaccaagatcgaccccgatcacctacacacacatgaaccaaacaaccattgtcttggcacagatgtcgcaacctgaccaatgttagtccacgcacacacttcttgcacttccggtacttgtcaatttcccatcacaaaagaactgtaaccacacatggtttcacaaagacattcaccgcaaccaaaccaaaaaagatgcttccgaatgctgactgaccaatattgcagaaaggctagctgaaaccacaacataatggtaattttccacattccagaagctggaatcatggtaatgagttgccaaggcttgcttgctgatttaattttttaaagttatgcataggatgcattcctcaattagcagacatgtttgcaactccagcgttggcatttgcttgccattccgctggtaataagcctgttcttggtaatattcctccagattacataagattttaaaagtaaaatcttggtatatagttgatgaaacgtgcttgctatttttggtttctaaatactcctcttaatacacattacagaaaaaaaatgctagaaatcttgaatttcacgtagtgaaaagaagaaaaatcatcgtcaccgcaatcacttccagttaggcggctactcatcttgaccggttgaatagatatggcgtaatagacatgatcaggtagtgatatgcagggagatcgagccttacctcgaactagtgcgccacggccgccgagggctcctcctccatccccgcatcgccggcggacgcgctcgtatcgtatatgtggcgccacgtggagacagtagtggcagaggatcgagcaagggaacgccatgcccggacctccttgcgccgccggcgccggtccacgcgcagcctgcctcatcgcggatcgtccggccggcggcggaggccatggctgccggccacggtggcggccgtgtgtcgcctgcttacgcaaatggagacggaggaggatttgtgcggcccagttatcatcagcaaaagagagccgatctcggctccaaaaaagcccacactaacaccaggcaataattacgcagcccgtatgagataaaattttttaggttaattagatccatgccactgtaactttgacaaattaaaaaaatgttactaccattcgtcatatccgctacatgtcactgggaatttttaaaattggaacccagggggaggacggccatggagcagggccttctcggcggttgttggtgatgggagcggtggagccgcgtcgggccgcaacggcgcgcgaaggcacgcaaggccggtggtgcggcggaggtgcaccgggcaacggggggcctgcaggggaggcggaggcgcgcgggtccgcgcaaggacggcagaggtggaggggccacgctggccgcggaggccgcggagccgcacgtggcctcgtgcagtcgcgctcgtccaccgcctcgtcaccgacggcgacccacactctaccccatggtggacgcagctatgctccgacgtcgccgtcgtgctcgccatcctccttgaccgcttcttcgacatggaacaccgccaagcaaaccgacgacgtcggcctcgcgcggttggtggactttgccgacgtcaagcgcatcaacgacagaatgcatctatgggcgggcaagctagaccgctgctgctacaagggatgtatgaccagggtgccatctgacagtaggtgggcgtgcaggcagccacggggagcgcgagcagcgtggcggcaccgtgccacgctcacggcacgtggggccgatggagccggcagagccgcgcgtcgagcggaggaggccggccggcgcaaacggcggagccgtggagaggagggggatgaggacgggaatagagacggcataagagaggaggatagaaattatgaccggagtggcatggttctaattttaataactttcagtggcatatagccgatacgatgaatagcagtggtatttttttaatttggcaaattacagtggcatagatccaattaacccaaaaattttacagccaggtccctcaatgtttaaatgatatcccccgcaaaaaaaatgtttaaatgatacggagtatatggattgctaatttgctatatcattcctaacgatctggttatttacaaccagtcaatcaggtctccatttgggatcgctatatggtaatgatccgaccttttgcaaatcaactccacaaacttttttacacacaggtcaaatggagaaactatttaatgtaaacaatctgaaaactatcgttaattcaaaaaatatatatacgcttgagatttgttcatgtcacacttgctagtaaaaatatccgcgcatcaccaatgcaatctcaccggataaaccatggcatattcggctgtaattttactcacaggtatgacctggaaaactttactatacatctatttttagatccaacagtaaacttttactgtatattttccatgttgtgggtggacaggaagcaaatcctctaacatgaaaccctacatgtcaagcaccatgtttctctgactggcccacatgtcagtc

SEQ ID NO: 64299 - DNA, 7717 bp, Oryza sativa
agaatccacaaaggggaagcagtagaaggctcggtggtgaacctgagtgagctcctgctttgcagcttcagcgaccggcttgaaactagggagaagtgaatccaagcacctggccacaatcccagtcacgttcgtgcttgctgtcaaacgtagaagaattccaagaacaaagttctcctctggcctctcatggttgttgtagcgaagcaacacaccggcttcttgccctcgttctgcgaaactcattggctttgatattaggtagtactgatttccatgagaactttcatactgcagtgctttgcctgcgaggagatgcccagtgagaggatcaacgagcatgtagttgatgctgcctattctgccaaactccatgaatttcaggaactcgccggcgccatcggcgaacctttcaaacctctgaatggttgaagtggagttcaggctatcaacattcttgtcagcggcgaaggaggagaggaatgatcttgtggcaagggcgatccgtttggggaaagagcaccgactgatcttctccgtctcatcgtcttccatggcgcggcgcttgcatctgtccatgacatggctgcactcgtcggaggctcgcttcagcttcttcctccaacgcataagcgaggaatccatggccaaaggccacctgctggacacttccagggcggcctccatcttgatgtgtgccatctccagcctctccaggccatcttcctcgcttgatttgcggttatgattgtcgatgaggaaggtggagatcctgctcacagcctcaccgacgaccgcagaagcgatgacctcagacatcaggatgttcttggtgatcactgctgccctctattaaaaagggaattaaaggtcaggtgacaattattcatcacagaactagagatactggacttcagcacaaaatatacttaccacaccaaactggttgaaactgaaactagtgctttaaactgatagctttgcagattgtgaacagcataaacctgaatccagatggaaatggttcagagtcttcacgataccaattagacagtgaaaagtcatgaaggagcatctgtacaatgagtgatgtcatgaagttgacagacattaggtaattaatgtgaccgtgatagcaagatgactagtcttcccttcacaacaccacaagtctgatgatttgaatgtacagttgatttgtcacaatcacacaaaacttaaaaagctgcctcgttgactgtcccaatcttgtaaaaagtctagctattgaagacaaattatcctcgtcaccgcaatccttttccttgaaaattcgtggtaatgcttcaatgtcatgttaatcatgatcttaaaaaactgtgtttcacttgcataaactcctaacagtttcagctgcacatacttaattatagtgccaactatgtatgtacttgctgaaagttgtagcatcaaaccaaagaaaaagttatcctcaggtgtgtctctatcattgtaaacaaagatcaacttagctcatgctcctcgttctacaatgttatttgcctgtatcaaaaacaagtggtacctgtttccctgcactaatttgtaatccagcgtttcaccagcaagaacgtgccccacaagagggtcgaagaacagataatagcatggcgtccctccaaactccacagatctcagaaaatcattagctccatctgcataccactcaaatcttcgaacaacagatctatttggctcatggatattgccgttatagatggataatactagagacttggtggcatgcacaatttgcataggaaaggatgaattccttactagttgttcagcctcttcttcctcgacgtgctgcctacacctgcatattttgttatcacactcttccacagcttcttttgccaacgtaatatcgggtcaccagtaatccgccacttatttgatgtctcaagtgtaacctccaacttgatttgtgccatctccaacctctccagatgatccgctgtacttgattttcactcacagctgtcaatcaacccagatgatcctctgtctcatgaaccacagcagaaacaaccacctcttctatcttcaataatctctacctgatcagcacagagcaagatatatcaatacatcaatcttttgcgaaatcgcaaaagaattgcacgtcaatatattagatcaatacatcattcaggatgctcaaataaaacaaaagatagatcagtgaattcctgataagtacaaagtgcattgttgaattatctgtgaacccaaccttctgagttgaattagtaggaaagatcttgagggaaaacaggtgagccacagagtatctagcagacgataactggtttgaatgaatggcgagaatgaaagtacatgtcttcggtggatagagaatcgagcaaaccaaaggtggttctctttcaagtttggttagtgctctagtctgttctccagttggtttctgcccactttgactgaccaatcgtcaatagtcaatactgaatgctgactgaccaatcttccagaaaggctagctaaagataaatatttttggaaataaacccctgtaggatttgttttcaacatataggtctccatgtacacactcccccttctgccgctgtaccacaccaaaactgaattttacatgtagctctctctcataagtcgatggttgggcgctcgcactcccctcttccggccctcccgctggggcgccgccacaagccaccagccaccacgccgtcttcgttgccgcaccagagctgagcgcggccaatgagtcggcctgcaccctgccatctctgttaccacattctccatgcagaggtaagcaacaccatggcaagacctccagaacacctcgtgcgccgacgattcatccaccgcctcgtggcacaggtgattgacggcgtttggcagcagcaactcctccaactcatgcaatccaacattggtgtgcacgggttgctcctccctcccatcgatcgccacaaccgtgacgctctcagccccggacagcagctgctctggtgacgcgtgtggcgcgaagacggccgtcagctgaagcagaggtggccccgaatttccagaaaaaccagatgacgatgaagacgatgattgcttctgtctctggctcgtagagacatagcgctgcacggccagtttgatcaccggctccgggaatgcacctgacggctcaaccatgtcactgcttctgcttcgaccatggtgctcgtgttcttcgcagtcgcagcatgctgagtttggtcgagcacggtgagtctcagcatggtggatgctccagtactctggatcagtagaatccacaaacgggaagcagtagaagcctcgctggtgcaactgagtgagctcctgctttgcagcttcagcaacagacttgaaattgggtggtagcaactccaagcaactagctacaattgcagtcacatttgtgcttgctgccaagcgtagcataattccaagaatgaagttttcctctggcctctcatggttttggtaccgaagcaataccccggcttcttgtcctcgctctgcaaaacgcattggccgtgctgctaggtagtactgatttccatgagaattttcatactgtagagctttgcctgcacgaaggtgcccagtgagaggatcaacaggcatatagtttatcctgcctatgctgccgaactccatgaatctcaggaactcgccggcaccattggcaaacctttcaaacctctgaatggttgaagtggtgatcaggctatcaactttcttctggccagtgaaagatgatatgaacgattttgtggcatgggcgatccgtttagggaaggcgcactgcctgacctcctgttccatctcatcgtcttccatggcacggcgcttgcatctgtccatgatttggctgcactcatcggatgtgcgctttagcttcttcctccaacgcaggagcgaggcgtctgtgacccgaggccacctgctggatatctcgagggctgcctccattctgatgtgtgcaatctccagcctctccatgccatcttcctcgcttaatttccatttatgcttgtcgatgaagaaggtggagatcctgctcacagcctcgctgactaccgcagaagcaactacttcagacatcaggatgttcttgtcgattaccctagcctgtttgtaaaaggggatggaaagataaggttacaacttacaattatattcacaacagaactagagatatagaggtttataagaatgtagcacggaatgtactcacctcaccaagctgcttgaaactagtgcttcaaacatactgcgattgtgacttgtgaagagcataaatctgtgtggtgaagaggggagttcaattgattcacaatgggacagtgaaaggtccttgagtacatctgtgctggaattgatgtcatgatatagaaatttggtaattaattaacatgaccgtgatagcaagatgacaagtcttccctccacaccgcctgtatttctccaaatactctgtaactgaatcaacttttgagtaatacatatgttcaggccgagaaaattgtgccatagttgtttcaaaaagagatgacaagtcttcatctgtggaaggatccatccgatataatgtgaattaaccaagcaaaagaaaagtctaagattgaacgatagattctggtgacaaattgattagtctcaatcacagactagtcagtcagaagaaataaggcgcaccgcacgacttgtcgacttaaccaaaaacaatgcttccgaatgttgactgaccagtcttgcagaaaggctagctaaagatgaatcctcttcgtcactgcaacatttttttttaaagaaaaaatcattgtcactggctcagtgcaatcacttccaggcttccagctactcctcttgaccggttgaatagatctcgcgcagtaaacgtgatcaggcagtgatatgcagggagacggagcctcacctcgtgctattgcgccgcggccgccgaggggaaacatcggtctcctccatctccgcatcgccggcggacgcgctcgtatatgtggcgccccatggagacagtggttgcagaggatcgagcaagggaacaccatgctcggacctcacctccttgcgccgccgccgcgggtccacgcgcggcgtagcctgcctcctcgcggatcgtccggcggcggaggccatggccgtggcggatgatggtggtcggcgaggagggtgaactggagacgaaggggtggcccagttgtcagcgaaagagagtccatcgcggcccaagtataagcccacacttacaccaggcaattacgcagcccccggatcagatgagatcagaaaatttacaaccaggtccctcagggccgttttggattgaagccaaaacgtgccataccaaaattttggtaatttaaatagaaaatgtgctagtttgaattgatgccaaacaattggtagtgcccatgttcaatttggctatattttagaatcttcctcaccatcctattaaaatttggctttatattggtcccaaaccaaacatagctagctaactttgctctacccaaaaagtatggtagacacgcatgtcaatacatgggtggatgcacgcccccttctaacaccaccggccgtcacattggagcacaggaggcaagcggcaccgtcgtctaccatcagaccagccattgagtcggcctagggacacaagcaagccgacttgcgagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttttatgcgaatataaaaatacttatatcatgcttaaaaacatttgatgataaatcaagtcacaataaaataaatgataattacataaattttttgaataagacgaaaggtcaaacgtttgtcaaaaagtcaacagcgtcatacattaaaatatggagggagtatatgtttacatagtatcataatcagcccctaaatcaataagattagccatgtagtgtcattttcatctttctccgcacgtaccagacaagttcatgcaccaaaataagcattttacaaattcgtgtaccggcgatgcaatttactctttacattcatgaccctacccggctacttgcaacggatgtcagcaacccacaaatttacaatcaggtctgtcattggatcactaccacaatcaggtcactcatagagattacaaaatttacaatcgaaatcgctaatttggcatttctttttttgcaaatcaata

SEQ ID NO: 64300 - DNA, 3290 bp, Oryza sativa
ttttttgaacaaaattttaaaaaatcatcctttacttccatcaacccatgccagaaatgagagttaccctgtttaaagtttacctcagacatagttttatttttcaaatatttccccctaagaatctcctgccaccaaccttctttgttttccaaattccaaatccatttccccaacaaggccttattcataatgtccaggtccagaacacctaaacctccttgatctctaggtgaacaaataatgggccattgcactaaatgatattttatgatgccttggtcctcctgccacaaaaacctcctcctgaagaagtccattttttctttcactcctttgggtaacttgaaaaatgagatcatatacatgggaacactgcttaaactagaattgatcaaaattaatcttccccctattgactatcagttttggtttttacatagctctcatagatcgatggctgcgcggagtgggcgctttctcttccatcctcttgttctcccgccgccgccgccaccaccagccaccgcgccgtttccgccgccgcaccagagctgagctcggcgatgccacaacctttcacaatgacacggccaatgagtccgcctgcaccctgccatctctcttcccatcttcttcaagcagaggtaggcgacaccatggccggactgccacagcacctcatgcgtggacgacgacgacgacgatccatcgtacgccgcctcatggcggcacaggcgatcgatggcgttgggcagcagaagctcctccaccaacattcctgtgcacggcttgctcttccctcccgtcgattgcttcgacagcaacgctccgggctctgggcggcagctcctccagccaagcgtgcggcccgatcacggccgttagctgcagcaggggtgtcctcctatcgccatgaccagatgatgatgatgatgaagaagacgatgatggcttctgccatgcagagatataccgccgtacgaccaatttgatcaccggctccgggtatctaccatggtgattgtgtccttggcagcatgcggagtttgggcgagcatggtgagtctctgaatggtgggtcctcctcgagtactctggatcggtagaatcaacaaaggggaagcagtacaaggctcgatggtgcacctgagtgagctcctgctttgcagcttcagcaacaggcttgaaattgggtggtaacaactccaagcacctggccacaatcccggtcacgttcgtgcttgctgccaaacgtagtagaattccgaaaatgaagttcttctccggcctctcatggttctggtaccaaagcaacaccccggcttctagtcctcgctctgcgaaactcattggccatgctgctaggtagtgctgatttccttgagaaatttcataccgtagagctttgcctgcaagaaggtgcccggtaagaggatcaacgagcatgtagttgatcctcctgcctatgctaccgaattccatgaatctcaggaactcgctggcaccatcagcgagcctttcaaacttctgaatggttgaagtggtgatcaggctatcaactttcttctgtccagtgaaagatgataagaatgatcttgtggcatgggcgatccgtttagggaaggcgcactgcctgacctcctgctccatctcatcatcttccatggcacgacgcttgcatctttccatgacttggctgcactcatcagatgtgcgcttcagcttcttcctccaacgcaggagtgaggcgtctgtgaccggaggccacctgctggatatctccagggctgcctccattctgatgcgtgccatctccagcctctccatgccatcttcctcgtttaatttccgtttatgcttgttgatgaagaaggtggagaccctgctcacagcctcgctgattaccgcggaaacaactacttcagacatcaggatgttcttgttgataaaccccttcctgcttgtaaaagtggaacgaaaggtctagttagaactgttcatgacagatctagagaaacagaggtgtacaagaacttagaacaaaatgtactcacctcaccaagctgcttcaaactaatgctttaaacatactgcggttgtgacttgtgaagagcatacatctgtgtggtgaagaggggattcaattgattcacaatggcagggggacttgtcatccggtagcaggatgacaagtcttccctcaataccgcctgtatttctccaaatactccctgtaactgaaccaactttggaataatacatatgttcaggccgataaaatttctttccatactcgtttcaaaataattaaaagaaaaaaaagacaaatcttcttctgtggaaggatccatcaaatataaaatgaattaactgaggaaaataaaagtctaagattgaaagatagattctggtgacaaactgattggtctcaatcacagctagttggtcagaagaaataagtccatgactgacttcgtggagaaaaaggttagcaaagcaaaattgtgttttctcagaagttaagtgggtcatgttggatgtatggtctaattaacatagcacacggtgagaagtgagaacacatcactttttagactctaataacatagtctccgtatgatttgtcaagcaagaaaactgccctctatgaccgtccaatctcattgcaaggctagccaaagataaatcctccacgcctctgcaattaggacaatttaaagtaactactcgtcactgcaatcagtttcgggtactagtcttgactcttgtgtggtcgaacagatcttttgccaattctcactgaacttatctttcccctaaaaagaacagtaacccattgcctaaatctgttttgcaggttgtgtacagatcgatagccctgatgcagcgctggagggtgctccaaacaagaaaagactgcgccctgctagagctggacaacgtttttaagaagctgatggataagatgtacaggctgtgtctagtttcttccaaagttgaaagtttggattgaaattggtacgatgtgactgaaaagttgtgtgtgtatgacaggttgatgtaatggaaaaagttggaagtttggattcaaagtttggatctaaacacagccacagctttggcctggagatgccctgccctccgtccctaaatatttaacgccgttaactttttaaacatgtttgactgttcgtcttattaaaaaaattaagtacttattaattcttttcttatcatttgattcattgttaaatatacttttatgtatacatatagtttatatattt

SEQ ID NO: 64301 - DNA, 3482 bp, Oryza sativa
aaaagaacagtaaccaaactgcacagaacaggtcgcgacaagcagcagtgaaattgaatgcgagcaaaatgtcgtacatatctgggatggagcgtatctgggatggagcgaattaacgcgaacaccatattacataaaatggcagatggcatttactaggaactgtcttttgtccgtacaactaagtaacataggaatgcgatgcaatagtggtgtggcgtcttgtaaataggtggtggctgcgaagcctcgccatctctgtgcattcttcaaattctcaatatactacggtcggcgtgccgacccggcgaatgcgatgcaataatctaccgtacaaaatgtaccaacctcatcaagctggttgaaactagtgcttagaatatactgtaattgtgccttaaccaaaagtttaagattgaacgatatattctgccattctggtgacaaactgattactctcaatcacagactaatcagtcagaagaaataaggaacacagggcttaaccaacctcaagctttgcaactgggctaagtaaaaatactgaaattattttaaacaataagggaatacctgtctgcttgtctgcttgatgattaaaattgtttggcttgacatgtccaccttcctcactcacccattcacagacccagcaatcaacttgttctccttcttgcaacttttttgtgtttccctttgtttctgtgtttcagtagacgatgaagtcagaataaatatgcatgtgttttaatgtttcatttcggaatcatcctaaatacatataatctgaaatgtaaaccgccccgaggataccactgtatgaaaattactgatatgcaaattacaatttttttacaaaaaataaagtgaatgggaatatgaaatagcaggaaatagggtaagtacaaaattttgtcatcaccttcaatcatggtaaacgcatgcgaattcaaataaaatatgtcacgcccaatgagtgaggatgtacattagattgatagagtatgaacatcatattatcaccattcaccaacataagtgatcagctggacaaacaatagcatatggagacatggagcacacattacagatcaacacactcctaaggacttctaaatttaactacctacaattcacttttcaccctataatattacatttccattcttcttaattctccctgtctccttaaccagtctctgtaaatgatctaaaatttcagacgcaatagtggagatgctaactctgtttccttttctttctgaatccaatcaaggatagagccctgcagctggacaggcgcatgagcagcccagaggttaaggaagtcacagatgaagtcacaggtcacaactgtgcgcctctgcgttctctgatccattccacgcagcagctttgctttcttggctcctcgaatggttctccgtgtgctcgtcatgttcatggttgccttcacaacctcaagatatgcaccgccatgtttagacttccaaagcatctggtacactctagcttttgcattctgatgaaaacaatctacagcctttggcagcatgatctgttccatttgttgtaaggcaatgtttgtgtgcaagcaatgttgctcattagcattaatcacctctaccacagaactctcgactgttgggaataggtctcctgaagagccatgcggcatatagataatgttaactttcaggtgcggaacttctttgatagaaggtttgccctcgacgatcgttccgcattctccaaacccacgcagtgaaacttcgcacttcaaactcacttcaataattggttctagagaaacgttttgtaatcctatcttgtccgtgtttccactgccacgtaccttcgcaccatgatgcttgcaacacagtgggtttgggcgaaaccattcaatagctatactatgaatgttgtaccaatggtttgaatgagcctgtggcacccaggagaagtcttgtgtaggtagcagagtaagttgctttctaacattttcagttgtagacttgaaatgaggggtaaacaactgcaagcccttaattatagtgccaactatgtttgtactctccgaaagttgtagcagcatacccaaaataaagttaccctcagatgcagtgccatcactgtaaacaaataacaacatagcttgtactcccctctccgctatgttattgggttgtatccaaaacaaaagctgcctgtttccctgcactatgtactctagagtttcacctgcaagaagatgcccaataagagggtcgaagaacaagtaatgacgtggtgtgcctccatactccacagatctcagaaagtcattagctccatctgcaaaccactcaaatcttcgaacaactgatctactcggctcgtctatattgccatggaagatggatgatatcagtgacttggtggcatgcgcaattcgcctaggaaagaaggaattccttgctacttgttcggcctcttgttcttcctggacacgctgcctgcacatgcgtattgtgtcatcgcactcttcagtagcacgcttcagcttcttctgccaacgtagcaatgggccactagtgatctgccacttattggatgtctccaatgcgaagtccaacttgatttgtgccatctccagcctctccaggttatcctgtgcacttgattttcgctcacacctatcaataaacccggatacgatcttgttaaccgtctcgtgaacgatagcagaaccgaccacctcttccatcttcaataatctctccctgatctgcgccgagcaagatacatcaatagatcgatcaggatgcccaaataaaacaaaaaatagataagtgaattcctgaaaactaataatgcgttgaagtatgtgaaaacggtaaaccgaaaccttctgagaggtgcaccagagagtacccagcacacgataactagattgaatgaatgctgagcctgagcatgaatgccatgtctttagtggagaaaaatcgagtaaatcaaagttggttgtattggaagttagataaccttttttttagccgggttggccataagaagaggccaaccaaatcttattaagattatgagagcaccttgacattaggtaacccttgacatatggttcgagaagaacaccttaattactattacactatgtgattctcctaattggaactattatactatgtgattctcctaattggaagcattaggagaatctgatgtcttttaatgcgttttttttgggttcttcttagccatggtaaggcgtggtgctatgtttggtgatcattttgccagtctgtctggtgtctgaacttgtaagcagagatgcgtttgacaggggtttgttagggggtagcaacctgaacttttgttgtgaaccttgtaatcgtatcgttttcattaatgaaagcgggaggggcttgacctctctttatcaaaaaacaaaaaacaaaaactatgtgattctccagtttttttta

SEQ ID NO: 64302 - DNA, 1737 bp, Oryza sativa
cagcgtgacataccatgtatctcggccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccgcacgtcccgatttcggcggcctcaactccacgatggatttcagcgtccgagcccgcatccagagcccgcaccagtcggccgcccacttcgtcgccggcgagaggtgacaccgccgcccggcttcgtccagggtaggagtcactgctggttgagtttgtggagaacgacgcaccttttcctgtgcccgcgaggtgtttgtggaaatgccctgccgtctgggatgatgcagagtcctgattgaaagtgaattgttattgtttggctttgtgagattagaagcaaattgattctgtaatcttgattgagattgatttggttgtatgactcatatatgctgtaatttgaatgaatgaatgaataaatcagtaacttctggcgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttgctgtagtgctatcgtgaaatttcatggtcagtagttcctgtgcatggtcgccctgatcaatagtgggtaggacatctttggagctgtttttatgcgagattcctgcaaaattcctagtacgaattcatgtgttgcaaacaagcccgtatgtctccttcatttcttgatacgatagggatggattgtgttttggttgacaaaatccaaagagagcaattttgtgaatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcggcctggcgcctcccccggtcgcggcggcgccggacgagggcgaggtgaagcgccggcgtacgcggacttgagggcgaggctaagcgcgtgcgggcttcctgttaggctgaaacggggattttttttgcctgcgtgcgggtccaagcgctaccttcgttggattcgttttgaacgggcgagatgcatcgtatgtcacgctgtgacttgccttagctaagtcacca

SEQ ID NO: 64303 - DNA, 2640 bp, Oryza sativa
cttgtggattacctaataatttgatatataaataggtttatgggttgatccacttgcttctctacgacgcggcaaagccgagtcatgacgcgaaaacctgcggattaccctttatttaacatataagtaggttcgtgggttgcaccgcttgcatccctaaatgtaatgcagggtttttcgccaaaattagccttgctaaattttggcacactttgacgttaccagattttggtaacgttggatgtattcagtttgtggtcctgccaaaatttgatagtgtttgtattaggagaaactttcgaaaatgctaaattttggtgaagtggcaatgtcaagatttgtttagtttgttatcctaccaaaaaattgatactatcaaatattgtgagggttgagattggcggcgaagtgaacaagtccgtaatgcaaaaaataatcttgtgcttgtgtccaaaatggcaaaatgttactcaactcaccaagctggttgaaacttgaaactagtgctttcaatatactgcagcttgacttggagtggtgaagagcgaaacaattgtgtgccgaaggaggagtttcagctccttctcaatgtcagttggagatgtcaattcgtataaatggagtccggatttctattcactatctgaaaaatgtcaatttaacagtgaaaagtctataagtagcaactgtaccagaatctgctctgcacaccgtctgtatttctccaaatactcttcaactgaaccaagttttttaatagatggcaccgttaacttttggatacatattttactattcatcttttttttttaaaaaaaaacgtaattataatctagtttgggcgtgggaaacggaggcgggagcggtgaactctgggagagagccggatttgttgggcgtcgtcgtcgcaggacaaggaggcggcagcgcgagatgaggagggcgtgcgtgggggacaggtgctcatcgggatgcggcggaagcagcaggacagacgacggcctcggctcctctcccgtcgcccgttgcccgcagcctcctccgtcgccgcccgtcacacgcagccgccttcgccctcacccaccgcttgccgcccgccccggccacggctcctcgcccttgcccaccagccacctcctctgttcaccaagagagagagagggggggcagagaaggagtttttatttgttttttctgactgtatcgccacgtaggctgaaaaccgcttcgaatcaagttagggtggtaatttatccggtttgaagagtttgggatgctaaatgtccggtattatagtttagggggataaatcatactaccgtaatagttcgcgggggtggtaattcgtactttttcttggaaatttcggatccaattcaggatttttcttggaaagtttcgggaagaaattggaatggaataatataaactagcatggtggcccgcgcagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttaattatttgtaaattatatatattcctatatggactctagactcgtcttttaatatttcttttttttaattccgaattttctgtaaattgtatttctatatagactcctcttcttccaatattatttatttttatttctgaatttttattatttctaattgtatttctatgtggactctaaactcatatttcaatattctttaatttttaatttcgaatttcagtcacttctaaattgtattcctatattgactttaaactcttcttcccatgtttttcttaatttcgaattttagttatttgtgaattatatttttatacggactctaaactctacttttaattttaattttattatgtttattccaaattttagttagttttaaattcctatatgaactctatactctacttctaatattccttattttttaattccgaatttctattatttcctaattgtatttctttatgctctacttcttatattccttatttttaattccaaatttcagttattttctaattgtatttctatatggactctagtcacctcttctaatattccttattttttaattccgaatttcaactatgtctaaattgtatttctatatggactctagtctcctcttctaatatttcttatttcttaattctgaatttcaactatatctgaattgtatttctatatggactctagtctcctcttctaataatccttattttttaattacgaatttcagctatttctaaattgtatttttatatgaactctgcttattttttctccgattaatgtgagaatttttaggccttgagagcgaacatgttggcttctttttctatggatgatatataatagatagattcatatagacgaaagggttatctattgatgctagatgacagggacagaggaagagggaaacccattaaagcatctccaatagcatcttcattccactctccaaaccaaaatttagctattttgaaca

SEQ ID NO: 64304 - DNA, 1988 bp, Oryza sativa
agtcaacggcgtcaaacatttcgaaacggagggagtagtattttcctctgttcagacttcagagccgatggtggagccgcatccaagaaaaaggggttcggggtcgacgagggggagggtgctccggtggtcgacaggctcggcgaaggggtggacaaggacagcggcgtcgcggcgaagccggtgagggcggcgccgaggcgaggcgacgtcccgagcggcggtgacagtggagagagagagagagagagaggagtggcgggagctcggttccgagcgggtggcggcgtcccgagcggcggcgacggcggagagagagaggagcggcgcgagctcggttccgagggggtggtggcgtcccaagcggcagcgacgggcgacctagcacgccggcaacggcggagagagagaggagcagcgagagctcggcggcgacgagcgacggcggcggcatggattcgggggccacacggcctccgcacccctgggtcatcgtcgaggccaccgttgccgaggtcgtcgtcgcaagccgctgccaccgccgtcgtctacgccgtctccccgaatccacgccgcccgccgttgcccccacgttgtctccgatggtgtggagtgagtggagagagaggggagaagaaaagaaaaggtagagaggaggggtgaagaagaagggtaaggtggctgacatatgggaccctctgtcatagagttaaaatggagagcgtagatggagaggctgttgaagtaggtaaggagtttgacttgctaaatcagatagagagttggctatgtgggtgtttagagagtctaatttggagggactgttggagatgctcaccggccgtagtatccgtccccaatgcccaattccccccaccattgccgactctcttcctcgcttccggccgacggccgcacttcccatctccgcctcccctagttggctactcctcccagcctgcctccgatccaccggatggcgtgctcgtcgctccaggccgccggcggcaactatggtccatggactgtggcagctcgacctcagtcagatccatggcgaggtggccctcaacttcaggcggtcggcattgctccaccttgcagatccaagtgctgtggaccactgcttttttcttccctatggagcacccgttccttgtacaaggggtgctgacatcatgcgaggtcattcctcgttcgtcttctccaccacgctgtgcataagagtctacatgaatggtatccgatgcaaggccactcgttgtcgcctgggcaacgcgtcactgggaaaatgtcaaaaaggccgtggcagatgaaaacgatctggatggagatgtgatgccgattcatcagtttttcaggctttgaatcatgaaactagctgcaattttcctatacgtgaaggactggattggcaaaatgtggaaaattcatggcaggtgaaaacgatatggatggagatatgccgtaaatttttcccatttaagcccttttcgggacactccgaaccttcaattttttttagcaacactttttgtttgatcagtaacaccgacgtaacaaggtgccccccccccccccccccccgcctttgctctcttcgtgtttcatgccatacaattcgttggtcttatgtcaatctttacttattggatgctagcatgactatcgtgcgaacaattgataaacacttgggtagaattaagtgctatttttacttacacttcctcttcgtctttccaagatgatagctcgatcgcctgcctttctgggatgatagttcgcctttctttcttcttctttttttttctttcataatagacagataacaagcagctcgttttgcagtgaaatagcaatcgacttcaactgtcattgcaccgtatgtagtccagcttcatgccaatttgtcccaaaatatgctatttttcactcacttttttctctccaggaaacatgtttgtcccacatactgaggctgcaggaat

SEQ ID NO: 64305 - DNA, 2269 bp, Oryza sativa
actttgtcacttatgtgacaggcaactgattatttacatgaactcttaccttaccttgcacatttcacatgaactcagaatatgctggaggaggattcctctcaacctctggagatgtatacagctttggcgtagtactattggagttgctaacagggaaaaggcctactgatcctctgttctgcaatggacttagcatcgtcagtttcgtcgagaggaactatccagatgtgatagatcatatcattgatacttacctccgaaaagatctcaaggagcttgctccagcgatgttggacgaagagaaggcagcataccagttgctgttggacatgcttggagtggcactttcctgcacacgccagaatcccagtgaacgaatgaacatgagagaggcagcaacaaagctgcaagtgatcaacatatcgtatatatctggaatgtagagctaagtatactatacacttcattagtgcgcgtaccacagtgtataaaatggcaggtggcatttacaagtaactgtcttttgttatccatacatttgattataagggcaatgcaagtacaaaatttactcatctgtagacgcgggcagtctccccgtagctgctgtagcctgttttggaggagtttggtgtagaatgtaatctctgtagcttgattcaaaaaaaaaatgtaatctctgtagcttgtaactctcttgccgaaaaatcttaataaactttggctggcatacgccaccctgcgaaaaagcaaaatgtactcacctcaccaagctggttgaaaatagtgctctaaccaaactgcaattgtgactggtgcagagggttagagggaggttcagtatcttcacaatgtcaattggacagttactgcaatgtatttctccaaatagtctgtaactaaaccaacttttgagtaatatctatgtttcaggccaacaaattgcttgccagttctcaaaaaataaaaataaaaatgctgtagtagtttaagaaaaaaatggcaagtttttgtctttggaaggatccgtcaaatataaactgaatcaactgagcaaaagaaaagtaaaaaatattacattccgttgataaactgattgattactctctatgacagattaatcggttagttgtgaaagggtatgtaacctagtgattgcaatgacctgagtacaccacaaggtcctgagtttaaatctttataggagcgaatttcagattaggttatttgagagctaagttccctatttgatagactaagtttctaattttaaaaggttgcatatatctggttggatgtagaggccagataaaaaatatccttctctaaaaaaaataaaaagaaagactaatcagtcagaatactgatataaggtagagtctctctacctttttgagtcaaaaaaaaaaaatcagtcagaagacaaggtcaagcttagcaactggactaagtacaaaaattttggaattcttttgaacagctgtaatggaaaacctgtctgtttgacggattagaattgttccctttcggagtcatctgttggcttggcatgtccacccaccaatcagctttttctcctacttgctgctttttgtgtgtttcctttgtttctgtgtctcagtacacgatgaagtagaagaaatatagcatgtttttttttgttacatttcaaaatcatcataaatacatataacctgaattttaaaccacccagaggataccactgtcaaactaagaatttccaggggggaaaagcatgcgcctcctatcatggtacacagatgtaaattcaaataaaatatgacacatctgatgagcacggctgtacattagacttccagacaatgaacatcatcttatcactatttaccaacataagttctgggttggaccaacaacagaagtatatgtagcacacattttttttttgaagcaaaagacggcaggagctctgccggatatattagaaggagaagcagttacagaggtcaagaaagagcagaccactaggtgacattttcagttttcatttttatgtagcacacatttcatatcagttaactccgaatgacttagatattatctccctacaagtcacttttctcagttaaaatattacatttgtacttcacgtttctctgatttcctgactagcactagctccacctctcctagagctagagctcagccaaacagttttagctccacccaaaatgggagtggagctgaatggaactctctcataaaatgaaccaaagaggtggag

SEQ ID NO: 64306 - DNA, 13120 bp, Oryza sativa
caaattcacttgaataactgattctagagagaagtctggtaattctatcatgttcatgttgccactaccacataccttctgatcatgatgcttgcaacacactgggtttgggcggaaccattcggtagctatactgtgaaggttgtcccaatggtataaacgagaatgtggtatccaggagaagtcttgtgtaggtagcagagtaagttctttcctgacagtttcagttacagactcgaaatgaggagcaaacaactgcaagcacttaattatagtgccaactatgtttgtactctctgaaatctgtagtatcataccaagaaaaaagttatcctcaggtgcagtgccatcattgtaaacgaagaacaccataccttctatcctctctgcaatgttattgggccgtatccaaaacaaatgttgcttgtttccctgaaccaatttgtactctagcatttcacctgcaagaaggtgcccaataagagggtcgaagaacaagtaacgacgcggtgtccctccagactccacagatctcagaaagtcattagctccatctgcaaaccactcgaatcttcgaacggtagatctagtcggctcgtcgatattgccataaaagatggacgatatcagtgacttggtggcatgggcaattcgcctaggaaagaaggaatcccttgctacttgtttggcctcttgttcttcctggacacgctgcctgcacatgcgtattgtgtcatcacactcttcagcaacacgtttcagcttcttctgccaacgtagcaacggctcactaatgatctgccacttcttggatgtctcaagtgcaagatctaacttgatttgtgccatctctaacctgtccatgtgttcctgcgcacttgattttcgctcatacttgtcaatcatgccagatatgattttgttcactgtctcatgaacgagagcagaactgaccacctcccccatcttcagtaatctgtaggattccctccctgatcaagaatcaatatatactatatcaatcactaaatcaaaagacagaccagtgaattcctaataagtactaacaaagtgcaatgctgtaggatatgaaaaggccagccttctgaattgaatcaattttgtgatataagagatattcatgcagggggcagtgaaatgaaataatgcatgattccatacagaaaaaagtgagaaattcaaagttcaatgtaaggcctaaccttctgggttgaatcaataagaagtaacttggggccttgggggtcagacaggtgcacccagagagagagagtacctagcacaagataactggactgcagttttcaagaatgaacagtcctgtaacacaaggaggtatttatgcagggggcagtgacgtgcatgattccagggagagagaaaaaaaaagtgagcaagtcagagttgggtgctaagcgcgtctttgtttgatgtgtatggtggagagaacacatcactctagtctaatctcctgttgattcgtcaatcaacttaaaggactaccctctttttgagcttttgaccgtcctaggtgggattgatgatctgccacactcttttagaccggagatttgatggtttgcaatcttgggctaaagctaagcatcagtcgacactgcaaagtctgcaatcaattcagttccggctactaacctttacggcctgtttgaagagaaggaaagaggaatggaagttttaaggagggagttgatagtgggattggtcatgggagttatatttttagtccctatcctttcttttgtttcacatcgaattctctccaagtctcacgaattaacaggcctcctccaggtaagagattggtgggaattggacctcttaattccccatcccaaaccccttcgaattcccaaatctttcaatcaaactacaaacttaaacttccagatatcatacactctcattccccattatcaactcccaccaaccaaacaggccgttagtcctttaccatccctttcacctccttggttgtgcatatacttcgtcaatatagagcctggactaatgaaaatcctcgaaatttggtcggctccttcgctgacccggcaaaaagttaatgaaaatccattatcttaaaaaaaaaaaatctctttcacctcctaaacagaattacagaacagtaattaagcatggaaccaaagaaaaaactggttgcgagatgcggggaaactgagccgtaccacgggctagtgcgcaggcgcatgaagcggccgccgcgaggcgcgagcaaacagccgctctcttcttcttccctctccgcgtcgccgcacgcgccaccacatacggcgccacctagtggtggagttgcagcggatcgacgaatgcaacgccatgcccggacctccctgcgagcgccctcgtcggcgcggactatcgatcgaccagaaaccccgtcctccggcgacggcggcggcggcggccgcggccgcggaggccatggccagccgcggcggcgtgcttgtggtggtcggccttcatgcggcccaagtgtcagtggaagcttggccagcccatcgagggcccaactaaagcccacactaactcacctggttgttacccttcttgcttcgctgccacaatacaactttgtttacaaataaagtcatgcagaatattgtgtatgatcatcgagcacaatattatcatcaccaactggcgtcatcacaccattgtcattttcgcgcaacggtatatttgtgcaaaacaataaattacacataaatggtaccactatcaaactcagaatttcccgttaaaaaatgtgtggatacaaataaccccaaaagaaaggaaaatagaagtgcatgggaatatccaatagcagaaatctgagcgagatactgatatatgctaattttctcatcaccttcaaggcttcaaacatattacacgcatgtaaattcaaatagaatatgacatccaaatatccagtggtgaaactgtacattagatttccagggaatgaacatcaagttatcaccatttactaagttctgcgctgcgcaaacagcagcagcaaatatatggagcacacatttcagatcaatacactcctaataacttggagataactccctaagtcacttcccctgctagaatattactccctttgtcccaaaatataagcatttttatccatattcttagctaaaagtgcttatattttgtgacggggtagtacattttcattctttgaagtatccctatttccctgacaagtccctattacatgatctaaaatttcagatgtagtagatgaggtgctaactgtgcttccttttctttctgagtccaatcgaggattgagccctgcagctggacaggcgcatgcgcagcccaaagatttaagaaatcagagatcacatctatgcgactctgtgtccaatgatcatgtcgtcgcaatagcttcgctttcttggctcctcgaatggttctctgcctcagcatgttcttggataccttcacagcctgaagatatgcaccaccatgtttggacttccaaaccatctgatacactgttgttcctgcattctgacgaaaacaatctacagcccttggcagcatgatcccttccatttgttccaaggcaatgtttgtgtgcaagcaatgttggtcaacaccattaaccatctctatcacagaactctcgactgctgggaataggtcttctgaagagccatggggcgtatagacaaggtgaactttcagatgcggaaattctttgagagaaggtttgctctcaacaactgtgacctgatcttttaacccaggcagtgaaacttggcactgcaaactcacgtcaataactgattctagagaaatgtctggtaaatatgtcttctccatgttgccactactacataccttctgactacgatgcttgcaacacattgggtttgggcggaaccattcagtaactgtactgtgaatactgtcccaatggtatgaatgagaacgtggcacccatgagaagtcctgtgtaggtagttgactaagttccttcctaacagtttcagttgtagacttgaaatgaggggcaaacaactgcaagcacttaattgcagtaccaactatgtttgtgcactctgaaagttgtagcatcatacctagaaaaaagttattcacaggcacactttcatcattgtaaacaaagatcaacttagcttctactcctcgctctgcggtgttatttggccgtatccaaaacaaatgctgattgtttccttgcactaatttgtactcaagtgtttcgcctgcaagaaggcgcccgataagagggtcaaagaacaagtaacgacgtggtgtccctccaaactccacggatctcagaaagtcattagctccatcagcaaaccattcaaatcttcgaacagcagatctaatcggctcgtcgatattgccgtgaaagatggatgatatcagtgacttggtggcatgggcaactcgcgtaggtaaggaggaattccttacttgttgttcagcctgttcttcttcttggacgcgctgcctacatttgcgcagtgtatcatcacactcttcagcagcacgcttcagcttcttctgccaacgttgcaagggcccaccagtgatctgccacttactggatgtctcaagtgcagtctccaacttgatgtgcgccatctccaacctctccatctgctcctccgcacttgaattttgctcatacttgtcaatcaagccagatatgattttgttcactgtctcatgaacaacggcagaactgactacctctcccatgttccctccctgatcaggacagagcaatatatatatcaatcactacatcattatgcccgatagaatcaaaatacagacaaatggatacctaataagtacttaaaaagagcaatgttgtagtatgtaaaaaggccaaccttctgagttgaatcaataggaagcaatttgtggtcacacaggttcaccgaagagtacccagcagacaataactggattgcaatttgcaggagagcttagtgcgaaagacggaaagactgacaatagtgtaagataacagatatttatgcagggggcagtgaaatgcattaatgcatgattctggtgaggaaaaagtgagtaattcaaagttggtgtaagcgagtcttgtgggatgactatgtcatccaggagaatacatcattctagtgacctagtctagtctctagttgaaactgccgtctcttgattttgactgtccgatcctgggctagctaaagttaaatccttttgtcagttgtctcttgtcagtgaatggccatggcactggcttgcttgtcacctgcttacgtggtggtggtcaaaggggtttattgggccctttgtcagtcaaagcttggctggcctatcgaggcccaagtaaagcacatattaactctccatatgccatatggattttccctttttactactattattatgttaataaccctgacctcctctagtcctatagtaaaatggaagaaaataacttgagatagagaggtgtataatagtacaatatcaagatttcagcagaaaatatactcacctcaccaaactagttgaaaataatgatgtaaacagattgcactgcaagcctgaagaccataaatgtgcgtccagctggaaatggtaagaggagagttcagttcagttgcattcactgttcagttcaattcagctggaactgtgcgtccaaactagttaaaatgtcaattggagggtgaaaaggcattattacctctggtatttctccagatattctgtaactgaaccaacttttgagtaatatatgttcagaccggtgaaattgcctgccacactctgtttcacaggattgcaagtcttcttcctttgcgaaagggtccatcagcatcaattataaaatgaactgtacatactagtgacacaattaactattctgaatcatagactaccaaccggtcatgctttgtaattggaccaagtattgggattcttctgaacacttttaatggcatacctgtcttccatatgcattgaaattgttctatttggcaccttatgttggcttggcatgcccacctccacacagacccaccaacagacacaaaaaatgacttggtctcctccttgctgcattgttctgttttctgtttcagcacatgatgaagtcagaatatattattacatatatgcatgtgttgtcttctctcaattcaaaatctcctaaacatatagagtagtttgaactaccatagagatggtacaaatgtcaaactgacaatttctgtaaaaaaaatgcgtgctggatgcaaacaacccaaacaaaaaaagaagtgcatgggaatgtgaagtacagaaatttgagtgagatatgaaattttttcatcactttcaataacgatacatgcatgcaaattcaaataaatatgacatatccaaatttccaatgatgaaactgtacattatattaccagagaatgaacatcatgttatcatcatttacaaacataagttttgagttagaccaacagcagcagcatatgtagcacacatttcatatcaatacactcctaatgacttagaaatcaactccgtatgagttacttttctctgctagaatattacatttccattcatttaattatccgtgttttcttgaccagtccctgttacatgatctaaaatttcaggcgcagtagaggaggtgctaattgtgcttccttctctttctgaatccaatcgaggattgagccctgcagctggacaggcgcatgtgcagaccaaaggttgaggaagtcagagattgcatttgtacgatgctgtgttttatgaccctgctgttgcaacagcttcgctttcctagatcctcgaatggttctctggtgctccgagtgttcatggttgccttcataacctgaagatatgcaccaccatgtttagacttccaaagcatctgatacaatttcgcttctgcattctcatgaaaacaatctactgcccttggcagcatgatctcttccattagttccaaggcaatgtttgtgtgcaagcaatgttgcttatcaccattaattacctctattacagaactcttgatttctgggagtaggtcttgtgatgagccatggggtgtgtagacaaggtcaactttcatatgcgggcattttttaagagaaggcttgcctttgacaattgttccctgttctctgaactcaggaactgggacatggcactgcaaactcacttcaataactggtcctagagaaacaccctgtacagatggcattcctagattgctactttcacagctgtggttctgaccatgctgcttgcagcataatgggttagggcgaaaccattgggtagtaatgctgtgaatattatcccagtgttttttgtggcatgattcagcatatggcacccaggtgaaatcttgtgaaggtagctgagtaagttcattcctaacagattcagctgtagacatgaaatggggattaaacagctgcaagcacttgattacaatgccaagtatgtccacactctctgaaacttgtagcagcatacacaggaaaaaatcatcctccagtgcactagcatttttactgtcaaagatcagcctagcctctattctattctctgaaatacagaagggccgtatgacaaacaaccggtacttattttcagacactaatttatactctagtgttttgcctgcaagaagttgcctgataagaggatcaaagaacaagtactgatgtggtgttcctccaaactccacaaatctcaaaaactcattagctccatctgcaaaccactcaaatcttcgaacagcagatctacatgagccatcgatattgctgtaaaataaggaggacactaatgacttggtggcatgggctattcgtctaggaatagaggaattccttacttcttgttctgcctcttcttgttccaggatgcgttgccggcatttgcgcagtgtgtcatcgcactcttgagcagcacgcttcagcttcttctgccaacacagtaatgaagaatcagtgattcgccacttacaggatgtctcaagtgcagcctccaacctgatgtgtgccatctcaagcctctccatgttctcctctgcgcttgattttcgctcattccagttcaccaagccatgtatgatttggttgactgcctcatgaacaaccacagaactaacaatctctgccattaggactcgatcacatatcactatgcccaatgtaataaagggacagatcagtgattcctgatctgtaatgaattgctctgattatagtagaactacttcagcctgctgagtttgaattggtagaaaagaacctgggatggaaggtattgccaaagagcacatgaagtggcactgtggcagtataagaatctacccagcaggctgagaccagattgcctgaatggcgagctcacaattctgtaatatatactgatatttggaagggacagaagaaagtgatcagattattgtggaattaatgaaatgttcaagtgggcctcttcggccctccgctgatggctcaaaaaagaagaagaaaaaactattgtggataggaatggattgtgatacccaggacttttgagggttaatgggtcaaaagtggttagcgagtcctgcactcagttggttttgttatattctcaaggagaagaaaatggccaaatggggaccatttgctacaacaatctcttgcgatgaggtgactggtctttgtcatttggttaattcttcaatgacccttgtcaaactctggtcattgtttaatcatttagggagaagaacggaataatatctagtccgatgcctggcatcacgttttcctcgtacacgaaagtgaaatcagtttccctttcataatgggatgtccttttctacagcataaaaccgattagacggtagtatcttatcactattgcagaaaatgtgaaagcaaacgtaagtaacttctaaagttgttgacgatgcaactacctataaagcacatccatggtggaaattaaattgacccctagctaattttactcccttagtatgaacagatggtagaaaaatcaaattgatccctcgctaattttactccctagtgtgaaagatggtagcatcattcgagcaggcggtgaaaaatcttctccatcatctgacgggacgccggcggtaacaacagtaaaccaaccggagatgcgagtgaaccgagcgtgcatacctcgagcgctcgccgcggcggtagtcggtgggtgcgcttgtgcttgcgcctcctcatctccgtcgcgccggggcgcagctagcttccccctccatgctccgcctcctacctccccgtgccgccatgcgcgcggcggctgcggcggcggcgccgccgctcgccgccagcgctctcggtcaccgcggcagtggactgggccgaaagcaacagcttgaaagcctcatttggctaggccgaaatgacagcccgcttacatagattaatacacgtgggtgggccagaattgaggcccatccaaataaggcccaagagataaatattgctcatctatttcagcaatgagatagtaatgccgattttgttatatatttgtcgacgtttttttctaaaaattatattgaaattacaatgaaattttttctgtcaacaaattttgctatatataaattacaatgtaattatattgagattgtactatatttacatttgtcaaacttttagtacaatctcaatgtaatttcattgtaattacatgtaactatcatgtaattttgaaccattcgatttgctttaaaattcgtgtatgaaaaaataactaactgtgacagaaaaaaaataagaactgaacaatagctagcagatgtaaaacatgtacatttgcattgaacatacaggaaattaattaacatagactggcttgtcaagagtcaagactaagatgggccttggctaaacctaaacacactggctcgtactagtacaatattatacatcttttaatttgaaggggaacatcttcagtaagcatatacataatacatgattaaactgtccgcccctaccaaaacttacactagttatgtcttgtctttgatactctcctggccttggatctgcaactagaattggttttgcagctccggatgcgcggcttcatcagacaaaggtatccataaccatgaactgaatgaaaagacagtgaataaaaccccaagtcaggttgacagacgaagcaatccattaccttgggcactaacactgccatctcctgcatttcgtgcagactagcatacatacacttatcagttgctccccgactactgtaactcccccgattggcttcagggtgcgagaaatgaggcgaaatattgatcaccatcttcaggatagaccaatccctcacaatattgcttgagttgtacaagtaattgtactcaacagccgaaatgtagctgctgcagcgcacatagataacttgttctggaatatcatatggtaaattgggcgagatggtgttgtcagcacaaggatcgagcctcttttctctgcaacaaaatggatcagggcgagcaactgtagctcgaaaggcaagaaagctccgatggtagtccacggcctgaagtgctagcagtggttcgaggtcttgaggatgtgagtgttgtagagcagcaagttgaccaattgcatctttagccaaacgcgtgaaatgaggcccaagtaactgcaagcaattgatgataatcctaactatgtccgtgctctctgagagtcgtagtatcagcaacagacaaaaatttttcagtggcattctgctatcctccttatttaactgtatcaatgcctctacgccacgcccttcaagagatacaggtactattgtaataccaagggttttgcttccttgcaatggcatgtcatacttgagatgtttcccttctagaagtggtctgatgagagagctaaaaaagttgtagtgccaaagtgtacggccagtctccacatccctcgcaaacttaccagccttctttgcaaaccattcgaatctgcgaacatgggagcaactcaaaagatattgcttgttcatgccaaggaaagacaagacatatgatttcatggcttttacggcttggacaaactgcttgggaaaatagctgtgtgttaccccttgctcttcagcaacttccaaaatccgcaccttgcatttctccaccacttcactgcactcctcataggcacgtttgaacatcctcctctgacgaagcaaggaaacatctgtgatgggtagctttgaagatctctctagggcgtgctccaattgagcgtgtgccatctccaacttctccaagttgtgcctctcggacaccttctcccggttgctggacaagtaggagacggctccgcccaaaacctcttggacaacagttgaggccaccatttctgccatgaggactgtttctacagaaaaaaaaaagaaaaaagggagcattttgacagaagacataaagtgaaagtgattaggttgcagagagagctcgaaatggggcaccatattcgcttaagggacgtagaaattatcacattaattgaagaaaaaaaaagtaaagatattggccatttgatcgtgataggtccaaattataatgatatagattgatcgatatagttgtatataaaaaatacagccatgtctatataaatagtagaaagtaagagttgtctatcaagtatcaaatccaattctaatgttagaatctgttatatacaaattacaattgaatctaagaaacttaagctaagaattgttactaaacctgatcctacttttgaaatctaggtctgctcaaaattgcgcagggaaatcctctaaattatgttacatacatacatacatacatacacacatacaatatgtgcgcgcgtgtgtgtgaagctgtttttaagaagttaaggacaaagtgatttatatttaaaaattataagatttaaaaggaaaccaatttcgggctctcaatttagtggtatcctattaatttaatgaaattaaaaattgacaattagcaaattgtaattgatgtctattcttctttcaatctaagcttataattcactcccactagacggatgaatggatagaaggtgagtgagaaaggaggaactattactagatatgtagtggcagcaatttattcactgcttttcctattaagatattttcttgaagtacccagttagtataagtataggtagatggtatgcataataaaattctcacctttgcctcttaggctcttactaaagaaccgagatactagccactgatcccaactctgagaagatttggaagctggccaggtcacatgcagagaattggcctagtggcgtactggtgttattgatttgtattgatggacctggacaaaccatgcatgtaggacagtaggagtaagcagctgtcttacaaatgaactaactgtctatatatgaagaagtagagcagattgagattattgtaatattactaaaccttaataatataatgagtattcaaaaaagtaatattactgaagttgaacatatgaaagacagaaagagacatgaaaagtttccacgaaggaggaggaaagttcctaattaagatgtcacattcacccgcaaaaccgtaggaagttgcaaacgagggtagatttacattagcatgggtttgtctaatctgtgtttatctacttaagcgcgtcatttagccaaaaattctgtaatcaactatgccatttccgcatttcgtttccaagataggagtaatcaatacttgaatcgttctcccaaaaagaaaataaaacaatccaatccttatcatgctcgctggcggaggctactcagtcatcgacaacaaatcttgaattcttaagatcatcacccaccctaccacttcttttatctggtgtttgttgttacctaatgatgatgggatcatgtgacagaaggtgccttagttccctgcaatttacgatcatatagataaataggataagaccctatagataaatgatctcaattaacgcgaaactacgctataa

SEQ ID NO: 64307 - DNA, 1516 bp, Oryza sativa
  unsure (1)..(1516): unsure at all n locations
tctcccgagtaatcctctcactagggttcgcgattgttactgctgcgctctattgcccttcccttccgtgatttttttgggatttttttaggtaagtaaggcgattcgaggatgggaagaggaagaggaggaagaggaggaggaggacgacgacgaagggtgcgaattggatcaggtattgcctccgatagcctttttttggtcagtttgattgttgaactgctgtaggtttagtcgaaattatgcgactgactgagcatttgctttatattggggttgaggaattagaacgtaatgataaaatctattattagcacatggctttaaccctgtagtgtaaggtatcatcacggagcagagagggagtggtttgggattgtgatgatgatgtagaatggcttgtgaaatgtctttatggcatcaaattacttagttcatgtagtaactgatttctgttttgtgagggaatttgtttgattctgtcactcaggttccaagtattacattcatttgtttcttaccctttttctttaggagattatttcatgttccgcggaagttcacagttgcagtttaccagctaaccagcattttgatgatggatttagctgcctggccaatattatctccatattggtaagaatatttcatatacagctttgttgcgtcagccatcaactttccaatcatagtcagcgggatcctcatatggtcccagttcctcataaccacctgttacagtattaaatatgaagtgcacaatattacccttcgtccctgccattgagcaatggctctttagactaaatacatctggcactttttatgctactatgaaccaataagtaattgttggggtctttgggaagcgaagggttctgggtgctagtgcctgactgcctgagtcattcattgtttatatagcaacacaaagacaatgagcaacactggattagtcttcattttcattaaccttaatcttttacatttgttcaggcatattggcatcaggatatataagtagggcataggcgttatcccgatcacctgtgggtctctatcaacaactttgaatcatgtcatttgatccgtaagtagtgttaatgtgtcatccactcttaccaatagaaaagggaggcatgaaaaaataacaacaaaattaaccagaggaagttgttgaaactgtggctccacaaaaattttaaactacgtatactgcttcagaattagatattattgacaattgtggtgactgtatactgttttattacatttcgtaccctcatgctttttttcttcaacagcttactttgttagtatatgacatcatccttttcaggttggcttctttggtttctgtagcagttatgttaaacactcagctgggaatatcctgattgtcatctctgactctctaatgaagtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64308 - DNA, 1016 bp, Oryza sativa
ccgctccaggatctccgcctgcgtcgccgcggccggagccagggagccgccggagggcgagggcgagggcggggaggcggtaatgcggctgtgcgatggggaggagggggaggaggaggaggaggtggagagcctggtcggtatcagcaacgcgctcgagtcgctcgagcggcagctcgcctctctgcaggtcattctcatctcatatctattcttggtgtttcgttccatgtgtaaatatgctaatcctcattttctagtagagattgaggcttgcattgaagattgtgggttagtaattttgtactgcattattacttttcattatataatatactccgaatgatgcaaatctataataatcgcatagtagaaggtttatgagaggggaaaagatagataggtatcaatgccatacttgcaaataagggcattttgaagtttgaaatgattaaaaacaaatgatattatcataggaacagggtatgactggagtgactgtgcaaggtgtgcagagcgaacgaagttgctgtccattagttaagctcatataccaaacctgccatttcttagctaggaatttctctgctttcgggggagaagggtgcttctggtaagaggtgtgatgagttgttgggatgcagattttcacttttagttataaccaaatggccaaatttaactgtaaaacttgtgaatcctgtttacttgctttgctgcactaggttggtatttaactatttaagatgcatcccttactattgcttgtgttagtgaatttcctaagaactaggattggcttccattgcattatccccatgagtttgtttagttctgttatttatttccatctgagtttaagtttaaataagtcttcttctatcacattgattgttaggacttgaatgtgttctattacaatctacattgccattttcattgctaaatattttgctttctacttcctctgtttcacaatgtaagtcattctagcatttcccatattcatattgatg

SEQ ID NO: 64309 - DNA, 2007 bp, Oryza sativa
attcctgcagccctctagtttttttttattggtatgtatgagatggataaaaaataaacttattttggagatagtactttgataaattttggactttctaacgtcacatagagtgttgtacccaagaaaaaaaaagtcaattttattaacccaaaatcgcaacaaaaacaattccaaatttccagaaaagtttggaagtccaactcccaaaactgcaaaatactgttcgaaaacagtagaaaatactgttcaaaatttctatttatatattactactatagtagctgtagcaatcaatctcgttcgttcgctaccaatcggacggttaaaaatatcacaaagttgaagtactgtgcgcctctgacggttttgtcaccatcagaggatctcattccacaggtgcgagcatggtgatgcgcggtgtgtagccatgtgcgcaagttgtcgtcatggtatgtatgtgctaggtagcatttatggataacatattgaaaattttggtattaatagtgtcgtctctacagctgtgcaaaaaggaatgtccagtaaaaagttaaataccacgatggaaaattaaacactatcggagtgaaactcccaaattcaccaaaagtataggactccacctcccaatcaaaacccttcgtcaatatctccccgcctctcaactcctcaaaattgaaattttaatttacactacaacagtcacccacatctcaatcgggtggcaaccctcatctgtgtcgggtatgacgcccgtcacgacgtaaaggtcactgatgtgagactctatcgaggataaggctgtcacagataaagttatctttgtcgggcctaaactaaagtccgtcaccgataggtttcacctagacgaccagtcaaacaaaacccgtcaccgatgacctaatctcaatggaccacaattaatgcccatcacggatgactacaatcccaattgggcttaaactaaaggccgtcacagatgcctcaactcaatcgggttttaacttatgcccatcacagaggaggtcatccctattgggtttaagttaaagcccatcatcgatgagtatttccccaaagaaaaattaattctgtttttttgctagcctcagacctttgctagtcatgctcactgtaaaatgacagaaacaaatatatttcacaatatcccatgatccgtgacaggctcgatttttatgcacatctagcatgtatgtgcgagtatatctttgtcggtctcttttttcggcccgtttaagatgacttcgttgtgacggcccacaaaaccctggcatgtgaggggcatcacagatgagaggatctgtactaataacaagtcttgaaccaaatatttaattcctctctttttccttcaaagaatttttccttaaaaattttctaattgcaaatacgtccggaaatccttcattgaactcctagttttcacgttttcaaaaacatcaaattggtatttaaacctcagcataagtactcaaaatccgttcaaacaatttctctctctctcattcacgccttggcccggcctgctattttcccttttcattttcctttggaataagttcacttgaggtcccttagcttgtcaacgaatccaattttcatccttcaaccataagaccagttataatggatccctcaaccattaaagccggtgcaaactagattcctcggcggttttgatggtggttttggctgacgtggtgcatacgtggccggtttgacttggtcctcgtcctacgtggctggtttgacttggtcctcatcctacgtggccggtttgacttggtcctcgtcctacgtgacagtgatgtggcactagaaccaaaaattaaaaatttggaaaatatggggcccacatgtaggtcccacccttctctctatccaaggaggacggcatgtcgacgcctccttctcctctcttcctccgtcccgaaaatcctccatttctccttgagctccctcgccgactgatgagggcacgtg

SEQ ID NO: 64310 - DNA, 2272 bp, Oryza sativa
gagcccccacccatggcgcttaggcatcgccgacctccctacgtcctccctcctcacccacctcgctagtcgccgcgcgccgctccctcctttaccgccgggcgctgcacgccgccatcttcccatggcatctggaaagaggagagggagagagatgaagagagggagatggggagagaggaggaagaagaagggagggtgacaataacatgtggggcccacgtgggctccaccatttttaaattaatttattttgtgtaactgacatgtggacccgatagtttttattactttccaaattaaattgccacgtaagcgccacgtcaatgtcacgtgtgatgaagaccgagtcaaattagccatgtatgggccacatcagcaaaaaccgctgtctaaactgacttgggacttattttgcaccggttttgatggttgaacgatgaaaatcggattcgtcaacaagttaagggacctcagatgaacttattccttttccttttcttatgcgtggtccggcccaattcttcttactcccgcgcacaggccggcctgctcaaccattcctcttcttttcccgtgaaatactggcccagctagttagcaaaatgttcactcagctcagctagttgtccttgtatcaatttttgtaataatgttgcttcgactcctacacaaatatatgcacaattacatatcattaattaaatgtacatatatatatatatatatatatatatatatatatatatataccactatctctttttttatcgatcatgtccacatatatccgtgcggttaaattttattaacttaattcagggcacaattgtaaaaagatataatatcaaaatatcacactagtaaatttatataacgaaaaatactttcaaactattacagtcatggaagtacgaaatcaggaaaaagctcgcaattattccagagagtgtaccggccttttcttttcgtgagacgtgaatggatggagaacaataattagcctataatatacaccacgtggcagctttttatgaaaaaaagcactatgtgtggaggtacgtacatgaacaaaaaggttcattccgttgctacgtgccaaccgtttagaccaatcataaactacgtcattttcttaattaatgaacctggaaagcatcagtgtttgaatacatactacatgctaacttcgtcccaaaataagtgcagcaatagatatccgtgtccagcgttttgaccgtccgtcttatttgtaaattttatgaaaaaaataaaaaatactagtcacacacaaagtactattcatgtattatcatctaataacaataaaaatactaattataattatttctcaaataagaagaacggtcaaacattgtacatgaacagtgttaaaactacacttattttggaacggaggtagtagaaatcctgcacatataactatataaggattcaaaagtgacggttttaataattcgtaggttctgaggcctgtttaattattattttagttatatatatttttacatagtattacaaaataaaatatttatttttacttcgttgcaccaacacataattaattaatctgaagacaaagcaacacgcacatgacccacctgattaacacagctcattaataagagatcatgtgtgcatgagtatttcacaattgatagaagagatatttatcgattacatttttattaattttgacatacattacaagtacaaggaactaattaggaataatagatacccattgaccgatacaaatgaatacaacagaagcggaaaccaacaccagagaaacacatgcacatacattacacatagcttcccccgtctctagttgcatggcatgcaagaaagatatataataccatcaccatcccaaaatataataagttttagataggatatacggatatattacgaaagttacaggaataaaatgaaaaaaaaaggcagttgggattgattgataagaggagaaatatatatgtaagaaatttaattaatggaaggttacgattgttttataagagaatataggtgaagaagttgctatattttgagataaattttagaggctaaaagtaattatattttgggaaagatgagtaataataattaagttaattaattggtggtagcttgtctcctccaagtttgccctggagttcatattaaagtgtacgtggcacgtggtactgcacacgtgcatggcccatgcaagcacgcgttgaccggccggggaccctacacg

SEQ ID NO: 64311 - DNA, 4614 bp, Oryza sativa
attcctgcagccccaggatgttgggaagctgcaaaaattcacacaattttagcttaattacaattcatgtggtcacacacataaatttgaattgagcagtttgtgatttgaagaaataattaggtaattgattgaataattaccgcgacgtatttgtccttgatgagaaggccgtagaggaaccagacgacggcgctgagggtgagcgtgagggagagggagaagggcatgtactccacgctcctcgactggatcactcgcttctgcaatatcgcatccatcgtccatggaagcagttcagttagcaacgagatcgatcgatcaaaccaagacacgaagtaaagatgagctagctagagattgacgacgactgatcgtatatatgcacatacgatgatgctgagcggcgcgacaaagacgctgacggagaaggcgacgcagacccagccgagggagacgacgcgctgctcgccatgggagagcagcagcgtcagcagcaggatcaccccgaacacccccacgttcagcagcagcaggatcttcgtcgtgaacacctgcaaaaacgacgtcgaaccatatatacttgtcaattattatattttactactacaaaacggtaaatatggaacaatcttatataggtgccggttcttgttcacaaccgatgacacctgtaaggggcctctcatcggtgccggttgcgactcgagaatcaaagggtggttcccaagtccccaccggcatcgaaatagggtttctgtggtagtgctagggtttggatgacatggatcgaaccttggccttcttgggggcgtaggcgaggtacatgacgatgtagatggtctcgatgacgcaaccggcggcgttgatggtgatgaggagggcctcgttggacttgatcagcgcgtagaagatccacagcatggcgctgaagagcgccaccacgtacggcaccgactggaacccctccgtcgacttgctcttgtagatccggtagaacgtcgggctgcataaaatattatgcacatatattatcggatacggaacgcggtgcggattgggaattaaaattacacaaaagctatatatgtatatatcatgtagaaattcagttacttacattggtgccagataggtcgtgaaggatatgaggttgcctgcaaagccaaaggaacagaaacaagatcaggattttgtaaaggaaaaaaggcaaagtaatgcgagtaaagagccccatggaggcagctaaggtagcgaccagacgtgataagttgtgatagatagacacgtttacaaactttatgtctagcccttgccttcctttgcaacaaagattgtgccttggcttttaacttgttctttaaattattgtgttacatggtgcactatgatgtcattaattagagtactatatagcttgacctattaattccactctctctccatggcaacataaatatatagaggttgcaccaaaggatcgaatgtttgctccacaagtaggatatacatacaaatgatgaggacttgctgtatatatatagtttaacaagaagcagaaaaattatatggctatgtgcatctcattaagtatgcttaggcccttgtagtttatatgcttgtggattttaagcctgcaattttaagggtggcgccgcgcgtataattctaatagacaaaagccaaaagaaataaaaaaaatcaaatctagcttttggcttattactacaagagtaccatccatattgccttcggaaggctagtagggtttttagcttatgcgctagtagctaattaatatgcccaaatagacataataaactgctgtaaataaaagtgctagaagaaattctttttgttgaaaataactgaaagaagctagctagaaaataaaaaacaaataaagaaacacaacaattttattattttatatatgatgaccactaaagtgtaatcctcactaaatgtcgtcgctagctatgcgtatctgccagcaagtaataactctgagcttatatgtacaaactcaatggtttctaataaaaagaagtaaaatgttggcaatgaagggaatgtcttagttgtggtaggtgatgatgatataccaaggaggccgaaggcaaaagcccagggatgctgcagggacaggccagccatttttgtgtgctaaaaggggggtaattgaagggaagagatgtagtgtaatatggaagcaaacaagcaaggaattgagcttgttgttgctagcttggaacttgtcacagacacacacactctaaccctagaccccctttgtggagggaagggagagctctgaagaagagttcaatgtgttggctgaaaactcttggagaggaatgaagggagttgtggtgctttatataggagcaaagctagctaggtgggaatcacttggttgcctcctacccatggccattcacgtacgcatcaaagtaatcatagaataattatgcaaagattttttttctttatttgcttttgaggaaagtcttttggacacgcacaataattaggcttttacaaaaatgagctactgttggagataatcctggctaattttcaaaaaaagttgcattggctttgtgcgcagcgcacctctcactagccatagccaatttagtgagtaattgctttgtgcattgtcagtagagatcgatctctccaacgtctgcagcttcctgctgggaacggtaaaagatagccgccgagtgcaacagcaaatcacatgagatctctcccagtgaaggattattcctgaatcctgatacggcttttgacttaaattttactactcgaaaaatattaatcgcggagaaaaagataattgtacttagacaaaagaaaggtagaattctctgccttgtttctatatattaattagaaccgttttgtaacatgatcttgcaattattgggtgatagatacatgtaggtatactatagtttctctgttctttgtttgcacgggtagattaattctcaatgtcgccgacagtgttctgaaaaaaaaataatgattgtaattgaatatgcaattctcccatgcgcgtgatatagctgcttattatttaactgtctttaccaaaagtaacttattttttgtcgaaggattgttttcacctgcagtagacatccctgtcgactaagctttcatacacagtttgttgggaagagaggtcgatttctgcttctgcgaagcgcgttgatcttgttctactcccacgtatatgaagctaagctagtggatctgctttttttttctctctacttttttctgtgcgcgcggctgcttgcctttccaatcaacctataagcatagcacaatatatatacgcaatcaatctgcatatatataagcatacttaatttcgaaatatatatgatacatacatatatttaaatcctaaatttgatacaggtactcgtatttaattgttcttttaatgataggcacaacatactcgtgtgtagttgtaaacagcgagacgtccgtggtaatttcgtcaatctcaaaatatgtcggctagagtagtgtatgcgtttgtaggggtgggtgtgagcacgctttcatgctgtgttatattttattggcatgcatgatgcatataggttggttagtttggaattaccggtgtctaagtagtggcactgctggaaggaatgacatgcatatgtactgtctgaaataaagtacatctctctgacataaatgattgcgtgatagctagcctctgatcatcatcgtttggagagaccgtgtttgactcctaaacatgattggaggaaaactaaagtgattttgttaaaaataggaagcaaagaacggctagaacgcctatcttttggaaaggttggctcaaccaggtctgaacttggctacctgaacctctgccatacgtttactccctgataatgcatgtctcttgtgcttcattcagctagctagtgtgtttcatatgcgacataaattgggggaataatgggcttgatcgatcggacacaagtgaaaactctctcaatagctttaactatatttagtcgtctcattttctacgaaaagtcataaaattaacttcagaattttttttttgcaaccaatattataacataaaaataatctccagacatagtattgggacagcttattatgttgtcaaaaggattgttttttctacattgtcaaacaatttcagtatttttagagaaaaatatatttcctctacactacataaaaaaaaaatttgtgacgtcacccttttatttttactggcggattaacaaaacaaacgcttctaaaaatgtattggagggttcttggccatgagccactagcgaaaaccgatttttattggcggactaacaaaacaaacgcttctcggctcctcctatctctcctctactttacaactccatctacctccactcccttcagcttctccacctccatcacaccacacgacggagacgatgaccgcggtggcaacggcgacggtgatggcaggctgtgacgatggtgccagcgacaggaggggacaagggcggtgacgatggcaaaccgcggatccaacagcgatggtgcctagatgccatggat

SEQ ID NO: 64312 - DNA, 5145 bp, Oryza sativa
ggggggggctcatccatgacagcgacagacggagtggcggcagcgaccactcctccctctcggcggcggtggaggaaggagaggggggctcggctcagcttgttcgacactgttccggatcttgcggagttaagtcctccctttctcactctacctataacaaatcagcacaacaaccaccgacggcgctactaagatgacaaccagcatgatcacagtcgacacgatgctatttcattttcatatgttgttgttggcatattggaaatggagtgaaaaatcaatgtagtgctatctggatgtggatctgaatatggatttggtttgatttgaatttggatctcaagatgtggtgggtttgaaaatgcagcagcttttgtggatattgattaattttttttgctaaaaagttgttttgctagtggtactcttaccagtatcgcctgcaaaaatcgattttcacagctggtcctcttaagggtctacttgcgaaaattgattttcgcaagcagaccacaacagctaccaaaaaaatcagtcatttttactaaccttttgtcgctggcggttgtgtcagccgctagcgaaaacatattttggccgcctgcaaaaattattatttttaagtagggctagtttatattctcatttatatttgacgatgagagagatatatagttctcaagaacgtcaaatatatatttgaccacatgtagtagcatatataattcggagtaataaatgcattcttgtatactccgtaattggcatggtcctgactcaaaattttttatttgtaacagccataacttcaggaataagttcatttctcagtaatttttcaaggcttagatatacatatgtgcgcccttaatatcaaacggttgtgtggtgtttttttaagtactttggctcatagctagtactggcaaactgatcgtggccaaacacttgcctcgtggagagtaccacatcaactaaaacaaaaaggcgatgtaagaaatttattttgacgagtttctacggtatattccaattgttgatctttggttgatatctatatttgagaaaaaagttgacaatagtaaatttaatagaaatacaagttctgccactgatgagtagtgttaaatatgttatcctaatttcagtatgcaatatggtcgaattagtttcctaatagaatttgactattatgatcagtttcctaatatgaacctatgttttttttcccacgaggattcctagatttctcctttatatattccatgtgagctgcgtaggaaaggcgcgatagcccaatgtatcccctacgtttgtactcaactcctcaatatcattgcctgtcagggtccatggtttttcctgtaagagtttttcacataaaaatttgtatctttgttatgcatctattttttctaacaattagtgagttgcacgaaatattatcatacaaatgatttaggagtttttataggatatttaccggacttttagtatataaagattcatactattacagcacgttttactgcaaatatttttgtcccatggtacattatctgtctttgtggtaccaggatgtacagcaaataaacaaccaaaaagtgcacaacattctagcgtaaccatctatgtactgtaaaccaagacaaaataggtcgtgtatatatctttgaatggtggccaatatttccaggggaaaaaaattgccatccgcaggcaataacagaatcatcgttctgaacatgcaagtggtcaaaagagcatgtatatagaccaattaaaatgcaagaaaactctgtacacgaatggttgagagatcgtcctgcttaatgataaaaaggtcatacataccagtaccaccatcactgagattcactagctagcccggccggcccgttgattataggtgtaatgatgaccaaaaagaattgatctttagaagcaaaagaaatatcgccatttgcctagcagattccaattcgatcaagaggacgtaagctaatttaatttaattatatgttgcttcctgagaagattcttgtggtagtaatgacatgcagctgtgtgcgaatattccagtcacacaagactgaagagtagttgcaaatagttaagggtggtagttcatgcaaaagatctcatctctttatttccagagttcctcaccgttctttcctggtttgcatgcagctgatcaaccgcagaattggtcttcaagtgatcatcaccacccaagcctgcttccatgcccatcgtccatttgataaattatttctttaatgacagaggtaattttcggtgtctatactgaaatttggagtgagtcaataatgaaatgggaagaactttgttgaaaggcatgtaatagtatagatcgtgggacccagattatagtgttagggacggtgtggaaatgaacactaccactactaacattaacattaagtagtacagaaattgtctgaaaaaaacacgtacatattacagtaaggtgtgctaaagcatcatgcgtgcaaacagttcagctaaaatatttcgatcttccatccccagacgcagataattacatttgatgagatgttggattaaatcaagattacatcgttcgagacgcagtcgatttctgctccaccctctcccctccacttccacttcctccaccgagcgggctggtgccgaccctaaccctacccctccatttcctccagcatgcatggtgtgagctactgtaatagatggcctaagcggaacgctagtggtgtataaggggatggtattcatgactaggcacactactaccaaaacaattttctgtacaagtatccctgtaggttccagacggactggtcacgcctacaaaaatcgacctccatccctatcccgcaggagcgagtggcaggcggcgccaccagcactgacgatggcgaggaagcagccgggaatggctgcatccctatcctcgcccgtcaccgccgcctccaacaacgacgagaaggtggctggcctggagtagcgccgacgatgatggtgatgaggtggcagggagtggctccatccctgtctcaccggggtcgccgccaacaaccaggtgacccaatccgccggcggtggctccgtgaccgctggatctacgcctccgtcaccatcggggagctagggtgcggacaacataagcacctgcatgcgaaaatcgaatttgaaaacattcaggtcaaatttaaaaacttttaactcatatttgaaaattttcaagtcaatatttggaaacttccaactcagatttaaagttttaaaattttgagttaaaagttttcaaattaagtttcgaaattgaggtgaaaagtttcaaattttaacttgaaagttttcaaaatccgagttaaaacatttcaaaacttgaaaagaaagtttcaaaatttgagatgaaaattttaaactttgacctaaaagttttcaagatttgagtttaaatgttttaaattttgacttaaggttttatctttcaattgcaggttttaaatgttaaaattcaaaaccgtcaaaaaaaacacaatatgataatcatacaaattcagtgttaataaaaaatcagttataattatatttttgttgtagcaaaatcccgcgtacagatgtgtcagctttgattccggcgcgtatgcgcggattagttttctcaacatcaacaagtgcagaggcagcagccggatctcgcgatggcatccacgaagcgaggcagcagtaagcagattcaagacagagtcctctacaaggtatcgacgtgcagattccagtgatggtgtccgcaaataagcatgcatattgcaatatatataaactgaattgtcactactacagaccctatttttccgtatgcttgaatcgattatcccgtgcggtggctcggcccacctacagcgtctcgtctgggaaaatcagtattttcgcgtgtggtgcagtaaggaggaccgcacgggataatcccgtgtggtgcagtaaggaggactgcacgggataatagattataccccacggctaggatgtgctagggcgaccgcacgggataattcgtgccatcgccctagcacatgctagctgtccgggacaacctattatcccgtgcggtaggtataatttgaccgcacgggataatagatgcaaaattagacgaaattagtcgagctcaattataaacatcaaattacatagaatgtatagcatttgtaatattacaagtttcccccgcgacagatccttttagtccatagcatgtttcctctcccactcccttaggttcttgaatttggggtccgtaacaagttcgctatgaggatcgtggaactctcctagatggttatagatgtcgcaatgaatgaataggcacaagtctgagcatgcaagagtatgaactggttcaccacatctcctagaagttcaatcccctctggtgttgggatgtcaagcaccaatgacatctgattgccattaacccttgccacctggacccttgcgtagtccgccagaactgggctatcatagaactgtctccctcttatgaaatgccgaaattcatggcaacggtcgggctggcggcttatatagcccccgaccaacgcaagcggtcggcttacgtgggccgcacgggataatgcattatcctgtgcagcccatagcccggcgccggtcttcgccttgttccaggcggagccacttacggcccgcctagaagctaccggggctggtgtccaggaaaatctcgcgtgtagtagtgtgtctaccactttcttttatattcggttaaactggttgatacatacaactcaatatagtattagagtgagtggcctcgattttgaatcttcgctagcaccaattaaatgaaagtttccaatccacttctattgcacaattgaggtcagggagactcgcgtgaggagtaagactaacggggtatttggcagagatggttgctgttgtacagccatagcagctgcagcatgtgcaacaaaatttgtgctgcttgcaccgaagctatagctaggcacagccggctataacttcggtaaagagctaaccctaaaagagtgagttcttcatctttactgatcaatttaagcttaagcttatatgttaaactaa

SEQ ID NO: 64313 - DNA, 1198 bp, Oryza sativa
accagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgtccacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactctttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtggggctgcagga

SEQ ID NO: 64314 - DNA, 2068 bp, Oryza sativa
aaaattaattttcataggtgggtctcttaacatacccgcatgaaaaaatgagcctatttttacaaacggcgtacctaccaccagctcaccaccaccctaaaatatcaaatttcctctctccactcctcactctctccccactcctcccttatcctctcctctcttctcatctcctctcctctcttcctacgacgtatggctccgacagtccacggcgggagcgacagcggactaggcgggaggagctcgaagggggaggtgcatgtcgacggcgacaacggtgggccctcctccactctcctctgatagcggttgccctccctcgtgcgaatctgcaggttgcagaggggcagtggaggcgtagggaggggcgacggcgatgagctgcggggactcagcgacgacgatgtcgacaattggtggcggattttggcaaccacgttgccggcaaaaaacccatgcacattcttcgctggcgtatgagctagggtttcgagttttgatttttttgggggcatttttatttttttttcagatttttatttttatagatagacggcataagcacccgcatgcgtatgcgagtgcgcctacatggaaaaatagcaattttcgcagatactttcgaacatcggacggttcaaccgcaaacaaaaataggttttgaccgtataaaaattgattttcgtagtagtgtactgtgccaaaggagggtgagcctgcagtggcagtggcggtgactgagggggaacagggtactatgggtgagaggagtggggaaattaagcccttaatgagttgacggttcaaccggtcaaccaatttaatatggtccttgatgtatcttttgctggttcagaataaaaactagcagtaatgtgtatctcgctgccgacctttattgatcgagaactagcagcaattaacatcggtttaattagacggtgcagtgatgatgcttctacaggaaccacaagtgatttgatttggcggtatacatcttttattcattttgtatatatactagctagtgatatgagactattaaatgtatacaactgtcagcaagcactggggaattaaaaggaaacaaactgttcctggctaactcgatcaagcgtgtcactcgtttcaacaagcttcaaaatttcctattcccgttcgattatatttgttcccttccttcgatccggtgacgacgacgacgacgacgacggacaacgacacccccagatgagacggtcaaaacggggcaacccaaccccaggccgtgccatgccggccgggggccggagacagcttcgctttcgttgaatttttcagcccccggtcgccgccccaaaacaaatcacacacacacaaaaataactctatctaaggcatctagctctagtagctagctacccctatcatcatcatcttcttcttcctctcgatcgccatcacctcccggttgcgtacgcgaccggcgacccgtctcccggccggtgtcgtgagctgaccctctaagcaaccaagctaccgacgacatcgtacaaacgaacgaaagaacgagcgagcgaacgaacaatcttctttcccatcatcggccggccggccaatcagccagccacatgtctggcccgactggccggccgaccgacctgccacggttttattattattcagctcgatcacgacggcgatttgctcgtcgccgcctcgatcgagctcgctataactgctccaacatcgcaagcaactgacgccgatcgatcgatcgacctggtcggctacggctagctgcagcggcggcgtccttccatcgttttcgatctcttagctcgatcttaattttgatgttaatttaatttaatatgcatatgcatgtgtcattaagtgatgtgggtacatgttgggggatgtggatgaataattaaggagtatgtgaagtgtgtgtgtgtgcgtgtatgtatggacagaatcacttgccatttgctgcaagtaacctagctcgatgattttggttggttggttcatgtgctgttttgctgcgtcgtcggccgtgggccatgcacacatgtacact

SEQ ID NO: 64315 - DNA, 1694 bp, Oryza sativa
attcctgcagcccaaaggacattttactagctagtcaagtaaattaagggtgtgtttggttgggtggatgggactggatgggagatggccgcctgattttttggggtgtttggttggaggacggggtggatatggcggcccagaataaggaatattctctcaatatgctggatgaagggatccggttcttttggccggatgaagccatccaccttctataggacgctgattagtgcttgattagtgagtttattagagtatgattaacggtattagcatgttttgctattaattagtagttagcatggcaagattagtgtcaacaagtgttaattccaacctgtaagtgtataactaagtaatattatgccaattaagatattataattagttaattaatctcatccgatgcatcctcatcctgtcaaccaaacaaaaagttggctcatcccatccatacaaccaaacacaaaacttgtatatcctcatccttaaaaacatggatggacatatcccatccaaccttgcccttcaaccaaacataccctaaaacgaacagaggtagtcaagcggcctttgcgaaacagaaatagttctgaagtgttttcagcatcagagttaaacaaacgcatgggccaaatcgcaaatggggacgaccgtctagatgaaatccagatagaattaagcttgattccatttcgaaactcggccggtcgtaccacggagaatcaatcttgcaagctagctagtttgaaaacaaatacagattaattaaattagacctataatcatctgtagctagctagatgctcgatcgattgagtgtcgcaaaacgcaatatcagaaaaaggggcaccttttacacacacgcaccctgggcttcctttttctttgagcattttaatgatatgaatttcaactttgctcgtcaacgttccaccaaaacgacacgttgctgtcagccttttcgcgacctttctcccttctcgcggtaacgtgcgccgcggtgctttgacaaaaacaccatatatttttatataagtatatatatatatatgcatatctatctctgtatacatattatatatattcacttccattacacacatagaacctatatatttattcatatataccgagacaaacaaaataaacatataaattgctatgtaccgataccaaaaagattttgtctctaactatgcacttggacaaatggtggagccaccgcttcgggaccccagcatgggtctgggcccaatgaatatgaagtggaatttttcatattattatttaaattgaaaataaatagaattttcatgataattagatttgttctggccttgctccggcactacacctgcatgcatagtactaaggtgctgcctagaaaaatatatttttccagacggaaccttaagcggtccgtctgagaagatagatattcctaagtggatggccacagagctcgacattctatgttgcaggaccggtggtggcgaagtttttgtctgcctggaaaaaaggtagtaagtttttcgtctagaaaaatgattttcccagcagtgtgcttgtgcagctgcataagctagaaatgaaatctttcgtggagtaatatatagattgtgagacagagagaccttttcgctattgggatgacggcaaaagcttcgggaggagtggaagccacactg

SEQ ID NO: 64316 - DNA, 3585 bp, Oryza sativa
caacacggcggcatcttccccctcgtcttcttctacctctccacccaacccaatcccatcccatccattggggccaccaccacctcgcacacgttccgtgcaacatgtgattgctttgcttccctgattgatcgacctccctcctctcctcgcggtcaacacaaaatccgtgcaaaatattcccgaccgggacgagctcctcgatcaggggccctccctcccatcacacgcttgaccaccatccctcacacgattgatgtttgtttctaataaaattaaacataaagttaaatcacgtaaaacaaaatcaaaatgttttagcgcaacgcttgaaaaataaatttatttgatatttttagattaacttatgtatagcaagttttcgtatgaaacatattgttttaaaacggaccgaaatttgtgttaacagaaatcaacattttaaaatgtgtatcttaattagaaatgcgcactactcactccttttacatagtaaaatacatgctaacgaaaatcaatctatatcttattagaaatggacgcttcttactcgtcagagtctcctagtcctccaagctaagctgacccatactctaccaccaagttgccctagctactagtagctagtagttagttctcgtttcatttccatttcatttcaccaccaacaattctgctgcatatgcaccatcaacttcaaagtaaattaagctgatcgtttgatctccgtacggctgaaaagcactggaaaaatagattaaataatcggaaataatttattgagagcaaaacttttataaccgtatctagaaaatgctggaaaataaatcacgatgaaaaaatacccctcaaaatcaattttaaaatttaaacttttgtttacggaaaatcaattttaaaatttaaattttttgttatggctgatagggtaacaagtaggcgatgggaggatgttgcctcctgctttccttcatttgtttctccatctccatccatcgtcttcaattcttcggttcttccttgcccaacattccaaccttttttacctttttgttttgtgtgagatggaagtggacccaccagttaattaattgatttattattaatctccattgtcataagtggtggcattgtgaattaatcatgcatgctgatgcccctattgcatccggtttggtggcatatccctagtgattaatctagtcagacgaccgtgttggatgggagattgagagagaaagggagaagactgacccaattggttgtaatcaatccaaagcaattgagaaaaatgggagaagatcagaagattccctttagcttcccatcgcaaatttgccattttcggccggctctcgcaacatgttcaatgatcttatagaaatttatatgaaatcaagatagttatcttttaaaaaattcgaacaaagaatacgagattatcaactcttttgataatgcgcggggtttatgaatatgataaaaatttaggacatgtgaaattgattcttagaattaaaaaacctaggacgtgtcaaactgaatctcccacaaatcacaatttacacatttgcttgggaccaacttaagtcaaactgaattttgtaaaaaaaaaatctaatccaatttaatgcgaatttgcgattgagctcaccgaatttgggacgagcaccgcgggtgcgtgtggcactgtgaaataaaacacaaaacaaaaaacagcagattaaaaatcagatacattagttttaacagatcttgagctacactgaacactcttgagctactctctgtcttgtcctcctgcattttttttttgggggcgatttcgttaagcaaacttacaaacaaagcttaaccctgcctctttcttgctacaatcttgcaaggcttgccttgcctagcttagtcggaggcgtcgccggcggcggcgccgccgttccggctcgtcgtctcctgctccctgcaatgctccgccgacgcatccgtcacgcagctcgacgacaccggcgacgccgcgcggcgccgccgcgcgtcggcgcgggcgaagaagtcgatgaaccggacgcccgccgcggcgtcgtcggcgcgctccgtggtggcgtcgtcgtcgtcggcgtcggcggtggggctggctgtcgacgcggccgcggagcctttcttccggaacacgcggcagagcacccagccctcggcggggcgcgccgggtggtcggcggtggcggcgcggcggcacggggcgaggccggcgccggcgaggcggtactcgtgcatgacccagtccgtcttcttgccggtcggcggcttcccgcggtagaacacgagggagcgcttcatgccgacgacgacggcggcggcctggctcctcggcgccgccgccacggacaccgccaccggcttctccttccccgtcgccttccagtacccggcgcccgtggcgcggttggcgcggcgccccttgacatacttggcctccttgcacgtgaagaagtacctctcctgctcactccaccctgcacgcacgggacctcgtcagcgccggccggccacactccgacgacgccgcgcgacggcggcgagctggctcatgactcacctggaggaagcaggtcggaggggtcatgcgcgaggaggcggacatcggggatgtcgacggcgggcgggagaggggagccgagcgcgcggcggcggaggtagtgcaccacaagctcctcgtcggtgggcctgaacctgaaccccggcggcagcttcttcgccgccgtcgtctccatcgatacacctcggcaaaatcaagaactcaacccaagcagagcaccagatcgccgccgctcgccaccgtcttggcctagccgagctgagcttgtcgcgggtgtgcggggagtaaaggcggggggagaggtggaggagggagacgagagggatttatagcgggaggaggaaggtgttcgacgcggggcggggaggggggagcagtggcgtgaggaagactcaagctcgggagccgagctgagctgagacgacgctgtgtcactgtcacttgcgctgtcgcgttgctctgcggcgcaaggcagcgaccaccacggcaccatggatggttggatggttttaattgtggcgctgccttctacggcgatttggagtgatttttttcatctttggcacggtgaggaagaaacgaaaaagaaaaggaaagaaagaaaaacaaaaagggtgggttgaacttgggggagtgtgtacaagcaagttgttgtgtatctctttggcataagttaagtataagagcaaggctaatagtatagcccgctactggctaatagcccataactaaagccaactactagtacaatagattgtccattagctagctgtatctcataatcaaataattaattataatatacacatatctatgtatgtgatcagtagtaaattgtatccttgtagctatttgtgttgttagatgaactttgttcaccaaacaccaacatcatttcacagatcataccaatcaagttatctgttgtataaaaattactacatacaaagcactagtgtttcgtgggcaagaagagctcacgaggaaggagt

SEQ ID NO: 64317 - DNA, 1705 bp, Oryza sativa
taagatgtggtgaacttttttgcatttttgaagaaattaaaccatctcttgtaaattccatgtatttataagttgcttgatggatccataaacttatttgctctgcgacgcaaggaagcgcccaccacaccatgacagatgattaattgaggcaatgcctctaaggacattagagagattagggagtgatttcttttggcatggtgaggaagaaacaaaaagaaaagaaagaaaatgggtgggttgaacataggggaatatgtgtagttgcaagttgtgtttccatggatcacctctttggcataagttaaaagtaatgagttatgcaaatcttaaaacgtgtggaattgtgtaaggttataatgggttatattgggttgttgtgtgttgtagatatggtggctagagtatttatttctttatttgatggaaaatatggtgccgaaacttgagactgagattcggctttagttttgtgaatgtgcagatttaaaatggtcttccaggtttggttgtttgagagaaaattgttgtacaaacttggtcataaaaaacgatctggcactattgttgagaaatagtgattcatctatttgtgtgaggaatatcaagatatttaaggtctggtgattttttgtaattttaaataaactaggaaggtagcccgcgcgaatgcgcgggcatgaccgtaagtttgagacacttataatagcgaaatattaaccggagaacatctaccacgatttctccgtaaattgtttttgtcagcattaacttcttctataattttctaacctcctgctttatattatatcatatttaagtaatatctataagcaattatttgtaatcttcttcgtcatttgaaaagaaggtaaacttattttctttagaaaatatgtcaatgaaaagtaagtactaaggtattattctttttttaattgaatatatattatcatggttcattcgagaatgaattgggtgggacataaagctccacttaaagtatggatgtatatagcttaatatgactaatgtagtttgagacactaaaacaaaacatcaaatagatgccggcactatataggtgccgaaaatgttaaaaccggcacctatatagattttcccacctctgcggggtgaaaaaaaaagaaaaccagcaccttttataactataggtgccggttctaaataaaaccgacacttatactacaagtgtcgggtttttttaaatgtgatgtaccatgaatacacacttgttttttcttatataagatagatctaacggttagaaataatgtttccaccaatttaaaaggcataggattattccgaaaatgtagcttaaaaattatggttgttttaattccaacattacgaagtgaacatagctcaactggttaggttccttgtggtggaacttgtccactcgggttcatgtcccagatttgacaaattctttcagtggtaggcgatgtggccgttgatagcgaggcgtagtggtaatttcgtcaatctcaaaatatgtcagactagtctcttggaagtactcataggggtagtgtgcacacattgtgagcgcctgcatttgtactttgtttctaaaaaaaatatcaaacaatatttattgtttctcttttaattaaatagataaaacaatagagaaccacagtgttgtgtacatcttagtgtgaggagaaggtgg

SEQ ID NO: 64318 - DNA, 3884 bp, Oryza sativa
  unsure (1)..(3884): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccgatcagtgcaatgggtccttcctccggcatcgacgacctcgtcttcccacccgggcagacgtttcggttcggcagcctcgacttcgtcaccgacaatttcggcaagatttctctccttgacttggaatcggaccagtcgggagagaaccggatctcagtcccgtttggattcccaaacgcggctgaaacctacttcaagaccatctcaatcgagtcggcttcaaaccactcggctgagatcgcatcttctccaacgacaccagatcaagatgatggggcttacccaccagtcctgatgaagctccccgacgatttagcggccgtctccaccacgacagcgtcttcatcccgtaggcctatgcggaagtcggtctcaacaccgatttcgcctagcttcagggaagtcggcgtcatcctccaaccactcggcacggtttcgacggatcagctagatgaccactacagctctcccaccgtcgactcgcgccccaccgacatcgtggagtacgatgagtttagctctcgctaccacgacttcgacgacttcgacgacttcgacggaagcctagatgacaactacacccctctctactttggcgttttcatggccaataatgagacggaggagcaacgccaagcccgggagaccgaagaacgtcgccgactggaagaggagcagcaagcacaagaacaggaacggctacggcgtgagcagcaggaccgtgagcggatcgccaaggaggctgaagatcgacgtcagcgagctttggaagcagggcgccgagcgcgtgatctcatcggccaacaagacgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcggcttcggtcccagttaactccgaaagcgtccacacgccgactggcagccgagtcccccacttccgatctcaggactaccgtcatccaagcctcagcatcaccggtgcaggatccaatcgcaggagcaggggtcacgacgagcggtccgtgcactcgcctcccgactaccgtggggagcgccgagtagaacggccacgttcaccgcctcgtcgccgccccatcgatcttcgcgacacaatcatacagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggctcaccgtctacggtctcgcaatccgcgcagcaggaggagacaacaaggccatggcgaattatttaccagtggctttggcagattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaagaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttacgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagctgaaaccgagcaatgcgccttttcatggagtaattccaggattatccgccactccactcggccagatcacccttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaactgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaaacctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgtcgattacactgaccttaacaaatcttgcccaaaagatcctttcgggttgcctcgcattgaccaggtagttgactcaaccgccggctgcgagcttctcagttttctggattgctactcggggtatcatcagatccgactgaaggaatccgactgcttgaagacttcattcatcacgccttttggggcatactgctacgtcaccatgccgttcggactaaaaaacgcaggagcaacttatcaacgcatgattcagagatgcttctcaacacagatcggccgcaacgttgaagcctatgtggatgatgtagtcgtcaagaccaagcaaaaggatgatttgatctcggatctagaagaaaccttcgcgagcatccgcgctttcaggatgaaattaaaccctgaaaagtgcaccttcggagtaccgtcagggaagctgcttggctttatggtgtctcataggggcatccaagccaacccggaga

SEQ ID NO: 64319 - DNA, 4206 bp, Oryza sativa
ccgtggagaaaatagagcactggaccatgcattttgacgggtcaaaaagactttcgggcactggagctggagtggttttaatttccccgaccggagaaagactaagttatgtactttggatacatttttcggcgtctcacaacgtcgccgagtatgaggcgctccttcatgggctacggattgcaatttccctagggataaagcgtctaattgttcgaggtgattcacagctggttgtcaaccaagttatgaaagagtggtcctgcattgacgacaacatgatggcatatcgacaagaggtacgcaaactggaggataagttcgatggacttgagctcagccatgttcttcgacacaacaatgaagctgccgatagacttgcgaactttggatccaagcgcgaggcagcgccatctgatgttttcgtcgaacacctttattccccgacagtacctcgcaaagatgctactcaagttgcggacactcatgacatagctatggttgaggccgactggcgagagcccctcatacgatttttgacttctcaagaactccctcaagacaaagatgaggccgagcggatttcaaggcggagcaaactttatgttatgcatgaagccgagttatacaagaaaagcccttcaggaattctgcaacgctgcgtatctttagaggaagggagacaattgctgaaggacatacattctgggatatgcggaaaccacgctgcagcgcgcaccattgttggcaaagcttaccggcagggttttttctggcccactgcagtgtccgacgccgacaaaattgtgcgcacatgtgaaggttgccaattttttgccagacaaattcatctaccagctcaagagttgcagactatcccgctatcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacgggccagtcaccttttttccttgtctatggggcagaagcaatgttgccaagtgaagttgaattcgagtctttgcgctttcgaaatttccgtgaagatcgctacgaagaggaccgagtggatgacttgcaccgattggaagaagtccgcgaagcagctttgattcggtcggctcgatacttacaagggttgcggcgctatcataattgcaatgttcgatctcgtgcctttttagtcggcgacctggttttgaggaaaattcaaactacacgagatcggcacaagttatctcctttatgggaggggccatttattatctctgaagtcacccggccaggttcttatcgactcaagcgcgaagacggtactctcgtcgacaactcttggaacattgaacatcttcgtcgtttctacgcttaactttatcattgtatttccctattttgactgtcaaacatcaagttttctccttgaagttgtcagtcgggggctattatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggctggaggtcgttgttgcgaaattgctctacaacatcactcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgctagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggctgagtccctttgcgcagccagttctgtcttgtctctctccagggcttcaatttgcttcgccatctgttccatcctggcggcttgcgctgtttgaaatccagatggttgaggatgcaattatgacagcataaatcaatggaacagatctggatgattaccttttgatgaaccacttagttcgaagtttgcatcctggagctgggcgattcggtcccttaactctttctctgtctttttggcgcattccttggcctcatgcagctggtccctaactgcttctagagttcccaaatgaggaaccagcttttccaaagttgtagtcttggcctcattgcgaagatggattctctgcacgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagatggatacattgaggttatttaaatcgccattgtttgagaagacaactaacctgaagatgtacctagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcagtcggctggttttcagcagtcggctcggggtcctgggatatattttgctctgtcatggcaggatcggggtcttttccagatggatctatatcagatggtttcctgcagagtgttctttcagtatttagcattattttcatcggaaaacatgccgaagcggaaatcataccgagagatctaatacctggaagatgttctgatctttggcattgcacggccagccagttttttcctgggcatggtacgctttgggggattattaggcgagcccttatccccagatttatcatcgtcgccttcatcatcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcgtgaagataaaattatgttctgatcacggtttgagggtttcctatgcatacctgtggaggcggattgaatgcattatatggcacaactggcagttggtgagagtagctgactacaattgcattgggctgcaggaat

SEQ ID NO: 64320 - DNA, 2605 bp, Oryza sativa
atacgatccaacaactccaaggcttgtactgcttcatctccgattggaagagagttccaagtatcttggtacactggaggaagacaagagtacccgggaagagcaggctcgggattctgaacgtagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagtctcaccgtgcgctggtcgccacccgatgatctccttggcagggagaacgccgtgcgccaccatctccttaagattctcctccgttacgtcggatgacgcccattggccttcgaagctttctctctcttccgccatcggtttcattcaaatgtgctgatttgattcgagggatggcttgggagaggtgagggattgaggcggtggatcacgggaaggattttgatgcacttttcggaggtggatttggtcggagttgtgaaccctagttcgccggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttggaggctacacctaattaggtgcatctattcgatgcaccatattctttatcttttcgccctttacagtcttcgtcttcgctactcagcaggccttggcatgaaaagcttgaagcactcggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagatttagtcggttacgactgtattttacctgtatcttcatattccgttaggaatatagattatcttttgtaatccggactccttcccatatataaggggggtccgggcgcctctaggggcatatgctgattttttcccgaatcacacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacacagctaaagaacacctaaaaaacaaaaaaaaatagtaatttggtttaggacactttcagctaaattgaaagaaaaacttcttaataaaacgagaatgcccctaaagcttctaacgtgccgttggagtgaaaatttagaaagtaagtaactctcaatctcccatcaacctagtcccttgtattttatcttcactctagcatcaggtttgtggcttgtggctctataattcatgttttttttctcaacagtggctgtgatactttttacgaagtccactaacaaattacacaaaatttggtgctccctataggaaaatttgcaatgatgttaactgttgatttctatgttataccacgagtagaaaaagttatagctattacccgtaagtggtggtattaaatagttactcctccgtctcattttaagtgcaaccatgagttttctagtctaattctaatcgtccgtcttatttgaaatattttttatttgtatttttattgttattagagggctgcaggaa

SEQ ID NO: 64321 - DNA, 1837 bp, Oryza sativa
ccctttcccctctttctccatggcttgatatctaccattcgtacaaaaggggaagggggaatgggagatcggaggattgtagtggtggtcatcacttgcacaccgttgcaagttcatgtccattgctttgtgcccccctctctctctcttcgccatcacacaggtgcatgcacacatgtggcaccttgcacatcatcatcgttcatcgtcatcagagagatcatgcagtaattgtggccacaaactatttggaaccaaataaatttgtataatacttggtgtaatttctgaaggggatcggaattggtgtgttaaaaggctcaaataaacggcaggcaagagtgaccaagtgtccccctcttgagtgagaattaaaggtggtagcaaatcacctcaagaagaaaatgaaggtacatgcgtatctacatgtggttttccttgccaccaacagagatttggatccgatagagatatgtccaggctatctcttaggataactagatgaaaagaaaggctagctagctagcgggtaaaagaattaccacttcagtccatgaaatattaattgccagtgtgattagttatataagtagtgacccagtcacaaaaaaataataataatagaactaccctagtatatggaatgggaaataacctagtgcaaacgaatctgggcagaagatgagacataatcctagtacaacgaattaggacacatcttctatctaacttcgttgtactagattatatctcattccatactgggttaggttttttttagagacggaggaagtatggattatagatatacagggttgacatcaatcgagatcagtagggtttaggttacacacggtgagaaattgtcggagttcaaacgatagattagtctaactatgatgaggtgatgtgaccctgtaattaatgtaagactgatattagtaatgatcaatctctggtatagtagtatatattgcatcattactaaggattcgattttttcgtgcggtcaaaatacattttcccgtacgaaggtcctgcccgtctgcaaccaggtgcctgcgaaaatcaacatccacacaggataatacattaatgtctagaccaaaccaccactttgtttagtttaggttttgatttattgggcttagacttttaaactgactttttcttttatggtttataaaccggtgacatttaatccttcaagtttacgggtgtggtcccaactaattaactcagttaagtaaaaaaaagctaattaaatctaacattcgacactacagtgcaggaatgacttctggaatttttttaataaaaaacaactggaaaacaatctatttgtttagtccagtagtcctctacttttttgttcataagagcaaaaaaaaaagggccatagtttataaattttggatggagtggatcaaatttgaatggaggggaaatcaaacttggacttatcggtatatatacgtacgtaacaatctatgccaataagtctaggtatatttcttaattttttccatagaggaagtgtaactttcggcttctttaccaactagatgtacacacagctgctacaccactaagcttgaaaaaattattaccttaatatcggcaaaaataaaaataaaataaaattatcacatcactagcaataataaaagggtaaaaacatacaaccccattatatatcgaactaggagttgattgatcatccacacaggcctgaccattactaaaaacaagatatgttaaaatatttatgtttgttgcaacgcccataagaaaatatcaaatccagggttttcatcttagggtctcatgtgttgaa

SEQ ID NO: 64322 - DNA, 4213 bp, Oryza sativa
cggagggccgcccggcgaggcggcggctggcggccgcgcgccggcggggtgcggcaggcagccggccggcgcgtcgcgcggtgagtctgcagcctgcggcggtggccggcgcgagggcggcggggcgcggagggccggccggcgaggcggcggatttttttttttaagaatttgagattgttgtgtgatgtatttgattggatctgattgttgtgtgatgtatttgatttgtgtgtgatgtgaatatttgataattttgtagaagttgtgatgtaattttttttttgagattttgtgatgtatttgagtatttgagatgatcgattgtggatttggaagcaatttgaaaatgattgatttgtgattttggggatgggattgatttgtgattttgattaaaaacaatgaagaaaataaaataataaagagcaaccggatctagtctttttagtaccaaccgggactaaagataaagcatctttagtcccggttgttaacaccaaccgggactaaaaatggatttttactcccggttttttcacccgggactaaagatagcgatctttagtcccggattcatagtcccggttggaaaaccgggactacaggagggttacgatctgggagtaaaaaccctttctccaccagtgagaagagttaccacagctccaagaccacaccatagaacaacctcgtcactggttatgatcatcctgtatccaaccagcaaatgcatgccataccgttaactgttgggatttcactgggatcgaacgactcaatcaacaaacacgactacgagagaactagaacgaagaagcatggaataataggaagcaaaatttctgacaagaggcaaaactttgcttcgttctagttcacgcgtgtattgattgagtcgatatgcctcatctcactgatatgatcgtacttaaaaggaaccttaagcgatagggccaattctataatggaaaaacgaacccggtagtaatttcttcttggcagaatgacttttactctaagaccaagttcccttggggtaagaggagcattcttgaattgaactatcctctactaatattactaacataggatattgggaaaagaacctatttatttagggaagtaaggtaggtagtttgcaacgttatatacaaagccaagggaaatagagtcctgggttctaccattatcgagaaataaaacaatgatttccatatcatttcatgaaaaagattcttttgttgacccgttgtctgaataaagaaattgtatatcatgcggatctaggaagtcaattctttaggagagccaagccaaaaattagaaaataaagggtttaagtcttttgccttcttcttcaaggaccaacgaggatctaatccagccaactccatactaagctcaaaagtctatggagcagataaatgattaaaaatccttcccttcctgacacttgccgcatctgtcccttctcgagaataattattacgtgtagtagcgatcagtggttcacgctagagctatttcttttagaaaagcttgatccgtctttgactcgcttttgctcaagaaggctcttccttctagttccttgccaaactccacttgtaagtaactctcccttgaaccgaacgaactttacgagaattagttgttatctatgatgtctttttacacctatgctgcaacaagacctacattttacttgaagtgtgctcactgattgaagagctttgcttcctaaaatataatgcattcctaattggttgatccggtgaaatcccaacaccaacctggtccagtaaacgactaggaatgcatgcattcatcctcatcctaatctattaatttcatgcaatttaattatgggaagtgtccaaggtctttcaagagtctctcattatggtatctaaaacaagctgggtttctagcccgtcatctgataatcatcactaatcgcgtgccagtaccaacttggtgctctatcatcagctcatcacaacacacataaatatcaacttattacttggtgcttctcctaatcaaagatcaaaggaggcttcatcaagatgtggtgcaatattgtgctgatcactaattaatatgcgccgccggggtgtttccagtgggtgttacttaatcatatcacatttcttttggcttgccatatgctcaagtgcgcattgcaacttgaagtagcttgattgacagtttgtccctcggcatgctttaatttaatttcgcctcctaattctaattaagaccatggatatttagctgcaagagtgatccttccattgttcttccttttctttcactttatgaattaaacttaattccagtggctaaactatctagttagattgagcactagatatccctctactagggttgtgtttgaggagaagagatagagaagattgggaagatacgcaaaacgaggtgagccattagcgtatgattaattgagtattaattattttaaactttaaaaatggattaatatgattttttaaagtaactttcttatagaaattttttacaaaaaatgcaccgtttagtagttcgggaagcgtgcgcgcgaaatatgaaacaaactcactcccgttctccaaacgaacgcagcctagatctctaggtgcatgcctagcttatctcatatgcatggatccttccttttcgtggtcctttggatgtaaataagttcttagatactttcagcgtccatatgaccaaaaaaaaaaaacaaaagataattctgatggtgtgtaatattcatgcaaataaatgcaagtgcccattagtgtacaccatgttagattttgttccagccatttgttaagttagtagaaacttgtgaaagcaaggaaggaattaattagaggggatcgaatctttctcttgctagcttttgctcgagtgacacacgaatattctggaacagaaagagagaataaacttaactgcgactgttgcatctcagcatctgtgtgatcgatgatgcagtaactttctaggaagctaactagaatatatatatatatatgccatggaactgtcagtataaagttttgaattcagaaattctctggtcaattctttatttgtgtaggggtgttagtgctgtacatatagtggctgtgcatgtttgtagcaagtcgtgttcttagcttttgagatcgatcgaatcatgaaactgattaacaattttgatcgagaattagtatcttgattattcctgagtgtcagctgccattcaaacatgtagtatatgttgggttgccttttctttttttttttttccggttgagaaattctcgaccatcaattggtatctaggaagtcccttgaccatccatatgtcagcaggaataaaacttgaagcatctctcactgtttatgaagcttttggcatgcatgaaatactctctgcttttttattattactttgactttttgagactatatgagtggtttatgacagttgccagtctccaatttttttttcattcctaaagaattttatgcatgcatgctatgtttaaactttaaatgtcgtaatttaagaacttaagaaaattatgacagttcatgtgtcaacgtactgaacttgtccgctgtacagctttcaaaatgttattcccggtcaacgtacagttcatgtcaacgtactgatcctctatatatgttctaaaagaaaactaattagattacaaaaatcttcccggcacgaaaattatcgatatatggtacgtagagctgtcctcgaatcctcaataaaagtaccttttcaaattttcgcaaaagaaaatccttttcaaaaacattatacaggtttgtaatatctcccacatgaactgacgcaacataccgatccatgatattttaaaggaataagttcatctgaggcctcttaacttgtcaatgaatccgattttcatcctttaacctgaaaaccagatacaacgggtccctcaactgtcaaaacaggtgcaacatagatcacacggcagttttagcttacgtggctaattaaattgacccggtctttatctgacgtggcattgacatggcaatttggtttggacattaataaaaatagtgaccccacatgtcagttacaccaaaagaattaattaaaaaatggtggggcccacataggcctcacatgtcattctcacccctcctcttcttcctccactctccccat

SEQ ID NO: 64323 - DNA, 2245 bp, Oryza sativa
  unsure (1)..(2245): unsure at all n locations
tgaactgctggtgacagttccagcaaacattattagcgcctgcatttcagacaaactgcagactctgcatttcaaatttcatccttctgttcctcctgaacagtgtgaccagattctctaaggtacaagaaaactctgctgttgcattacattgatttataatgtagatcgatgtttaaccactactacatgtgttttctcatttcttgacatattagtagatctggtactattcatgtgatatatctaaggccccatcgtttggcttattgatggaagaagccaaacgacatatttacaaacgaaaaataatttgtgaataaaccttttatatatgcgctcttagtgatctaaaagcaaaggttgaaaaataaacttcgataaaaaaaactcaaaatcaactccaaatttaaagttgaaaattcaaattttagctaataagcataagcataagtgaaaagacgaggctgtaaaagtgaaccatccctttgtttcatcaaaattaattttgacatgtcctaatcattctgacgtagcaaagtagagagaagcaaaaaaatctctgatcttacatatctggtagactgatactactgatgttcacaacaacatgaagtgaaatagtgactggtgagcatgccctcagctatttcgaataaatataagctaaatttataattgaagtcacatactcacatggctggatttccttttcctagatcaaaaactgaaatttctaatcttcataaaacagaactgaaacttccaacaggggagcagagcaggccgcctgaaatactgaaatagaactttattcagactgcagagcttttcatatttggtatgattgtcattgtacacattaaaaatctcattgaacagcgcatttaataaacattacaagaatataaattaagtctggaaatacaaaagactcgaccaaattatcatctatgtccattaagttggcaactaaagcacacttctgctttcctctgtaatggatatctgttataactgatactcaatgaatctggccaaacgaagaattgttctttccctcttcaattatcaacagcaccctttaaaatacatcaatggtccttccttactgttcatttttccaaagagaaaattgcactgcgatcagcacaaatgctcttctgtatcaatatctcctgttaaattgtcataagttataacagcaccatggaccctaaatatttcactgcttctgtatgcagtagttttttctcaagaaatggcagcactgtctgtctttgcttcatcaatactctcaaaggtcactacatttgctgttgaatatgctctcgccgacatcaaacttgcttgcacagttaggagtgagatagaaaagctgaganactcattgaaggctatntggctgttcttaaagatgctgaaaggaagcaatctacatctagttcacttaaacattggctggaaaacctcaaagacattgtctacgacatagatgatgttctcgatgacgttgggacacgagcattgcagcagaaagttggaaaaggtgaaatccgtacttattttgctcaactattcatttttccttttgaactgggaagaaagataagaagggttcgtgaaaggctaaatgaaatatctgcacttaaaagaaattttgatttgaaagaagaaccaatagacacaccttcagatcgaattgtacagagagaaacatactcaattgtagatgagcgaaagattgttgggagagataaagctaaaaatgatattgtgaaggtgatttcagaagctgctgaatctaattctgatacactgtcagtgcttccactaattggaatgggaggtgtaggcaagactgccctagcaaaactggtatttaatgacaaacgaaccaaagaaaagtttgataagatgctatgggcatgtgtagctaatgtgtctgatcttaaacatatagtagatattatcatacaatcagatagcggtgaaagcaacaagcaattaaccctagaagcactacaaaagaaacttcatgagctttcaggagataagagatacttgctagtgttagacgacatatcacatgataacattaatgattgggaagaattgatgaacctgctaccgagtggtagaagtggaagcatgattttaatcaccacgcgtctctcaaaaattgcatcagtattgaagaccatagagccatatgaagtgccaaaacttccacatgaagaatgca

SEQ ID NO: 64324 - DNA, 6316 bp, Oryza sativa
cgtgcacagggtgctccacgagccgctcttccccatcgagtggacaccaccgccgtccacgacgtcgccatcggcacccgtctctgctacgcccgcctcaccgacgcttccgcctcttcgccatggccgctgtcgtgcgggtcgacctccctttccctatcccctccacctccccgctcgccgatcgctggaccgccatcctcgcacgctgctgcccacctttacctctgctgccggcgccgcctcgcctcctcctccgctctgtgacggccgcttgagcaacctccacctccgccgccttcaaccgtgctggtgagaggagggagaagagagagagatagagagagagagagtgagagagattggggagagagagagatagataggtgtgggaactgacaggtgggccctacttatttttttaaaaaaatattgactggactgccacgtaggacaaaaccaccatggtttgaggccggggcagggagggggttatttgttcggcttgcgtagttgggggtgaagaatgtgtccggttttgttgttcacaggggtaatttggcagaccgcgatagttcggaggggggtaattcgtaccttttcctttattcaatgttaaatatagttttatgtatacatatagttttacatatttcacaaatttttttaataagacgaacggtcaaacatatttaaaaaagtcaacggcgtcaaatatttagggacggagggagtacttatattttacgagttaattactccactaccatcggtttcaataattttattccatacctcgtcctcctataattaaccatttcattgccatcagttacaataattttattccatacctcaccctcttttaatcaacttctgtctctatatatctatctcatgtgttaatggtaaacactgatgatggtgcgcccaggccatgcgcgcgcgtatctgaacggatagaagattactcctgatcttctgctgcttaacgtcgctagtgcgtgttaatttggaactttggatggtcgtcgtacctaggagcaaatgaaaagctctgctggtcaagttcgtgcagagaaataaaccggccagttgaatattatattatacattattggcagtttacgtcaggatatatgtgcgttctagctagttagcacaatgctgctaatctagtatgacgaaatggggtatctcttcaggcacgttctatgttctagttggtgtcaatcagtgaaggaatgcatgcatattcatgaccgatcgccggccaaaaaaaaagtagggcactggccccgatgcaaaataaatagagaacatatatttacaaaaatactgagaacaaaaaaataagttatagtgatggcgttctacctaaatcggataaagatttttttgaagaataaatttcattggtggcatatgaccttgataggtggatgcaatctggtacgcaaatttgcaaaatgcttgtttcaacgcacggacttgtctaatgcttgcgaaagaagagcaaaatgggaggctgtgactaataatgctgacttaagagtccacttagaatgacatgtgcataataaaagggtcatcaggtataccacatgtgtggatagtctgatctagttggtatttattttttattccactgttttcaattcattgtatcattcatctatgctacaaattatttgtttgtataatcaacatcccttactataaatttgattgagtacatgcatatctagatgacatcatcctgatatatgtgcctgcatggcatcctaataaaatattcaattaagtaggattaaccatggtatgcttctttggctgggttcacatgcaccacacaagttcatgcattttgcaagtttgtgtatcaaattacatccacctcagagtaccgtcagtgcaatttactctccttttaaggaaggttggaaaaaaatatatcttgatgtagtgatatgaattttattaagcagaaaatggaacacatgagctatagcctttcgagatggtcatgattatcatcgaacacttattggaacataatgaaactagtttagacagttcaataaaagaataagattgaagatttttaaaattagaatcccgtttggatgcaataatactggttaggtatcggtacatatgaggtatcatgttctaattcctattggtataaggtgatacccatgcataggtatcagtcgataccccataagtacaatatgttgatacccgttgataccatcagaacttatagatatcaatgcaatactgattgataccatatctgagctgacgtcaggggttgtgcgtgacgatggcaagtcgggtccgagtggcccgaggggaagagcaattgggagacaaagagcatattggtgatggtgaggagctcctcgacaccttggaggagcaggaccacctccatccactattagaaaaataatttattgccataaaaaaaatcgtagtatcaatgctaaaattattgcaatagatacatgttgccacaatcttaaaatcgttgctagccatggtaataaatagcatggtaataggttattgcaatgatttttatttagttgtaataaattttgttattgccataaaatgtatgtggcaaaaaatatatattacaacacttcacatcgttgcaataaataactattgccaccactccatgtgtgacattagttctacgtaccaaattaaatgtttcaatattaatttatcatcctaattattttcttttgatatcttgtcatggctaggattcgaacccaagatttctccctcacgcgcgctcttcatgaccaactcacctaagcatcaattttgtttaaaaatgtatataattccatttgagactgcttaactgagatttgaatcatgaatttgagtatttaaaagatttcaaatgaaaaatttaagttgtagatctcatcgagaggtataaatttcatataaaatttgtcctaatccgtatccatacgaaaataataagctaaattatgagatgataaattttttatcgcaacgaatttgttgatatggcaatagaaaatagtgaaagtaccatgtactatgcaaattgccacaaaaattaaatttgtggggatagaacatgttcagttttgaaaataaacagaaataaggtctttaaacatattagaacacacattagtatggaataaaatattaaatgttggacccctaattttgggaagccttgttcggtcgtccattttgcacacccggcccttatcggcggctctgcattcaagctgacaagttaattatgtttagcatcatgcacttgcaacatgggaagtcaagcccgataaaataaattaacacgagaagttatgccaaccatttcaatttgtgcaacatatatatggtggtgtagtcatgccaactatttcagtttcaaaacggttctaatgggaacatgggaagttcaggggaaaaagctggtggcgtacgtatatacagtgtacagtgcatatagcacccgtcaaattttgcaatttctcatatatatgtactttatctgtctagctatggtctatggtgtatatatgtgttttcatttttttgctgaagttgtttaggaatttggatcattgagccagacgagcagcctctgcctaactaatcagggttgtgcatcagctggttggctggttcaataatactctacttcaaagagagaagttacgtggagtctctaacaaaaatctcataggatttctacagcttacgtggaatattatcccagcactacactgtacaaataacaccaaacatgtgacgacccatatgtaccagcgacatttttctcaccgtcgcctattttcatacagggcggaaactaaaagctgacacatataacaccttattagtgttggttcatacaaaaccgatattaatagcagcgataatgtatttctcttttagtggaattacattatttataaatgttttttaaaaaatatttataaatagtatacgtgtaagaaatcttagttgcttttatctattaagatagttgatggttgaaataggtccttaacgaccgtcaacagcataattgagcccgtttgatgctgtttttactgtctcatcaaagtcctgtctatgttggtactacaacctgcacagatacggttatacagtgctgctgaccgggtaatgcacgtacggttggaaatccggtactggtagggccttcagaaccagcactgatttgggtgcctatagtagggctaattgtatttgaacagtattaatatgcggtctttttggatatgcatatatatatatacatatatatatatatatatttgttcgaatactccatctgatcaagaaatcatgtcgatcggttcttaacaagcttaagacacagtttaaaatagattattgtgcggattgttgctacggtctacgaatgatattctacttgattacaaagaaaaaataaatactttgataaataaacttaaaaaataactgaaacaagtgatctaaccaatacaatagaaaatgttttcttaagcgtctagtaaataatctgtttcagtaattcacttcacatctatcaaatttaaaggacaattactcatttgaccctattttccaacttaagtatcaaattgacccttttttttaaagtttgctcatttgaccatgtttttttaattcgaagttaccgcctaacccttctttcactacaccgtgagtatttcacttagaaaaaacaacaaaaaaacatgtatttacaagcccaactaacaaaaatgcccctaatacatcaatctatcctctaccttcattcttatcctctctctctctctcaccagagcgctgcggaggagcggcggctcggcgacgaagcggccctccgctggcggcggctacgggggagcggcggctcaattacgaggagggccgccgctggtggcggcggagcggttgtggcggctgcggaggggtggcgtcgtctcggcgacggtggcgttggctcggcaacaaggaggaccgccggtgggggctcggtgaataggaggatcgcccggtggcggctcggcggtagctgcggaggggtgacgttggctcatcgacgaggagaacggtcggcggcaacggcggcggcagcggtggctcggctacgaggaggactgccagcacccgcacgcggcacgcatctacagctctacgcacgctatgagcttgtcctgtgataaactaattttgggagaataaggtcaaataatcaagggtagaagtggtattttgggattttgttaacaccgtctaatgcccttaactgaagagggttagagtgtagcttcagtttttaaaagtagggtcaaatgagcaaagtgacaaaaacagggtggtagttagacctcaaaatagggtcaaatgtgctattgcccttaaatttaaagccattgtgttaccgttcacaatgcacctacatatatatctcaatgtatatgcaagcatgcacattgatgccaacatgcaacccagcaccttgagatattcatacatctccagtactagctaccagagatatcagataggacctctcctgagtgccaagtgcatgaatgacatggcatggtgcatcatccatatccaggcagagataagtccaagtggcaagagatcgatggcaaagcataataatccaccagcaaaccgtaccctaattggtttacatcatgtgcacaagcaacaggagccacataattgaggctgcctgccatggatgcagtaaagggatcagcagtttggtgacgacacaaacacacaatctaatataaagcccccccattatttgatcatgacataacctctttcctggcgaaaagaaaaaggaaaaaaaatatatctctgccttttggagagagactgatctctacacacctggtgcaatatgatacatcacctgtggactgcccaataattaatgcatggtgtctctcctttgaccaataattataaggatatgacatagagattagcaccagatattcataacaacaaactaaagaaagcttaatgcatgcatgagattaattattttccttctttagttatatatatgacgatggtatgtgattatccttatcaagaacacatatgatatatatcatcataaagctgcatgcagtgcggcgcctaattagggggacaaaagatggccaagatgatttcagcatgggtggtgagctgtcgaccccatggccatcaacacctaaagaggagcctgtgaattcttccaaaa

SEQ ID NO: 64325 - DNA, 2011 bp, Oryza sativa
tcacatcgagcgtgttgaatgctacaagtaatgaacctctgatcacgtgctattctctgtaggccatgcaatagcttttacaaaaagcggggaatatagctcatgctttaatttgtaacacttcatctgttacttttgggtgtactctttctttctttctttctttcttttttcttgtcttatttttttttacaaatgaagtataacttacagtctctgcattggatttacacaaccatatttgcaatattagaaccctaactgatagagttatacacttgcaactttacgactacattaaaggtgcattttgtatgtttcataggttattttttttgaaatgtacaacataatttaggtctattttgttcaacaagaacacaacatattttcgatggtgttgctaatttatatgtatttgttttttatatacaagtttccatgttgtgcaagaggatacatacaaattttcatatttttgaaagttctaatgagataaagtaattgttaacattgtatgtctataagggtattttgggttttttttaaaaaaaatccaacctatggaaatatttaagaataattgataaagtcaccggtataatagatatatagacaatatcagtgaaaaattatagaactgtgacaaattcagtggtatggagtagattctctgtaacaccctaggtattctcctacctagtatgctacacactacggaacaaaaaacactaagtcctaaattcattaagaattttgacagtctcccctgtaaatatggacatttaaggctggcagttatatattaaactattaataatattattcccacagtgcgatcgatccatataatccattaaaagaaacttatagttatctaaaagattattataagaccaaactaggatatagttcaagtgttattatggacctaagtaatatagtttgatagtgtgcatatagatctgtatataattaagggtgctacttcccgcccatgcatgccgatatcaatgtgtacctaaaaccaaataaacacaagagtgagtacgaaaatactcagcaaatacaatatggaactagaaaacacatgtacacatcattggcaatagagcataaacataaagctttctttctttgataagaaacacattttcaaacaccaaatcaaagaaaatagtagttcccatgtgggcaaacatgaattgacatagtagtttccatcccagataattgtgaatacattctagcatttgccagcaaagctgagtaagcgtgatcaacgattacccataagaacatgaataaaaccagatagcacatccatggctcgcatggaacatgaacaagaacatgaataaaaccatatttcacatccatggcaagcatggaaattgaattatttaaccaaagctagaattcggaatattgaaacaagaatggcgttaacaatattctgaacataaacagtcacatatcatctagaaatatatcagaaataaataggtagagcaatcaatccatgaatcatacaattagttcgttatgcacttgcctccaatgaagggttggtatcatgcacgatccgaaggaccaccacctaatcacaaacaaaacctcagcaaacacattcaaatatgactataataaattaagtggcacactccttcagctctatcccaacctcaagccaaacagtaaacaccactcccatctataaacaacactgttacttcactattaattaactttaacacaacaaacaaatacattttaggaaactacagaatgagacctacaacttccatgtagaaaccatatttttattttgccatttaaaaggcctaatgtgcacatcaaaacaagcttcagaatctgcccacgaattcagactgtccacactaaaacaaccataactggagttctactcgcccaatcagggtgtactttaccaatatggaaaactaagaaaaaacttctacaactttatctataggcagcctgactgatt

SEQ ID NO: 64326 - DNA, 2373 bp, Oryza sativa
tcctccaattggcgaaatacaaagacacagaaaaactgacagtgccccgaactaacaatccaaaacactgcacctaaacccatcctctaaccctccaaaaatgatgaattaaaacaataaaacaacctacaaccactactataggagaggtaagcctcacctagggtttgcttggagaacttgtgagaatatgatgggaacaccaacccaccactcctcctgctccccacattttcctcgatctgtttttccaatcagattcttgataagggctatggttcttagagatccatggagtagggttaacaggggagaaaagaataggtgagttccatgcatgggtgccaagggaaaggtgtggcggcctccgttggatgcaccagcagcggcggcgcagaagcggagatgcggacgaatatcatctagtatacttatatagttcatccttactaagtagtgtagttaatactatttctctcttctctcatgaagccatatcacccgaattatttctaacctctggatgatagatctatagtacaattatcttttctttcttctcgcataaaaccattcaatctcaattattttgaggcttaaaattcataaataccaattacataatatatattcaccttgcactatatttgcaaccatgtgcaaattatataaaatacatgaggtcattttgttttggttttaaatgatcatattgcaccttaccttatttgtacatattatgcaacataatttcccacagcaacacgacgggtattcatccagtattacaaacgattggtcccatttgatgaaacatcacattttcactacacatgttctttctcccacccacttaaggacttgaatttgtcctctaattctagttgactctcatcatggtaaaaagaccatggtgtattgcaacagttatggcatatgaagtagcataggtcaacacatatgttcataattgttgccttgttgaaccggtttgctacaaaaggggtttgaggaatttgtgaaaaaaattgacaataaatcttaggaaataaattgcagattaaatacgatgtatagagaacaatctccagacttacatattcatggtttgttgtgtacctaccgttgaccgtaagcatcttgtgatgaggacacaactagcttggatatgaccatgactaacttatgtattcatcaactaaaggtgcatatgttctatgttagatttacttattatatatttgaacaaacattacgacaccatgagttttgtattttttcgtttgcagaggtaattgcttgtgtgaaggaaaagaaaccgagcgtaaggaatgcatggatgatcaaataagttgattggggatgaaaacaagaccttctccaagtctacttctacctcaccatgccacttttggataatagaagataagagataaagttctgtacgttttggattcggattcgggcctcccgacagcatgaaatttaaatggacctagccgctgatctagaaggaatttcggggtccataagtacttgttgaaaaaattttgtagtctactttcatatggtttaggtcccacgtcaaaattccctccgagctattgggaatctgcaaaacaagcaacgtacttcacacaatctgatttgggttttgggccttgtaattgtgtcgtaggctaagcccaagggggtgtgcaccctagggcaaccctaggatatcccaaatcatatttattcagtagccgtcatagtttagatttgggttttgcttagattatttgccattgcagtttcactgttagataggtttgtggaaccccaaattcgagtgcttaatcatttatgtgcaattgtgttgtaatctatcttgttcttacttgtgttcttcgattcgcatgcaagcattagtcttatcggcgaggtcaaccggacagtgcacggttgataaccagaggagatgtggtactgcgattgcaggattcgaatctcattgatcggaagctggatcgtgtgtgtcaagtttccaacaaattgagagttatcaatacctatcggaagatcatgacctagtttcctcatcagttggtatcagagcgccaaattgaccgttaggtactttatctatagccataaccagaaaattgccacacaaaaatattgcatccattacctagccaatttgagccgttgcattgttctattagtttttgtgttgttgaattttaaattgcatcgtcgtgtcgagtgccggtttagttttaggtttaatttttagttttgagtattgcatttgttcatcactttgggttagtcacgtctgtcagtttgggtccagtttgtaggatcgaaacataagagggctgcaggaat

SEQ ID NO: 64327 - DNA, 3376 bp, Oryza sativa
aacccggtgaaacacaaatcgaagacaatacgcacacaatacctccatcgtatgccatatggaatcttcaccaaccacatgcatcaactctagccttagtatcccgcatgatatctgatcaccacggacatcgtcttaccaccaagccgactcccggtccatcaccacagatactctcccgagacatcgaatcacctacacatgaaacaaacaaagaaacaatattccgggaccaagctatcccaaacttgactcattagtagcaaataatagtatctcatacgtatagtatccatctagaagccataaccatgaaacaatcatggatatccaaagaaacaacccgaaaccgaaaccgacacagtgtcggccggtcaaaccgcgggcctggccggtctgaccgcacacatagcgccggtctgaccggcaagctccacccggtcggaccgatcacataaaataatagtgaatccgatcatcacctgaaaattgattatttccaaaaccacttcgacgataatctccaaatatcaaaaccaataatcacagatgctaattattcatcacagaataagaatcaaaacacactttgatcttacacagttttgcatctcgtcggttgttgtcgggacctagcatcctcatcatctcatgcacgtaatattcacatagtacaagatgccgagggggttgcttgaaacactgcgaacataataagaacatcggtcgttataaataagtaattattcaaagaatttgtgttcatgtcatatgtcagtaccaaccaaactgtcttggcgtttagcttagtatttgctcctctattgacctttcatatttcaagtaaaacctctgcgcaccggcctgataaaatctttttctcatcctacttaaaaacgtcagaacagccctttggtacggcggggcgggctgggggtggcgctgggggtggtatcttattacttacaaattagtaaggaactctatgtagcttttcttgtgatagtttgtcgggtcaagaggtatggccaagtggtcctttggatatactaaggaataaaatgtagtgtttgctgcaaataagatagatgaattagagacaatatttgctagtaatgatgtattaacgaattgtaactacgtaatcaaatggaagagccactgcttacaaaaagctgtataggagcattaattaagacttttttttgtcatggtgcgagagcattcctcatcccaagtagtataacttgaatgaactggaagtttgtttcatactaggttgtccacggccgagacggcgaatcagatttggtgccaatagacacatctggatctggagcctgcgaggttgtccatgtgtacagtatgcaagctcatccaccagtggcggcgcatccatggcggccttgctcatagcggatgtgagcagatccacttgagctcatccgagacagcggtggcggcagcagatccatggtgaccttgtggggtggttgtggggggtgaggggttgggctcatgtacgatggaagttgttggcggtgagcagagatggagtatgggtgagctagggtttctgggttctagtgttttgtaaaggttctcgagtgaaaatggcaatcgtcttaaggaatcgcatatgaatatgtgatttcccgtaggctgacctccaagagctagcatttgatatataacatctgcacaaccattttgttagaggtggtcagcaccgcgtctctgctaggtcaatttagagttttagacgcatgtaaaattgacaattgtagtagtgtaccgatccagactagccaggatatataaaaagtcaaccatacatacactctaaataacttcgttgctacaaaaggcaacgtccctgatcgaaccaagcttatacacttttattgtgatttggctgaggagaaaaagtcggatttttttcctagcgtgaaaaatggtatttgtaggcccctggagttctatctttttcacaggtagacaaaataatgcctgcaaaaatggctgatgccatctcagggtcacataacacataaaaaatattttcatagatgggtatagcagaaaactgcatgtgagaacaagtatgtttttgttgatggttctcctaaggaattgctcgcaaaaaccatgactttcacctgtggttccttaagaaaactgcccataaaaataggatgattttttgccgatgattgtcgtatgtaagacttaaaaaataatttttctagaggtatctagattcatcatattaggaatattaggatatgtaacattcgatacaaggttggtttacttttaaatgtaggaaagtagtatgtgtttcaaataagttatttagccgtcagcgtggattcgtgcacctctatttccatgcaaccaattaataatgacgctaggcagtccttcctattcgttatagacttaataatgctttcattttttataggttagaatttaccaaaaatgtaaataaaaaccttgactatcttttgttaatctttaccgtaaattatattttgtttattattgttttgaggtatatatatgatatggtgtatcttgctattcgatcaactttgattagaaatacaagacaatattgcagggggcaacttcagggctggtttgcttttttaaaagttttcagtgcgcactctcgatctgtcacactaaactaatctataattaaggtactgaaaggggctgtgattccaagaaaaaagggtggaattcaaaaaggaaaaagaaaaaaggatcgcaaattaagaaagaaaagaatactaagttggcgtcacagatgatagcatgtagcatggatgcctatcctaattgattaacaattgtgcatgatagtgtacaaaggtttacatagcgattaggaacagaaaaccgatgcgacacttcacctagttctttaactgcaaatatctctgcacttcacctttataataggcattcagtttgtgtacacaaaattaagagggcatgcaataggagaaatcgaactatatatatacaaacgaactacagcagaaccacactcactacactggtcaaggtcacctgtgacgggcccaaaccctcacctttgacggttttgggcttggtcagtgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgtcacagggtgacccacctgtgacgggccc

SEQ ID NO: 64328 - DNA, 5184 bp, Oryza sativa
cgaaagtaaaagcccgtcacaggtgggtcacctgtgacggtccgacgtttgcgagtccgtcacaggtgaggttacctgtgacggatgtttcttccgaaccgtcactgatgagttaattccagaaaaaaaataaatgctaaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattaccaaaatttcttgtattctgttcgttgtgaacctccacaacctgtcaataagggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcatttaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttaggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacgggtcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcacccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggttgggtttgcttcttcctggatcctcgcaggtgttggggagggcgggtttgcgccgggcattgacatggtttaactttcgcgaaaaagattataaatttcctaccattagactaaatagcattagatccaatgtagtgacggggtatactatgaaagatatggcctcagttttgctgagaaatatgcatcaattacaatcatttgcatgaagggataaaaagaggaaatcagctactaggagaaaaaagcaacccaaataaaataggacaagtgtagttcatctgttcttatcaataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcaaggggagattcacataaacagcaacagcagggtggaaattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcattcaaatttaaaaaacagcagcagcaagggtacagaatttgcatgattgacataaaacagcagcaggagtataaatgcaagtccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacggggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctgttcttatccataaagaacaagtgtagaggtatataaccactgagtcaatcatgcaaatttaaaaaacagcccacaataagggtacaga

SEQ ID NO: 64329 - DNA, 1984 bp, Oryza sativa
ccccaccttagtagtatgtctacattggtatctatagctctctcatgcattgcctcgtttttctctatagactatctctaagttagtagatagttttgctctctctcttcatttaatacattccaagtaggaaaatatgctgacatggatctcttgtagagagcctatagataaccattgtgggtgccctaagggcagtagcagtgtaagctatggggtctatacccataaggccctagctcaaagtcacagtttaaagacattcaccccacaatacaaacacccatatatatatgtggtttaattggatggagacacaggtggaggaaatcgagcccacagtgcagcgttacccaagcatgtggacacgaggtacgggacgaaatttcttccccacctaccccttccagctagcgactttctcctcctctactccatcgccgtcgcctgcctctcatcccgcgccgcttcgcttatcctcccgcgccgccgctccacttctcccccgcacctccttcccctcccttcggcggccgaggcggatgtggtggctgtagcggcggatgtggtggtcgacgcagacggatgtggtggcagccgcgcctccttctcctctcctcccaagcagcagtcggcggcgcggtcttccatagtgaacgcgaggaggacgaagaggtaggggagtagatccggcaggcggcagcgagttcttggcggcagcgaggaggaggaggaggagatgggggcgtagatccggcgggcggcggtggcgatgaggaggaggaggaggtggggacgtagatccggcgggtttttggcggcgggttctttgtggtggaggcgtccccggcagcgggttcttggcggcggcggtgggttctcatccggccccatggaggacgtcatcaccgacgcaccgccaccgtcccgcttctccccggacgcctcgacaactttgccgcgccgcctcctcatccacctcatctcccctacctacggtgacggtgggcggcgggcgacgggaagccgcggcgaggaggccacgggcgcgcgtcggtgcatcctgcgagcggtgcggttggcggcggctcaccggtgcgcgggattttttttgcggcggaggaatcgttggcggcggatttttttttctttttcatcatgtggtttacatacgtctcgatttgttttgttgaatccatcttctttgagttcttctcttccaatcccgaaaatttttgttttgttgaatccgtcttctttgagttctcttccgatcccgaaaattttcgtgccttttcttgacttggtggccggagaaagagtggctgtggtgggagtggattttttttttggggggagggattctgggttttcaccccgctagggcacgcatgtgcgaggtgacgctgcccacagcacgcgtgcccggggattttggtgtcgcacgctccctcgcttggaccagggtccgcgcggctttgcttggggccaaggggctctgctagggcgcgcgaccatgctccacgcaagcacaaatcctcgctggcgcggtgtagcaccggtccacgtcactgcactgtgagaggcctaagggcactcacggtgcaagcacccactgtgagttaccataagatgacagctaggacaaagagctttgaagaccctctctttacagtgcaagcaccacgtgttggacccacaaatatcttctagtgggacccacaaacccccaactcctcaccggccaaatccccaaatcctccacccccaaatgccactcttccccgctggctctcccttcctgccttcaccggtgccggctcccctcctccctccgccggcgccggctctcctctcctctgggccgagcaacggcatcgtcctccgggccgagcggcggtggcggcatcctccgggccgtgcggcgtcgtccttgaagaagtggcagagctcggcatcgacgggcttgacgcgcgtgccgggg

SEQ ID NO: 64330 - DNA, 4340 bp, Oryza sativa
  unsure (1)..(4340): unsure at all n locations
cccctccctctctgtccgntgcccctcccttctccctcccccactccatcccgccgccgntgcatccatccctccaccgccaccatttttgtttcttgggagctcctcggcgagggcgatctagggttttctctagcggcgtcggcgcgagggcacggggcggcgaaggcacgctgcccacagtgcgcgtgcctcgcgatttcggcgtcgcgcgtggattcgcctcgacaaagtttcgcattgctatgcttggtcacgagtttccgtgtttggtcccgggtgcacgcaccacgtcgacgaaaatcctacatggcgcaacaaggttccgctccacgtaggagcactgtgaaaggcctaaggccttgtttagttcccaaaaactttttctcaaaaacatcaaactgaatctttggacacatgcatgaagtattaaatatagataaattaaaaaactaattgcacagtttgcatagaaatcgtgagacgaattttttgagcctaatcagtccatgattagccataagtgctacagtaacctacatgtactaatgacggattaattaagattaataaattcgtctcgcggtttccatgcgagttataaaattagttttttcattcgtgtccgaaaaccccttccgacatccggtcaaacgtctgatgtgacacccagaaattttcttttcgcaaactaaacaaggccaaaagtgtgtgatttctcactgtggccttttcttcacatgcgcgtgcatcgaaactttaataatactactattaaattttggtattatcaaattttattaaaataagattagaatatataagtgatgtttagtttagttaaggccatactaattttggtacacccttcaacccaatataaatgcatcctagtacggatatcaacatatcctagtaccataaatctggaccgatattctttccagatttgtattattaaaacatatcacatccatattaggttgcacttatattgacagagagagtagagcttttgaggtacgtacaaaggtgatgtttagcttatttggcaatgcagatccaatgcaccggtgatcgggcccgggtgaggaggctgaagctggaaaacaacgtcgagacgatgtagttgaggcggtacggaagatgggtgatcctgggtgtatgtcacgtagagtggatcggatcggcacagtcacatcaggggtgtggggaaggagatcggtaggctagatttgggccggtgccacgactagttggtgtgccttgaggattttgacaggtgtggaagtggcggcagttgggagatgatgcatgggtgctagcgattgaggtaggcatggcagttgtccgagttgacttgtcctatgtagcattcctcttcatctctagggagctcctcctcctcccatgttatggtcgatccctctggtcgtggggagctagattgacgagacgatggcggtagtggtaggggtaagggatgctccggtggcgtggctttgcgggatctggcagaaggcggcaatggtcgcactgcagggcaacaaatcttggtttggtttggccggtggtggggcaacagtacggctaagatgcgtgctagcggagtttgttagggtgatggaacctaggggtggcagtggcaggtgcaagagagggtttggtaggcaaaagcctagctcgtgatttcctgagctggaaacgacaacgtcttcggacatcgtgacccccttggggcgtggttgaggtaccatactctctctagataaaaacccaatctagttggacaagatatggtggcacctaagcatagtcattgagactgaaccagtaattgaaccggtgaggctcttggttcgatggttcactggttctaccggttgaaccattggtctaacccagttcaatagttattaaatatattattcgttcctttaaagcacaagaaggatgatagcctagtggttgatgagcttcctccctcacacgttatactgtgttcgaatccgtcccaagcctattttcccctcattttcccccgactgctcccttgcttgcacatactcccacacatagcatatccagtcttttaaccggaccgacagaggctctggttccggtttttcccggtccaatccggtcttaataattgcgtcatgacctgccaagaggcttaggagatcttcgtctcttgccttgcctggaggctcaagagatagagatcttcgtttcttacctcgccttaggtcggtcctcgctagtttctcggttgtcgtcttgtgtggtttcggtgttcggcaagacgtttgcgaccctccttaaggtctagcagtgattggtcacgcttagtgatgtccggctcagtgctaacgcttttctcctaggttgtgtgaagagctgctagcaggtggtggtggtgtgtttgtttgctttttcctggttatagccttccagggctataattttgtaatattttttctattatatcaatatgaaactacacaatgcctggtgcggttttttttttgtaaaaaatatttggtaggccaatatctttggcaagttttggcactaccaaaattagtagcatagagtttgtagttgtatgagcaaaaattgatagcaaaacaatcatgcataagatactattggagttgctaaaaatttggtagggcaaaagtaggtctcaatccaaacaagctcaaagttctagagattattttggtaggattgtgttgataatgttatgtttagtttgttgtcttgctaaattttgttaataccaaaaatttaaaaaggttaaaaatgtcaacaaagttaacaagccctaaagtattaatagcatgtttttaccaaggggatactaaattactaatggcttggcctagttttttctcttcaactacaaacttcaactttctcgttttctgttagcacttttttcaaagatgatgcgtttttttaaaaaaatttctatatagaagttgtttaaaaattaaaaaaaatccattttttaagtttataattattaatacttaattaattatgtgctaatgagctttctcgtttatgtgcactaaatatgtttcttttggagaaggtcgaatgcataggattatttgttttctcatgttaggacgcacgcacactgcaagcaatgcacatgcaggtgacaaatctctaactttgctaaatttctactggtgatggtgatctatgttacctcgatacggggatacggatacggatacgcaatacggtgatacgaggatacgtcatttttcaaaatattaggatacggggatacgtgtatatatttatatatattaaggaaatagcaataaaataggagtgttcagccaattccgtatcaatcttctccaaattatcttttctagataattcaagttggcgaattcagacaaaaatcaacacatgtaaattgatgcatcgtgcttacaacatcaagtgaagtgccgactaggcaagtaggaggacccaacacctaccgatcgaccaccaccaatatcaagatgttacttgcccttgctttctcttgataaatcagcagctgcatgagcagccgcgctagcactaggattgctagatgcacatgcactagcctgagcttccaaatccaaaatccatgataatgcttgactacttgtagcaagaagataagaaaaaaaattacagatcaagcatgggaatttggaaagccaagccagaagaggagatttggctcacaggggaacgaagagaagtatactcgtgcttccacggagccaccggcggttgcagcggcagcggcgaaggcggcggcggcagcggccaaacggcctccgcctagcgttggcgcgggcaatcttccgctgcacctagctgcgatgctgttccgcgtgtggcgatgacgacagcaccgggaccacgtgtggccacgagcatgaggagcatccggaagaatagcagatggaaccatatcaggaacgttcggaacgtatcggcgaagtatcagtgtttttctatttaattgaaaatcacgaaaatctgggatacgtacgggatacgatacgtatccgtatccgtgcgagtatccgatacggatacgtgacttttgtgccgtatccaggtaacacagatggcgatgataaagcaaagaatgagataggccttagcagatgaaaccaatcggtgcctccaagagggattgggatcaggtgcaatcccaactacaattgcacgtgatggaggctgcagtgttcatgttgttacaatggaatcttagtctgacaatactctgaccttataaatgcgacaccagatattgctgggaactc

SEQ ID NO: 64331 - DNA, 1617 bp, Oryza sativa
aagactaacccgactgctctcttgaccctattctgcccaccgacgattgacgggagttggaaacataacacaaaggggatctggggaggaatatgttgggagttgacctcccagctaaggaaaccgagggtggatcactcaacgcttattcccacctgatcgacgctagttgttttcttaattacaaattacccacattgattggtagagcctaatcttttggatttcttttgatctccctcaatgcaatattaacatgggagtatgctcttgttagaataattgggctaggcccaatttatcctattaaatctcaaaggcccataataagtgttaaggaaaataataccacctcaggatttaagcgaggaatatcttaacctaaatagggggttattggaggcttcctgttgactggttgaggtgggggtcggaaagccacgcgcgcgcgcgccgggcgtgggcgtgggcgtgggctaggcgtggctggcgggcgtcacgtcgttattcttttgcaaccacgaacccacgttcccacgactgccttcgcaacggcgcgtccacgatcccacattgcaaccacgaacccacgttcccacgactgcctccgcaacggcgcgtccacgatcccacgttcccactactacctctctcctgatagataaggaggtcgcgagtccgatcagaacgatttctcgggtgttagttcctccttcgtttctgatcgcttgcacgcacaagagattggaaggagcagggcctctggaatcacaccttcgcctgagatctgcaccggtaggtgggtgatcaggtttttggggagtgcttcccgcacgactgctcgtcctcgtccaccatgtctgcgcctggagctgcagacggagatggcgcgcctggagctggagccggagccgcaattctgcctcacaatccagcggagggccattctcggggtatatccttctcctgttgttagcgttgttaatcctgttagtcgcaatgttaatcctgttagtcgcaacttgctatgttcctgttcctgatgttcatgcctttagcatactggttatgttatatgttcctgctcctgatgttcatgcctttagcatgctactggttatgttacatgttgtcactagatcaccctacactattcatgccatgattattgtcttaatattttggattaaaatatgccgatatatgaccatatttccaacaatccaaaaacctgataggtcattttcagtagttggctttgctgctgcactgaaaccacatgcttttgatggtcctaattataagagatggaaagcacgtgcactattgtggttgacagcgatgcagtgcttctatgtttcacggggcaaacgaagtgaaccacctctttctcctgaggaagaggctaagttcgaggcttcggattgcctgttctgtggagcattgatcaatgtactcgctgacaacatagtggacgtgtacatgcacatgccttccggaaaggacatgtgggatgcacttaaggccaagttcggagtttctgacgccggcagtgagctgtatgtcatggagcagttctatgactacaagatggtcgatgaccgttctgtagtagaa

SEQ ID NO: 64332 - DNA, 1951 bp, Oryza sativa
tttagacttgtgtttgagttcaataaatgtgtcgtatctaaatatgtgacttttgttggaaaaggctatgacagcggaggcttcttccgcttttctttgaatgacatgtgtaataatcataatgttgtgaaccatattagcgagaatgatgagtctaatgtgtggcattcgcgactctgtcatgtgaatttcggttgtatgacacgcttagctaacatgagtttaattccaaaattcactttggtcaaaggttccaagtgccatacttgtgtttaatcgaaacaacctcgcaagcctcacaaggcatctgaggcgaggaatttggcaactctagaacttgttcattttgatctgtgcgaaatgaacagcgtgttgactaaagggggaaagaaatatttcatgacactgatagatgattgcactagattttgttatatgtatctattgaaaacaaaggatgaatcattgcattactttaagatctataaagctgaggtagaaaaccaacttgaaaggaaaatcaaacggttgaggtctgatagaggtggggagtatttttccaatgagtttgcatccttttgcgaagagtttggaattattcatgagaggatgcctccctattcaccccaatcaaatggggtggccgaaagaaagaactgtactctaactgagatggtgaatgccatgttagacactgcgggactttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggagtacccgacatgcatgttggtacaatttttgagtctagagatgctacattctttgagaatgaatttcccatgaaacatacacctagcacctctagtcaagaaactgtcatgccccatgagcactttgtaccgatagaacacaatgatcaaacgcctgagggaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtatgcagtgaaatagactcgattatgtctaatggtacttgggaagttgttgagcgtccatatgggtgcaagcccgtaggatgcaaatgggttttcaagaaaaagcttaggcctgatggtacaattgaaaagtacaaggcaagacttgtggccaagggttatacccaaaaggaaggcgaggacttttttgacacatattcaccagttgctcgcttgaccatgattcgagtactacttgctctggcagcctctcatggtcttctcgtccatcagatgaacattaagacagctttcctaaacggagatctggaggaggagatctatatggaccaaccagacgggtatgtactagaaggtcaggagggaatggtgtgtaaactgttgaaatccttgtatggcctcaagcaagcacctaagcaatggcatgagaagtttgacaccacgcttacatctgtaggctttgttgtgaacgaagctgacaaatgtgtgtactatcgctatggtgggggagaaggagtgatcttgtgcttatatgtcgatgacatattgatctttgggaccagtctcagtgtgattgaggaggtcaaggactatctgtccaagagttttgaaatgaaggatttgggagaggctgatgttattcttaacatcaaactacaaa

SEQ ID NO: 64333 - DNA, 1151 bp, Oryza sativa
ttaatcctgttagtcgcaacttgctatgttcctgttcctgatgttcatgcctttagcatactggttatgttacatgttcctgctcctgatgttcatgcctttagcatgctactggttatgttacatgttatcactagatcaccctacactgttcatgccataattattgtcttaatattttggattaaaatatgccgatatatgaccatatttccaacagctctctcttgaccatcttatccctaacaccaaaactctaacccgatcacttagctgctggagagagaagatgtggttatcttggacagtgtaggtggaagccagagggatactgccaccctagagctaaacatcggcaaccactttgtttgtgccactgctacaactacttcgcctacagacacgaagggggggtggtggagttagcatagaggatattgccgcagcgaggttagtgcggagaaaattgcggcaacgggaattcggcgcgtccgcgcgtcggccaggttttttcgtgatttcaccgtaggatccataagcacaactccttttttatattagtataaatatatgctttacaaaatatgtggagaaagatcagaaatcaaattttaattttttggcaggaaaacgatgaggctttcaccggtcagcactgtctagttgggcccacatgtcaggcgctgctttcctgtcaggcgctcctagtcctatctgaggagagtttagcagcaacgcacagttatggacgtgttcgtcaccaccgccgaccccgacggcatagcagcgcttgacgatgacgcgctgctcccggcgatggacgtgttcgtcaccaccgccgaccccgacaaggagccgccgctcgccacggcgaacaccgtgctgtccatatatcctcgccgcgggctaccccgccggcaaggtgacgtgctacatttccgacgacgcaggcgcggaggtgacacgtaacgcggtcgtggaggcggcccggttcgcggcgctttgggtgtcgttctgccggaagcacggcgtcgagccgaggaacccggaggcgtacttcaacgccggcgagggtggtggtggcaaggcgaaggtggtggcgagggggagctacagggggatggcgtggccggagctggtgcgcgacagga

SEQ ID NO: 64334 - DNA, 1194 bp, Oryza sativa
tgcccagagagaaacacactcccttataggcgagcaaaatatttttggaagagataaagctaaaaatgatattgtcaagatgatttcagaagctgctgaatctaattctaataccctgtcagtgcttccactaattggaatgggaggtgtaggcaagactgccctagcaaaactggtatttaatgataaatcaaccaaagataagtttgataagatgctatgggcatctgtatctaatgcgtttgacctaaaacatattgtaaatataatcatacaatcagatagcggtgaaagcaataaccaattaaccctagaagcattaacaaagaaacttcatgagcttttaagggacaagagatacttgctagtgttagatgacatatcaaatgataatgtcaactgggaagaattgataaacctgctaccgagtggtagaagtggatgcatgattttaatcactacacgtcttacaaaaattgcatcagaattgaagacattagaaccatacgaagtgccaaaacttccacatgaagaatgcaggaaaatatttgttcgatatgctttcagaggagaaaaggcgaaggatagagagttactaaaaattggagaatccattgtacagaaatgtgatggccttcctttagcagctagaacattgggatccctattgttcagaaaagacatttctatgtggcaagaagtaaaggaaaataatttgctgagtactgggaaaggtaaagatgatatcttgtcagtattaaaactcagttatgatgcacttccatctgatttaaaaacttgtttttcctggttatccacttttccaaaggactatgatattttcagagaacttataataatgtattggatggcaatgggtctattgaatccagctagtcgaactaaggaggcaataagagtgggagagaaatactttaatgagcttgctggaagatctcttttccaggactatgtttttaatcatgatggcagcatctcacattgcaaaatgcatagccttgttcatgatctagcaatatctgtgtctcaaaatgagcatgcaattgttggctgtgaaaattttactgccactgaaagagttaagaacctagtgtgggaccacaaagacttcacaacagaactaaaatttccaacacaactgagaagggcaagaaaggctaggacatttgcatg

SEQ ID NO: 64335 - DNA, 1512 bp, Oryza sativa
attatgtatcaaccatgttgcctcacaataattgtgtcgataagaacatgctttagcgataagtatttgaattcatgtgaccagtcacaactatcatgcactcttaatagcatcactacacactctagcaaactaaataaaatagagtaagtgaattttaaagaaaatatgattgttcaacaggccacaacaataaataaaccttagtcttgttcatacctgattgcatccttggaacatgtttagtttcttgacaaggggcaagaaaaaaatgtggcgacaaaagacgacacagcagcaaatcctcgtgagcaatgccaaattgatccgatagagaccacttgaaagtaatctcgacgctttactgttactacaaataataaagttctccatttcatttgttctcgaatccttgatattaggccatgatttggcctgagttgtttaagtacgcatgtaattgtagctaggagcttatcttgaaggcccatcagtgccataacagtttctgccagccattgatgcaatggccctatgagcagaacaagcatgatcatttttctactccctccatttcatattataagtagttttgacattgtatcgatctaatcagatttgtttaagtttgaccaagtttatagaaaaaaaaatatagcggcatttccaatacaaaacaaatatattcgatattatatttaatggaactaatttggtgttatagatattgctaatgttttttaataaaattggtcaaacttaaagatatttaactgaaaaaagtcaaagcaacttattataatatgaaacaaaaacagagtactaaaaggaaagtactagttgtcttcctaatgccattgaaccagtggtgacactaggaaagacaattagtgctcataatttgatccagaaattaaaccggtcgcatcggtggacaataatcagcgccagtgttcttcctaatattctctcttatgcacgaaatacacactaatggatcaagcattatcctatctgatttttcggtgaaggggatttcgaatctactttccttgcggtgggtaggtagcgaggaggaaggacgaaggagcgcgccgcgcgcgtacgatagacatggggtggggagagacgggctaacctttgccgccgccggcgatgcgatcgccgctcgaacaccacgcgaaagggagggagagaggcagagaccggacggctccgggcgccgccgccggcgggatccatccatctccggcgggaacaaccgcggatcgaggcgccgagcaggggagcagcgagagagaaggcaggaagaaagggaaggaagacgagcaaactcctcgcgaaccgctacagggagatttctttggtaaaaaaaaaaagtaaatttcattttggccatatatttttacccatgttacagcttgggtcaggttttagctgagtttttcaccttggaccacttcatattaccatttgtttcaacctggaccatagccgctcgtcttctccgag

SEQ ID NO: 64336 - DNA, 1385 bp, Oryza sativa
gacgagaacgagcagtcgtgcgggaagcactccccaaaaacctgatcacccgcctacccgatgcagatctcaggcgaaggtgtggttccgaaggccctgctccttccaatctctcgtgcacgcaagcgatcagaagcgaggaggcgagagagcagcacaggcgcggaggaggaggaactaacacccgggaaagaagcaagcggatcgttctgatcggactcgcgacctccttatctatcaggagagaggcagtcgtgggaacgtgggatcatggacgcgccgttgcggaggcagtcgtgggaacgtgggttcatggttgcaaaagaatagtgacgtgacgtgacgcatgcacgccagccaagcctcggctcggcgcgcgcgcgcgtgcgtgtggctttccgacccccacctcaaccagtcaacaggaagcctccaataactccctatttaggttgagatattcctcgcttaaatcctgaggtggtattattatccttaacacttattatgggcctttgagatttaataggataaattgggcctagcccaattattctaacaatccccaccaaatttcatggctcataagaaatgttctcaaggttgttcctgtttgatataccagggttttggtggagactgttaagttgaacttccacctaggaaatgagctacatcagatcacaactgaataatggactatgccttgaattgtcagttttgtgtgatctggtttcactcagatccttgactggtactgggctgtcgttcgcatcccctctgttcggagcatataagtcaaactctaggcctttcatgagtatctagagatcgcccaaacctcatagactgtgactagcagtcgaactcatataggtgtgttccttctgagatgttctgcaagtcaacatctctgcttggaaaagccacccggatcacattaaggcatgagccatcctaccatgcgggaaagaagagaagtacatcatgaaaatgagcccttttcaagggtctcttctctcagtcacacaatagtttgtttcgccatccaaattcacaagatctccgatcacaatggacaggtttccactattgtgcaaccttaggtgggtatcaagcccatttccctcgatgcactatctatcacattacgtggtagccccttggtaaactgatctgccagatttctagccgtttggacatagtccaatgctatcactccggagtttttctgctttctgacagatttcagtcttctcttgatatgcctagatgacttcatgttgtcctttgaactgttcactttaataatcactgtttgattatcacagttcattaggatagctggcactagtttttcaaccactagcaaatccatcaggagt

SEQ ID NO: 64337 - DNA, 1258 bp, Oryza sativa
cccctgtgatctaaaaattggtccctaaggaaccccggaagggctgccatccaatgggtacacgaaagtgacgaagttgctttgactactgaaccatgcctagatcgttggagcaaattggatgatcgggccgagggctgccccctaggtccttagttgtcaactttatggacatagaagatgttctgcttcaatttttttttacatttccaaacttaattatatttttgcaatgtcacattcattatgttgattcaatgagatttttgatgtgtacaaatcattacaatatatttctagagtcaactattataccaaatacgaaatgttctgtattccgggtattgaaacttcaggttttgttgctcagtattgaaaattactggttttgatatagtagaaggaaaatctaactacggaatttcaatcataaatttagcccatgtttgtttgaaatagctgggggcgtacacatactcaccgttatttctcgcttaatgttgctgtgaacttgtgaagcttgatggctatattcaaacagaagtaccagatttccagtctacctgatacttgagatcaatggtagattgcttctatccactttactgccataacatggtgctaattctcatcaggaacaccaagatatacattatacagtactgaaactatcatgtcaacaaaaaaagagaaaaacatgtagtatttaaatatcgatctgctgcatctgcactaacagatcaagtaatgcaacaagcaaaagttacttgtaccttgtagaatctggtttggtgcttttgaactcttggtgaagggacaaggaagtctgcggtagtctgaaaatgcaagtgcttaatgtttgctgaaactgtcatttgtagttcagtcttagctcttagggcagcttctttgggccctattaatactccctgaagcttgctctttcattaacaaaagcatgtcagtcttcctaattcctcccctttcttcagataatatacctttgagaatgtaagtagaacatcatcttctttgacaaaaaataataatggaaaatagaacctcataggagaggaatacagctttgcttgctacaaggatcagacttttcattccaaagaataagacacatgtttgagaacatatgggccctgctgggctaaaaaattttcctgggcctacttgtcagttgtcaatgcctgttcataacactcttagaagttagaacattcttagtttattatcggaagagaatttg

SEQ ID NO: 64338 - DNA, 2137 bp, Oryza sativa
aattgctaaaaaaccgtcacagcaaaaaactttgaaatttaactataatattgttgtagtgcaactataatataattacactatagttacattataactgcagtgtaactatactgtaactatatggtaatttttatataagttaaatataaaatcgcatatattattttagtacttatatacaagtattttatagttatagtatagctatagtgaaattatattacaattattggaattatattatggagtagttatgtgcagtttttttagatagtcccatgcccgatggatccaaatcgaaaaaaatactaccataattgaaccataaacttattttaacataaaattatatatcggaatttaagtgaattatgtcctaagtgtaaaaaaataaaaataaagtaaattttatgaaaccccacataacatagttacacaaaatcaccgggattttggcacgtggcacgtaaccttatgtattttcacaaaaccacactattgataaattttgctcttatctatcacactttgagttttacaaactcatctcaaaaccacaacgtgttttgtccatcgtataaatattacatccactttttaaaattttaatatatgagtacatcagaatggttaatgttatggttttgtgaaattttagaaccataatacccaatttgtgttgcatgttaaaatctctatggttttacaacttatgtaacctgtaacctgcatcatgataggtggagttttctgaaatttactcgaaaatttatatcgagcggaactttattttcactactacaatacctattttcctatgtgggcattttgattatctcgtgcagtagtccggcccgtctgcagccgggcgtctgggaaaatcggcatattcacgtgcgggcgacccaacttcacgggataatcgattatctcgtgcggtcgtgttataccgtcctcacggaacaaaaaaaaccaaaaataaaaaagggtgaaaatcgccgccgcccgccggatccgggtgggggcccgcccgctcgccgctgcacaggaagggaggcagtggtcgacgtgcacgacgaggacgacctacaggagtaggtccgccaccgcgcccggctcgccacctcgccagcccgacagaggggaaggggaggagggaaagagagagaggggtagttgagggagaataaaagggaaaaagtaagagagaggatgtgaaaaatttgaagtagatgggagggaaaggagggggtatttttctgtgcggtccacttaaaaagcctgcatgggaaaatcgattttttcgtgcgatcggattaggaggcccgcacggaaaaatcgattttcctatgagggcgatagccccgtgccggttcctttattttcccgtgcggttccacttatgaaccgcatggaaacaaaagggggcggcttccaggaaaatctatcgtgaagtagtgtttactatgtgagctcgatgaccattgctacatggtcccatatgtcagtctcctgtttcctttctctctacctcgcggatttgctcctcgtctttctccgctctctcgccggctagccgctacccggtcgccggcggcggccgccggcggagatggatgctgcgggcggcggcggctctagccgtcgttcaccgggagccatccagtccgcttgtcccccttcagccaacggcgagcgacgatggcggcgaaggttagcctgtgactcctcatctccccctctctcaccttccctccagaccaaccgcagaggaagtggattctgaatccaatctgtgcaaatcagataataaaatgctactagattcatttctgtctacgaatttctcgcaaaagagcgagaaaattgatccccaaaatagatactctgtatagtgactcgatccgatttttatttctggatcaaaccatgagcggccgatgtgccatgccatcgctggctcagtggcattaggaagagaattagtggtagaaaatatcatttcttgtgttgtattgatatatgacctcattatcattatcagtattagtatcagatgagcgttttatcggtttaagtgggtacagtactagctcccttggtaggctcattttgtttgttttccccgcccgtg

SEQ ID NO: 64339 - DNA, 1441 bp, Oryza sativa
tttttagaacaagtaataataagcaacagtgcacacggaattgcagagttccatggaatgacggaattccccttgcttagtttgatatttttcgcaagaactgagcttgcgcttttgaagcaacagtgtagcacaacttcaaccaccatggtggttaatttataagcgtatatcatctgcatgcaaacatatgggtgaagtgaacaagtgtgcaaatgttttgaatattatcactaataaaatgtgtagtaaaaaaacaattaaagacaagtaactggattatggattgataatggaagtatggaccactctaaggtagatgtacttacttctatgcccaggttttactggaatattgacgcctttcagggatctcaattttcttcagagaagaaaatctctggatgaaatctggcaacttcttgaattctttgcagtcactaaccttcaggtattcaagagtggaagcagctgatgcaaagctatctggaaaggtctcaaactttggaagccccacaagttcaattgatttgagactcttcattccacccattgcttcctttggttccatcaaatttaactcatcacagttatgaatcaccaatttctgaagggtgactaaccggttcatgctagaggggagagagggcaaatttggacaattgaagacaaatagctctctaagtgcactgaggctgccaaatccttctgtcagtgatgttaacattgggcaggcactaatctgtagaaataccatggaagtccaacccatgagggcatcattaggaagatattgttgcttagatgtgaggattaagtacctcaagctgacaagtcttttaacatctcttggcagctcctccagttctttgcaccaagcaagttgaagtgtttgcaaattcaccagcttacacagagaattgggaaggtatttgatcttcatattccattgcagatctaggtatcttaggtgcttcaaatttccaattgaacttggtaactcctcaaactcaacttcagagaaaaccaagattcgtaggcgtgtaaaggttgccaagagatcttcaagaaaggatttgctcacagtaccatagttgtgcctactcgcaaatgtccttgccttccttgcccttctcagttgttttggaaattttaggtcctttgagaactccttctggtcccacacaagatgcttaactcttttggaggcactaaagttttcacagctaattgttgcatgctcattgggagatacagatattgctaggtcatgaacaaagctatgcattttacaatgtgagatggtgccatcatgactaaaaacatagtcttggaaaagagatctccctgcaagctcactaaaatatctctctcccattcttattgcctccttacttccactagctgtattcaacagacccattgccatccaatacattat

SEQ ID NO: 64340 - DNA, 11877 bp, Oryza sativa
  unsure (1)..(11877): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtttttcagaaatttggctaagtttctggtcggaagttcactataactcgctatatgatgctcgaggtgagaaaaaataaatatttctcatttcttatagtgcgctatcagatttggtgccttgtactgttatacatccctttccctaataagaggaaaatacccattactttgcagatctccctagcaaatacaagcctaggaagaagcactggttattgttttagtaaccacgcgggagctttgctttggacatggattttattgcttggccttttggcccctcctgatagttggagcttggaaccctgaagagtggaatcctctgtggttctcttccttgaagcgctgaatgggtttgccggatgcactcctcaccacagtacatacagcattagttatactataatactgagagaatttgagattgcttccttgtgaatatatacccatagggaaattactgacatccatgttgattgtaaaccatatttgttcattggtatattctgtatacattttataggctgctaggtctcttatcattttattcattccattttccccggacaattcatctgatttcaatttacatactgaatgtcttttgtcagtatctagtaattcaattcatacgccttgtattatgtgccgagtatatttttgaccgatccttatgcatggatgcaatgcaagattagtagttgaaccaactaaaccaaagcaatgaacagagccccggcattgaagtgagtaaggccctgtttgattcagcttaggattattataatctagattattagaaataagctgaaaaaaatagatagcttattatgatagattattataatctagtaatccactctaaatgtgcttattttagattattgggtggctaacagctaacaaacagcttataatccagagaaacaaatagctcacagcttattttatatcggtttattataattcactttacagtaatttggttcaataatctatattacaataatctcaaagagagcctaaatctctgtgagccttgtgtttagaatttgctttagggggagcttcgcaaatgtctattgaagtaggttgttgaatgatctgaacgatgctaaccgcacaactagactaaactgagatcgtgggctgtctgtagcacatcctaagttccaaacttgcaagtatttcgctctcaccctgttcgttttggtgaggaattattctggactcaaagttggtcgcttttcgtgcaagaaattctcactggtattgttgcttccccgatagcaacttgagatgaatatagccgggtcggaaaggaatcgagcatgggatcctgtttgggacgttttgatcctggtgatggtgtagcttgtgtgaggtaaaaaataataataataataataaactcgaagcacatctgcagttagtaatgctagccttttgtgagtgggaaagctagaaaaacttgcaagcatagcccatgggctatggcctatggcccatatcatatggctgcatgtcagcatccaaatcaagtcacaaatacaagccctcgcaatttgcaaagcatatgcatgcgtagctacccctttatatactacacacttgtaattaatcttgtacgcagtattatcatcccatatatatatatatgaatatatctacatcatacaataacgacataggacaaaacaaaaggaaaatgaaaaacagcgatcctactcatactctggtagtagcaccaaacaattccggtgtcaaagctaaagccaagcgcaccttgtcgtcaagacctcgacgaaaaaccaggcccatcatcccagagtcacgcacgcagatgcgcgcagtcacgtagtcagcaactccggccccggccaacggcagccaaaccactttaatttccattccaccgcacatacaggggatacagcacggtcgccctccccttcccccacgcgttcggctttcgcgcctctatcggcgtcttcggccggccggcacccaccacacgcaccgtcgtcacatgctgttttacatctctgcaggcaggacgaccactgcgcgcactgcgtcgcatggcagcgccatccgcgctccacgcgtggaaggcgaacgcgacagccgaagtggccacacacgcgcacacccctgatgatcacatctcagaccgtgcgtgtgtttctcggtcaaaacacgcggttcatcgtgcggatccgtggactccgggaggcagggagggagggtggccgccggcgagcgatcgatccgcgacttggcgtgccgggcgggtgggcgggtgttggtcaaagcgtaacacggtcatcagtcatcacgaaccaccactggtaaagcttggggtttggggggccaacgcaacctccgtgctgccgcatttgaggaacgacgagaagacgcacgtaatccagaagtagtggtacagtcatccagttgcttggtctcaacatgggcataacaattattggagcacaggatcggtattatttcagctaagagagttggatcttgtggtaattggagacttggagtatatgtactccaaggcaaatccaattgctttggatggtgtccactggaaatccagccggagggccgcgtcagaatcgccgtagtacgtcaattgagtttttaccgatcaggtttacccttccatgtatcacacatttaaacggaccaacacatccacatgttcttttttttttcttaccgtattttttttttaggaaactctagcggaaagaaaacaaaaactaagaaaaggtacagctaccgccgttcaagtgaccacgctgatggcatccccatcctgcaaacttgcaaagattctaattcgaatgtcaaatacaatccaaatcagcgttgccaacttgaacacggaagtgaccaaactatcttctcatctatatcttgttcatcaacccttttacaatctctcagacaagagcttaaagaacgaaacatgatggggtgtactgagtagcacgtgcacacgaaacagtactaaaatgctccacgagaaaattcattcttgactaacgcaatcatgcacggaaagatggacagatcaagacgaaacctaacgcaagtaacgtgaaacccagggatgccacagatgttcaaagctccgagtgtacagcgtgcataaaacgtcaaatagtcacttgatcagataagaatcgtcattctttttaattaaaaagaaacaattcctgctgattgaaggaccgcaggatcacacatcgctacatgaattggaacaaaaactttgaccaattttacaagacaatctttctaattatgcctttgatcaaggcattttcgatgttccatgcgcaaaaaatctcctgctgttcttgtacaggatcctcgcacaactcgacccctaatcgttagtgcgcctctacactccctttctgcactccaaagcaaagcagagttttgacccaaaccaatttatgttcagaataacttcgatggtggccgacacagccgaagcagatttctgaaacgccgcactttcgaccatcatgcgtggagctttgggttgcagcggccatcatcagctgctgtcatttctcatttgtatagcatctcgtctgactgtaactgtaactgtaaccccctttgttgtctctgttcatctcaagaacaacacctccatcacttcacagttcacaccacacctctgaagataattaatctgccagctgaaccgtgtaaccccggacaacggcgacaagtgaaccagtgcatttatacgccggtgccaaactgccaattatggacagggattgtgttcgtagaagtaggtccattttagactgccccccacttgctgccaaatcttttgaagcaacggtacctgcggcagatgagatcgatcggcaatcaaaccattcaatccaccgcaccgaacactgttgcttccaccgacaaaaactcgcgtggcccggagatcaccgatgcactgaaccgtggcatgaattttccatgtaacttgggacaggatgattgttgttagctttgcttgacgccggatggtcggtttcggtctcgccatagctgtggttcgtgtgacttcaggagaggaggacatggacggaggcgttcttggtggcggcgcagacggggcaagcgtcggcggcggcctcgcaggcgccgcacaggcacaggtggcggcacgggagcagcagcacggacgcctccgcgacacggcatgccttgcacgacgtcgccgtggagaccgcgacatcggcggcggcggcgggggtctcgaagcagcacgagtgggcgtcctcggcgtcgccttcccccgcggaggcggcggcggcggcggcggcgcagggggactggaggaggagctggtcgagcgtggcgcggaggccggcggcgacggcctcgtggctcttggcgacgcccatccacgcctgcccctccgcgctcacctggcggagcttctcctccagctccgcgttgcggcagcgcgcgcgctccagctcggcctccgccgcacgcaccctccccgtcgtggcgcgcgccgcggccgccaccagcgcccggacgtgccgccgctgcgcctcctccagccccgcgcgcatccgctcggcctgcacgaacatccaccaaacaccgacgccgatcaaacaccactcaccaaacacaaacaggggagtccacggttaacggagaagccttcttcccatacctcgagccgaacgagcgcgtcgatctccacgccatggtggtagagctgcgaaagaaggccctgcgagattccgcccgcaccgtccatcctcctcccgctggtggacgccgcgccggcgcacgccgccctgcccgccacatccccgaagggcaagatcccctgcagcggcgccgccatcgcgtgcgccaggaccgcgcgctggtcctccaacagacccgccgccacgcgcggccgcttcctctccacgaacccgtactcgccgttgtcgccgccgaacaccaccgcgcccccgatcccttccaccgccgccatgggcggcgcgcactcgccggcgagctcgtccaggaacagggcgccgccgctcgccgccgcgtggaggtcgtaagggaaagcctgggcgaggcgctgcgcctgcacggccatggccagcgacacgatgcgtgagcgcgagctttccttgatgagatgagagggcggagaaggcaaggaatggcgcgcgcgagttgggtgagaagcagtggagtcagtggaagggatgcgtggaaacgaatggcgaacggcggcgagcgttttatatgtacccgctcctacggttggggaagcagtggctcactggcctgtgaagagaggcgttgtgggtaagacacgtattacacgctcctgggaaggacaaagccacaaaaggcgtgacaaaaattcaatatgtgaaaatactagtactacggtaaggactactccctccgtcccacgataaaagggattttaagtttttatttgtactttttgatcgcttgtcttgtttaaaaaaaattaaaattattgtttttttacttgctttattatccaaagtaatttaagcacaacttttcgttttttatatttacacaaatttttttgaataagacgagtggttaagtagtgcaaacaaaaactaaaaatcccttatattatgggacggagggagtaacttggtataaaaccacggtagtacaaactaaaaaaaaacctattttattaaattctaatgaaattattttttactttacctacttccaatatgattattagctgatttcacaatctccaatgcaatgattactaaaagatgaatttattttgagacaaataaaggcatgtaaagactattgtttcaggcttgttttgacacggtttcaaatgcaaattttttttgaaagggatatttctaactttacaaatttgtaaatctagatatgtgattacattaatagtatctgaatgatttttttttattttgaaagaaatataaaattttcgagcactttaatttaatttacaaagtatttatccgatttaggatatgtgtgttggaagagtgtgtactggtggttatatacttatgtacgtgtggcgtttgtcttgtgtaatgaaaacgtctcaggaaaaagaaatagtgtatcctgcctgttatcttggtataatacgccttacctactagcagtatgtgtgttcttttttttcttttgagatccagtacatatgtacgtgttcttgttagccgatcagagtacgctcggtaggaaacaggtgagcggtgaaaatgccgctttctccctggaagtccatggcatagcgcccgccccagacactttctaggcgcgcgaggtcgacgcgatcgaagcgcttcattcaaccggcagcgccgtaagccacggagatgcgcagtttaaggacttgtttgtttggagagctactagctattataacttctctcggaatctgaagctccctaaacagcctatcttttgattcagattttgagaagttatagttttagattttagaaaataacttctctggattctgaaactaaggcctacgctgcgcagcactgtgcagcgtcttcccagcccccacacctcacggctcgcaaattaatcaacggaatcatggccagggaggagtggaccgtggaattcaatggatgggcacgttgcgtttgcattataaccggatctagcgttgtctgatgagcgatctcttaactcgtcgtgaccccggaaatatttagtggttaaccacatctctgtgctgcccgtgccaatacagctttttgattaattacctttggcggattgggtttactactagttcaggcgcgtgcatacctcattacagtagtaccttgccccccttgtctcccacatgtaggtctgacggttgacggatccgtcgaagatctagctagcacatctccagatctagaactacaagaacggtgatcgattaatttccgtaacagagctgaactagcagcatatatagtactcctatacgtaccccgagcaagcagccgtacgtacagttgcagtgcaaaacgatccaaagacaatctgcccaccgtgacagcagcagcagcggcagctatacgtacgtacatcgcacgtacagcgcgcgctgcggcgtacgcagtccgtgcttgtcttggcaccgatgaagcttagcgagatactccgatccaccacgcacgtacactgcaccgcgcgcgcaggctgcagcttgttgttgtacgtcgtcgccacgcgcgccattatattgatggctcgcaccgaccgaccgaccggccggcacggccctgaccgtcgagccggccgccggggaggactggctggtggaccgcgcgcccgcgcgagctgcagctgctgtacccaactagctactacccatgcatgcaattgcatggggacacgcattaagattcgagcagccgtgcacgcgagccgcgtgatcaccctgcctgcaccctgatatactgctgcctctgggcctgcctgcctggccgtgcacacagctgcatgcaaaaacacacagtatatgtcagccgtgctccagtaggcgttagcgttacattacgtacgtaatccatgacattgtcaatatgctaatgcggtaatgccgtattactgtcatctgctaactgcgatgcatcatgcgctgtggcgctaccacgtagtagtacggtgtacgtgcagcgcgagtacgtcagcgcctacgtctccggggggagtcgatcggcgaccgactgatcgatctgatcgcgcgcccgcccgtaatgaattcgatcacacggtcggtggccccgccggcctgggaaagctaccgcaaattaaagcccgcccacatccgatccccctttcgtacatactccctccgtattttaacgtatgacaccattgatttttcgatcaacgtttgatcattcgttttatttaaaatttttgtacaaatatgaaagtatttatatcatgcttaaagaacatttaacatttgatgatgaatcacaataaaataaatgataattgtataattttttttgaataaaacgaacagtcaaacgttagataaaaaattaacggcgtcatacattaaaatatgaaggtagtaatacttatacctgcggctgtccaccagaacacacggactaaccgatcaatataagcatgcacacgcatcatggatggatatatggattggtgtactgcgtgccccgtcgtgcatgcattactgcgtacgcgtacgttcctagtagtcgatcgtagcgcgcaaagcatggccagatctgcgagtctaatggcaacacgcatgcacggccgtcggggtagagagctatagtatagtagctagcttacataagctatagccccatgaccacatcacagtaaacgtaccacatacttccagtgaacagtgtcacatgccgtgtggagtcacgtatatatgcgcccgcgtcgtgcacagctagcttaacagccgcatatatatacatgacacatctatatggcagctgcattgcacagtttcagcctttcaggaccatggctcgtgctgtgttggtccggacggctgtatcatgcatgcgcgcagtaagcagggtccctgaacctgaacgtacgtacggatagcgctgctgccctatcgactgcacgcatcggcgcgcgcgtgtgggcatatgcatccagcgctttctctgtttacgctgctgaattttttatgtttcgaccctttcttaaaacttattttacaaataaaccctttctctaaaaacttattctaaaaatggtccatttctcaatgacaataacccttgacaccaaggtctaaaaccaaaaatattggtgccaacaccattacccccctagcagccgaggacagatttgtaatatatttttttgagaaggaccattatgtaattaccttttcttataaatagatcctcagcatcatggaggctagcattgaggtctatttgtaagaaaatattttagtttttaatcatttttgaaaaagaatataaataggtcctcggtattagtttccttggctcgacccacttcatatgagcgacttaggtaatagggagtgacgagggtgtcgacgccaattaatggctttgatgtcgagaaagattgttaatttctaaaacaagtttttcaggggattatcataaaataagtttttcttataaaaaaaatccaggttttcctgtttggctcgtcgtagccagcgctagatggtccaagctcgccagtcgtgagctctgtttctgtgagctagcgctagggcacggcgccgtgccagtccatgctgtgtacgtacatggaataaccgtacatattgacatatcgatactcctacattgcgtgatgaacggtcgtattcaaaaaatctactgctccctacatttcaaaatgcttaaaaaagttgactttttagtaaatatttgaccgttcgtcttattaaaaaaatttgtgaaatatgtaaaactatatgtgtatatgaaagtatatttaaaaataaatcaaatgatatgaaaaaaaataaataattacttaatttttttaaataagacgaatggtcaaatacgtactaaaaagtcaacggtgttaaatattttgaaacggggagagtgctattattattggatatgctccgagcagtgcctagttaaccaaacaatatacttggtaaaccgagcacacgaattttacattattttttaaactgtagcaatgcatcatagagcaaagtgaatagtagtgcctcagtcattaatagtatttgacgttgggagtataagcttaatgacgggagataatattcggctagttaaacaaaaattgcatccattggctattttttaaaaaattaagatacatagtttatctcatttgtgttatacgcttttcaaactcgtaagtatatataggttgttttaaaatacaagatacattcattttaagtttaaaaaattaaaaacaaatttaattaattatgcgatgtgacatcccttcaaaatctctaatactatgggaccggggagttgcaattttctcattttatgtttccgtatttaatcttcattttaagtgaactcacacaggcctggaacatgatgcaattaacgacaggttttttttttttttttgcctcgttagacttgagcatggactagcaaaagggctcacggatcacggactcaggttgcttgacatcacaaccccaggaggaggttggcagccaggtcctctctcttttctctctcaaccttttcggttgccatcagatcatccgtacttcccccccacaggcacaggcacactgcaaatgcctgcccccctgcagacgacgtaccagtaccactgtggcactgtcccatattattgcaatcgatgccaacgcccaagtcgaaggcatggcatcacattggcatatgcacccccccctactccaccatgcaactctcgtctctcaaggcgcggaatggccgggccaaggaggagagctggcagatcagatccacgcatggtgcatgacttctgcttcgccctgtcgtttggtgagagtagtaaagagaaagatacgctttcacttttctgtgatgaggagaagggggagggggctcatcagggcccaagtttgtagggggggaggaggaggaacagtctgcgtgatggcagacgaccagatactatcgctgcttgctgctgttgctgccgctgctttgctgttgcccggactgatgatgcgtggtttgtttcagatggcttgttgcgaggagtaaccaacagtggccgtttggggagacgggaaaggtttgtaaaaaaggctgtgcgctacgcctgctgctacaggccgaatttttagccagtaggagcggtgcggcgggcacaggcatgcgatcgatgcgatgcacaggaggagcagcagcgcatggttcgtcctgctctgttccaactgcgacatgcgtagtgcagtgataggactaggagtattacatactgtgtgtactcttctcagtattttttaatactagtacagagaaaaaaaccttgctctagggatctttgcgctggtaaactccaaagaaaagtcacaaaatactccatacggaccgggaatcccaggtacgccgtacgcgcacacgacggtctgcacatttcataaagtggagtgagtgcacatttcataaaaatacagctactagtagctaacagtgcttaattgtttcatgacaaaagctatacacgaagccggtcgcggaccacagcatcacgtcctgacagcgaacctcgtttcctagtaaatcaatacactattaacttatcggcagcgggacatctgcaacctgtggtcctccagtgcttggagtggcatctagctaccgggacctgcgttgcacgtttcctggcgcgccatgaaccatgccggccacaccaaacacgcacggatggatatataaacaactggggccgcacacacacgctctgtctctgtctctctctctgtctctctctctctaatttcttgcacgatagtataaaaacggacggtaacttgtgggggccatgtgagcatgcgacgggctgaatcagcgctgcatcaaagacgacgacgacgacaacaacgtcaagggggggcacggcgagcgacgacagctagcctagcagcactaccggataa

SEQ ID NO: 64341 - DNA, 9932 bp, Oryza sativa
caacaatgactgtgaaatgtattgccgtatcgtgatattataaggtgtacaaatgcaagaaagagaatgatggtgaaagtaaaaaaaaatcattcttttaggaggacaggaaacatgtaaatcatgtccacatgttttgtagaatagttcacccaatagcggaatatatattttaaaagagcattatttcatttttttttgtctagaaacctatcttgtaaagaaagtgaaacgcgacaaggatttgatcaaatttgaggtgtctcgggatttgttactcatccatataatatatcaaactaaaacatgaagttgcgaatcgtagagcacaagagcaccacaataaggaacgacgaatccttaaattttctatatatattttttaatgaaaatttgagtaattgttataatgaacctttttagtatatttttaactagcatggtggcccgcgcagattgcgcggctagcatcattatattttctctcatataatagtatatatgttttctcattatattattcaaatatattaaaatgacaacataattttaaattttgcaataactttacaaaactactaatgtgtaatattcatattatattttatatatgtgttagttattaattatttttaatattaaattttagttatttgtaaattatatatattcctatatggactctagactcgtcttttaatatttttttaattccgaaatttctgtaaattgtatttctatatagactctatgctcttcttccaatattatttatttttatttctgaatttttattatttctaattgtatttctatgtggactctaaattcatcttttaatattctttaatttttaatttcgaatttcagttacttctaaattgtattctatattgaccttaaactcttcttcacatgtttttcttaatttcgaattttagttatttgtaaattgtatttttatacggactctaaactctacttttaattttattatgtttattctaaattttagttaattttaaattcctgtatggactctatactctacttctaatattccttatttttaattttaaatttatattatttcctaattgtatttctatatggactctatactctacttctaatatttcatatttttaattctaaatttcagttatttcctaattgtatttcaatatggactctatactctatttctaatattcattatttttaatttcgaatttcagttatttcctaattgtatttctatatggactctatactctacttctaatattccttatttttaatttcgattttcagttatttcataattgtatttctatattaactctatactcgacttctaatattccttatttttaattccgaatttcaactatttcctaattgtatttctatatggactctagtcttctcttctaatattccttattttttaattccgaatttcagttatttcttaattgtatttctatatggactctagtctcctcttctaatattccttattttttaattccgaattttaactatttctaaattgtatttctatatggactctagtctcctcttctaatatttcttatttttttaatttcgaatttcagctatttcctaattgtatttctatatggactctgctttttctttttctccgattaatgtgagaatttctagaccatgagagcgaacgtggaggctcctttttctatttctttaataatataatagattgttagattcaaccttgtcctacttttcagttaaagtaaacatcctgaaaaaatttagtttggttaaccatcgtaagatgaaggtattcgaatttaattttaagttttaagacattcacttctcaatcaatcacaatctcttcacatttaattctacctactctaaaacttattttttagatggaggtagtacatttcataaccgaaagcatgaaaacagtctacccaaaatttattcaaccttgaactatcaagacctttttatttaaactttaccttgtacaatattaaacttctggacaacatggttttctttgtaacggtttttacaacctgcacaatatagagcctgtttggaggggtagccagcttctgagaatctggaaaagctgggtttctagcttctgacttctaagtcattttctgtattatacagctacagtttcctagaatttgaatcaaaagatagattgtttggtggagcttctaattctagaaaaagttgcagcagctagaaactcctataaacagacccgtagtactaacgatttggtacacattacatgtggccctaacagttttttctccaaaagaacttttggccaagcccgcatcttgttcgtggcccccacatggctcccatctcccggtactgatcccagaactgaacacggacaccaccaccaccaccaccaccaccacaccggtcgcttggaccacagcaccacaccacacgacacgtcttggcaccacgcatcgccatcacctccctcccctgatccccccccccccctcccccctcttctcatgtgcgtcgcggccgttgcatcatgggataggaatgatacgatcggccgcgcgcgcgcccagcgaacgccgagaaaaaggcgagcggaaacgacgaaagctacacgtacgcgatgctgccagagcttggctgaggcggacagaatcggccacactgtgcgtgtgaacggtatcgtcgggggcgacggacggaagcggcagcggtcgtcgcgtcgcgccgtgccgtgatctgacgcgcgcgagcgagcaccggctgttggggggggggggggggggggcccctttagctttccggcaacggggacggacgggggcaaattgaaaaccatttgtggcttttgcttctcgcgtacgtgtttttgtgaagcgtgggaactactaaccattgtggcatcatgggcgtccacgggccgcagcgcgcggcagcgacgtgagccgatcgatcgaccgcgagcgcgaggctttgtactcttgccactgtggtgtggtccgccactccgccgtatggagaatagtaacatttgatctgttagttttcaatagggtgatgtatttcattttgttttcgcaaaaggaaaaagaaattgtttttcactagcttgtttcttctcgacaagtgtggaaagtatctatgtctcgatgtgcaacccaacattgtgaaaatgtttctttttctagataactattcaaatcgtaaaataggttattattactgctgtttttttattattactactattattattatacttatcgtgccaagatagatatgccaaactttataatttctggccaagattaaaatttatgttgtcacaactctaccggtggaaatatgatacacgagttttatatcactcccggttcaatatttaaaatattacaccgtacaaatcaacgcgggaaaaaaatctacaggttagtttagtttagaaaaacttgaaaagtagcatttcacggttattaaggggtgtttagattcaggggtgtaaagttttgacgtgtcatatcggatattatataggatgccgtatagggtgtttaggcactaataaaaaaataattatagaatctgtcagtaaaccgcgagacaaatttattaagcctaattaatccatcattagcaaatgtttactgtagcatcacattgtcaaatcatggagcaattaggtttaaaagattcgtctcacaaattagtcgtaatctgtgtaattagctatattttagcctatatttaatactttatttaggtgtttaaacgtttgatgtgacagcgtgtaaaatttcaaggcgggatttaaacagaccctaaatttgtatttttggctttttaggctatttgggtcgaagctggcttgcttggtcgggctaggctgctctttaacgggcctagtgcctctactccgtcccaaataagcacagttttacaccgttcatatcaaacgtttgactgatcgtcttatttgaaaattttttacgattgatattttaattgttattagatgataaaatatgaatagtaatttgtgtatgactaattatttttattttttttaaataagatgaacggtcaaacattaaacacgaatatcacagctatacttattttagtacggtggtactgctaaccttcattcattcttcgccgggaaactgttcgttcattaattcacgatcttcagttgcggacgatgttctacagccttgtggctttccatcaccaaggtgaaaatggactgttgttttctctgtataatactgttggtttttgttttgtcagagtgctcaatcaaattgaggtactgtacgtagtactatactccactcctccgtccgtggagtagtcagctgggctcatgcagctgtgcgtactgccacgtactgacgacgctgtcgacgtgtctggcccggtcgttggatcgctggcacggacgcacgcaattatctgccctgcaacgggcaccggtgtagtactactacctgccgtgtggaccagaaattaacaacgatttcgatgccgtctcagctagtatgcggatctggcaccgcagcagccgcagcagcagcaagcggcgccccaacgcgacaaaaacaaacaagctagctgcgcgtcacatgtgccgctgctatctaatccgtgccgacaccatcatggaattaatgccccggcagttccctgctcaatccatggatggatgcgcgtggcccgaatcgctcccgcgaactggaaactgttttaatcattcaatcactcgaatagatgtttatccgagtaattagaatccatttcccctacatctacgtactccctccgtcttactacccgttccaaaatacttgttacttttaagttttttttatcattcatcttattaaaaaatatataattattatttattctatttgtaacttgctttattataaaaacactttatgtatgacttatattttatatttgcactaatttttcaaataaaacgaatggtcaaacgttgcgaaaaaaaaagtcaaagcgacaactaatttgagacaaacgtagttttaaaatataagggattttagatgaataggagtatgaatagggattttaaaataccaaaaatctaaacagactctaaaatactattattaagatatgtcatatcctttaaaatactccatacgtacttacgtagtattaagctattatggaacatggggagtactacgtacgtatgatgttgcatcgccgattccggggaccatatgcacgcgtgtatgcgaagtcactcccgtttacccgtgcgtgcacagggcaattgaatggtactcctatcttttggagaggggaaaagaaagggacgcttgatgaatgcactatgcaaccgtcgacttgaaattgttgcttttgaggccatctcacgcattacgtcgcatctggcctgcaggccgtgatgatggaccgagcgtacgtaccgacgctgcgatcgacgcacgcgtgcacgtacatttcatcaacacagccggaagtcccccgagcgaaatttccggcgaggcacacgtgagcaagctagctagatcccgcaccggccggccgacgggagcgtacgtgcaaaacagtgccgttttatgagatcgcggcacgcagcagcgtcacgggtgtacgtacgacgccttctcacatcgataaataaacttaacctccgtgtcctttcgagctagccgtatatctcatgatgggaattgtcagggtcgatccatttatccactgaacctatccgtaaatttgttctaacggatttatagggtcgctctaaaaatataaatggatcaaacggatcaaaccattagaacctaaggttcaagagattcgatccaaaatgacttcacatgtataaatgttataaaaatttatacaaagttgcttcgctatataataattcattcctacaaaattcaactaaatttaacaagtttttatagtgtgaacgcgagtttaaaaattttggatccgagttttacatgtaactagaatttttgggtcttagcaacgcatcgtgggccccacatgtatgaagggctcaaaatttacacaaagttgcttctctgtgcaataaattattccaccaaaattcgactgaattcgataagtttttatagtgtgaacgcgagtttaaaaattttgggtccgagttttacacacatataactagaatttttgggtcctagtaatgcatcgtgggccccacttgtataaagggctcaaattttatacaaagttgcttctctgtgcaataaattatcccaccaaaattcaactgaattcgataagtttttaaagtgtgaacgcgagtttaaaaattttaggtccgagttttacccaaatgtaataagagtagccgatccatttggatatccatagataacctattgatataatggactcatggtggaccgaccctattaaaccatggatcaacgaactcacttaaaacggtttaggttcaatccatatcctaaccattcccatcctgatgtatatctacataggagtatactgtggtgttcttttcttctaaaaatgaagattaagtttttttagcaaaacgatgtgatattaacgtttgattgattgggttttaattattaaaacttgaaaaatatattaagatgatattttagagcaactttcatataaaatattttcgcacgaaacgtaccgtttagccgtgtgaaggcacaaataatcttaatctacatcttggaaaaaataacgcgacctacgactccacggagcaacgaacgtttgcattcagggatagttcgatttgaccacactttgctagctgttgctgcgcttcgtcgacatcatgcatggacaatacgagcatagtgcacgtacgagagtacgggcatcgtcgcatcatgtgtgtaccagggccgcattgaatgtcacgcaatcacgagatcagatcgatggcccgtactgtacccggtgactgcatgccgccgtgtgataaggtttccaaagttgaagggacatgacggctatgacataaatatagtaattactccctccactccatttcataatataagtcacaacctctttttacatatttcataatataagtcatgcatgcatgtggacaattaactattacccattctccattaaattattactttttttaaatactctactctcatgttctctaattctattggatgcatgtattgtatttattaggatgattcaaattataagatgataataattttttcttagtctttggattaaggtggttataccttatattttggaattgagggagtaattaattgggactgtgttttggagctactcctagccaccattccaggtcaaaagtccaatgatatatggcctacatttcccgcatctatggtgcatatagtgactggatagaatgacggctgcataccgacgagtatgataatcggtgctactactcctaatttatgtggttaaattacgagaaatgctatatgatggtatttcattccgatgtataggatgatactatctggtaggtatgctgatattccgttcgaacgtacgggtaatgcctctgagatatcgtttgatagtcatctaatttattatcccgtccaaacaggatatcgtcgtgtaacattttcctaaattattcatgacaatatagtgtccgggtgtactgttgatggttgaaagcttgaggctaggagtgtctctaccctcttgcgagagggacaactaatctttttatgatttttaaggattgtcgagagatgaatgcagtgcttgaagcaaaagccagaacgaatttatgcttgtttcttaattaatttaaacaagtgatctggatgctgatccaactcagaatttacaattcatctctgtttatgcatccatagttgttctagctagtagtggcatctcgtatatgccaatattgaatatcacacgatagctggtcaaaacatggattggaatttattttataaacatataggagtaatataaacaagcatgccgttggtttgtcatagtactgtccaaatattgtactacacagtacaaatttaagacacctgctaaagggaatcaatcatttcatccattcaacactgtcaccagatctgagatctcttctttcgcatggcacctcaatgcaaatcaaaatcaatatccttgtctccatatggtggcaggagaacaggtatagcttgtgtactcagccttcctcttttgtccaggcttaattcaatcattatatgtacatatctttgtccacactattttccaatgaatgaatgaaacgatccaaacaaattaattgacccaacaattcatgtcagtgtcactgaccatcttagctagcaggaccgtgcgttttgctatgcgcctatgccatgatataaaaataaaactttaaatgattcaatcgacactttttagataaaagagatttcaccaagcaaataaaaatattaggtttctacaacaaagtgtaccactacttaaaaaaaaaggaacgtacatgtcggcactatagatgccagaagtgctaaaaccgacacttataaaccttttcccacctgcacgggttgaaataaccaaaaaccgagagaaaataagtatcagttctaaagaaaaaccacctataatttattataggtgccagtttataaaaccggcacccatcttaagcggagccgagccgagccgagccacacctaccacacttaaatttgccttatctatctactgagcggcagagcccatctctctcgcaacttcatctctctctctctctctctctctctctctcccaatcgaggaggcggatgcaggcggcaaggcgatgccactactctcggaggcgagccacggggtggctggatccggcgtcggcggcaagcggggtggccggatccggcatcagcagcagacgggggtggatggatccggcgtcggcagcacgcggggtggccggatccgacgtcagcatctgttcccgcggcggatccgcgttgacagcgggaatggtacagcggcagcgtaggtgggcgccctcctcagcaagctaccgtggcagcggcgggcgccatccccggtgagctacgatagcagcggggctcgcacgtgcatgggtggatccggtgacgacaggcgccatcctcggtgagctacagtggcgggcatgcaatggcgaagttctcaaatcagtgatttgtattatatgtttgtgattctgttcttgccttgtgatggttgatgttgattcttgtggttctgttgttgatcttcaatctagatgtgttgattgtttggggattattcattgtatttcatgtatgcatgagtttgggggtttggagcttgggatctatcgaggatatgcttgctcgatgcattggctcgattcgatgcatcgagccgttttctttttttttgcttatgtgcgtctcaaaggtaccagttgtggaatcgtcaccaataacctagggtcatcagtgccacctccgtcgtgccggttggtacattcggcacctatgagggtttctgactggcaccaacagtactttctgcagtagtgtactcgctagtaacacaatctcacgggcaaaagatctaactatgccacaagctaaagaatatggtccccacatcgactgtatcatgttcaggcctaatcttaaattaacactaattgcaccactaaattaagttaaggcccaacaaacttagtccactccaccaatgcaatggtttcttatctttaaactatgctgatcacatatggatcagagacgtcgacttattcacggtcagagaaaacaaccacaattagagaagtacagttgggctgcagg

SEQ ID NO: 64342 - DNA, 941 bp, Oryza sativa
cacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctcccctttatgtaacacttgaaaattttgatatagatgcctcacacagaatctttgttcagcatcagaaaactcccttctcacagctggaacaagcccctggaaacgaattataaagaattatagttaggaactaaaatgtgagttatgtatattatgaaaaaaatcagacaaagtcataccttctgcctatcagtcatcactgtccatgcagatgtattctcaatgccaaggtccttttttagagtgtcaagaaaccaactccagcttttcaagctctcaacttcaactactgcaattgcaatgggaaaaatacagtcatttgggtccataccaacagcagttaggatatggccaccaaattttgttttaatatggcatccatcaagacaaatgataggtctacacccaaacataaaccctctcttgcaagcatcgaatgacatatacaaagtatggaagcaaccaaaatgtaggttcaggtagaatgagctccctgggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcagtgtcattttgtcattatctctaaattcttcaatgtacctttttgcaagatacttagctgtgacgaccttgatctcccactgtttagagcaggtgtgcttctctatatattccctt

SEQ ID NO: 64343 - DNA, 2919 bp, Oryza sativa
cttctcaacccatcacttaattgtttgccaggaagcaaccaataaattttggtgttatcagatttctcatatcctagttcttcaatgaaatcatcaacccacaacagtgaccaagaatctgactcacaatggtcaaaccagtttactctaccatcaacataagcccggtttacaccatttcccataaaaaagcctccgtggtgcatctcaatgctgaattcttcatcttcgtaatctacatatgttgtgtacagataattattcatcgtcagaacagtttactttaggttcagatgtttaagggtatatccatgtttaagggtatatccaggaagaaagcatagttaacaacagaaactagcagtacattaatgatcaaattgctctccaaaaatacaaatttgtcgtgatcacttctataccataaatgtcaacaaaaattacagcttttgtgtaccatgaactagctcctggcataaattaaaacaactaatagtccttcttgtttgcaatacctaataaatcgacaataagaggaagaaatctctacaaaaattggaattgagaaagacaatctcatttttgacctgataaactaaagtactcactgtatacatgagatcgtgcaccttcacttcgcagccctggcaccatgttgcctcagcgccggcggcaacgtcctgccaccgctgccctaaacgtggccggtgtgttgtctcccagaaaagccctaccgcctggatccaattcgcagccttccaccttgatccaaatatcaatctcctgatttatctccttttgttgctaactcaattggaggtaggctatcgtgaaactgatctctagcatgggcatcatcgtgggctacaacacaaaagaagattcggaggaattgaaagatgtatgaggggttatttgcaaatatgtgtagccagctcgcgcccccataacgtgtgtatgcgctgatgtggcatcctaatctcaagccaactcaataagattggtgatgaagtcatgtcttggccttggttcgcacgcactacgcaagtttgtgtaccgaaatgagagttttttaagtttttacactaaattgcacccaccttacaagtttatgtaccgcgggcgcaatttactttaaaattatcatgttcaggatgtacacaatagacttcaatcccgctatctcagacaggtatctaggctcaccaccagcgagctgcaatattgtgatgacacatgttacccacgctcaatgatacccacaataatctaaagatttatacagcctcattttttcacttatattaattatacttatcagctaaaaattaaattttttatccttaaatttgaagttgattttagagtttttttcatctaaatttattttcagcttttatttttagatcgctaaagttttattatatacagtttggcttattcagccaaatgatgatgccgtatcacttgtcactactcgcattatagacacaattaatccctcaagaactaagctgacatgtcgaggcatcatgggctgcagagagcggcgtaagcatcaacacccgtcaacccgcgctcttgacacaattttttatgagtttacccagaatttcggcaatatattatgaaattaattatacccccaaagataagctaaccaaatctcaatccattccgggccttgtggttttgcccacttgcccttacaattaaaaagattcatcatatcttccgtacattcgtatgcacaactgcacaagcagtcaaccaaagcgtactcttctttaatatcgccggtaaactactagcgtggctactttattcaagtcataaggcatcacaaacatatggaccacacaaattgatctcattacatttgcgtataaacagggtcaacataagcccataaatattttacaaggtttaagagtccatcatttagaaaggtcgtctgtagtcttctattagcaccgctacttttgagggcttgttgagagtgtagtggggcttcgccaccaccttccctctttatagaaacaacattttagtagtagtttttcttttaccttagcagtctttttgtttttctctttgttccttgtcctcaggcaatgaccgtccggccaattgtgttgcgtaacaaaaactttgatttcctctaatataccaacgtgcaatctttttaagcgttcgcgaaaaaaatttaccagtttctaaaaacaaacggttgttactgggagaatcttcgctgtcaagcctaccgaaaattaacgctaccgaaacaaatctgaaaacatgttttaaaccatttaatttagctatttgtggttgttaatccagatgaattgtctagtggtagttgatatatattaccaagtacgccaatagcactacgattaattggagagttacgtttgttagatgacggagcagccacgaattttgtagctagtgcaggtctcgcaaaaccagagagaaattgagaacccatgtgttcccagtcaaatgcatgcacgccaccatggatgctctgctcaatttgccgccatcgcaatttgcatcggggtcacttgttaatcatagtactacagggagaataatatgcggtttattcggtctgaagggaaaaataaaggatttgtattattaagaattaatttctataaatgtcatttgatttgtaggaatgaagtactacctctgtcccataaaaattgaatttctacctttgaacatttatccaataaaatttgtatttctacttaatatgggatccaataaactgattatattttcttgtaatcttcttttctttcatcccatctctaactcattgtcttgacataacttttaatcaagtttatatatggaatatgtgcatgtactgtgcttattaaatagggttattgtagttgg

SEQ ID NO: 64344 - DNA, 1778 bp, Oryza sativa
ctggttgttccctgcttactcgatcgcttgcttgcttggttggaccattttgttggtcctggaccattttgattactatgcaaatttgcgagatggagacgcatacacatatgggggcacctaaaaaggcaaggctggactaatcaaatataatggtttggctatttctcctatgcccctgcatagggacaaactctgcatattgaatggagtttggattgatggtggggtggccctgaaatgagaagatgatatatctcagatcttagctggacgtgtcgagagatatgtggatcgctgattgagaagggtgcactcatgcatgcactagacactacttgcaatgtttagtactacagtgtgtggacaatgctggcctgccggggcactttcacatgatgctgaattaactttccttgtacgaagtggtccaaggctaaaaataacgagcactcagcagtggatcatatcatatactccatatgctagtagctactagtactagctggagtagagttgcatgatggatgggctgaaaatgagaaacgtgtggtgatcgagatgagtaatggagctgtccagtggtaccgtccatatcagggatatcatggcacagacagggtgtacaatactacattgacttgtattacaccataagaaaacggtaatggaccaacgaccaaaaaaccctgcccatcacatgacacgtcaggacgtacgcatgcgaagttatcatatccttcaaccgcttccattatcatcagagaactgtacgtgctgcaaacacacactcatggcgagctgcaaatagccaaatactactcctggatacagactgtcgtcatgttagcgaggctcgtgaaatcagagagatggaaacatctggatcgattgatcgataggtattcagtgtcatcagtactcaaagcagcctaattgtcgacgatagacattgtcgcatgactcgcatgcatggatcatcattcatcatgcagtacgtagtggtgcggtacccttttgatttgcagtagcaacacacatgcacgcacaggcgcacagcaagcagcattagtacggcgatcttggcgagagctaagcttttgcatccatcgatcgatcggcacgggcaaaactgtagactgtactacgctagagaaacggacgcgcgctaagcgttcattgctggccaccgactcaattcaatcaacgcaaagggtacgtaagctgctgctcgccagtcgcctatagctagccgctgctagctgctctcctgctttacaggtttgcatgagaagagagaacactgaacagatggagatgcgatcggtcgatcgacgtgaagccaagccgccagtcactgctttgtcgatctctttccctccctcccagcagaaacgtgactccggtcgggactgtgttactgtttactccatcattgttacaggaaggaaaaagaaaaagagagaagcgaaagttgcaggaatcatgcatgcaagcatgcaatgagatcgagagagaagccggcctttggactgtttgcagcacgtggtcggtctttgccttccgaccgatggccaatcacatgcatggacagcaggcagggtctgatgcatgttcggtgcgtaattcgtgatcttgtacagtgttcgctagtacagcattcagagttcagattcctccacaactcggtgttcctgatagctaggagaagcccaaatcatggatattcatgcatggttgattggttgaaaatgtaggtgaagccattcatcgacact

SEQ ID NO: 64345 - DNA, 1722 bp, Oryza sativa
ttttcatcagaattgtcacccatgcaaaacctttgtgataccttgactgttactactaccagattttgattactctacgagtgtgtggtggggccggtatgtacgtaggatctacatcacgcatgctaatcaattcgtccactttatcatggcgttgtagtggttctgattagatcctaaccgctccgtgattagcaaacaactcgggaacgacggcatgtgcacatcatgcaaacagcggccactgtccaaggaccagcttacccacgtgatgacgtgcactgcagtgcagtccgcagcaggtcgatcgatcgatctccccatgcccccacccgtacgcttttgtttgccgcgcgcacagtgcatcgtcgtcggctaggccacgatttttttttagaaccagaaatttattgcaactaaaaacagagtacaacatattcgatcatacagctttctgatctctgaagagatttttcagagagagttggcaaagcaacttctgttaggataagcaagacacgattgataattctagtagccgtctacacatatggagacatggagtcgtaggagtagtatcttattagcaacaacggtagctgcgcaggcaacgcttgtgagttgtgcgaccttgcaagttgagcgagccgtgggccggccggggactctcgctcaagaacaaagcagaggagccgcgaatccatgtgtcaccagctaaaggatccggatgcctatgtccgcttctgaacgtacgggatcaggacgcatttaataccatctcgtcgtgctctacggccagcgagatacacacggcaatgtccccttcttacgtgaacgtatacgtgagtaggaaaaacaatagacaaagattttttttttctttttactgcaggggaacaacaagaattactacggagtacaattatttccacccattatcaggttcatttcaaccaggaaatataatattccatccgtcttagaatataagaagttttaaagttagacacggttattaaaaaagtagataaaagtgaatggtggagagttgtgatagattgagtagtggagataggtaggaaaagtgagtggtggagagttgtgattggttgaaaagagaatgttggtggagaagttatattttaggataaatcttgagagttaaaattgttatattttgagacggaaaaaatacacaaaccatggattgcgattttgcatgcaccctacgtgtaaccggaacgaccacatcagaaatgaatcgttacggttttggccttcgtatggggaaatcgggagagagagagagagagataatacagggtgtcgtgtgggcccaacgataatatcctctcgcgcgcgtcgcacggccggatccgggttgggggcccaccggaggggtttgtccacgggggaaagggagagatggcgatgcggcgtgcaggtgcgcgtgtgtggtggctttcaggaatcagtaccgggaaatgggagccaagctgggggcccacggcctgcgcccgcccccacttgtgctttcggacaagcgaaaaggttgttggaaatggctacggccacaccgcaacacgacacgatgaggtgggggttggccaatggccaggccatggctggcttgggatacagtaggggagtaatttttggctgggactttacagggaccaaatttatttcgtgcacggtcagaaaattactgcggggtcttgg

SEQ ID NO: 64346 - DNA, 1791 bp, Oryza sativa
ctattttattaagtaggagaatcgtccatcgacgcgatgtttttcttctttccagtagctctttgaagagtcgctgttgtagctgaaacgcaagattcgggccactagaagcgaaggaagcgaccgatcaacctcggtgtcaaggatagaagccatttttgttgttatctgcaagcttaagcagccaccacctacggggcataaatggcaccggacaagcaaaaacatacagcgaccagcggagagcggcaggtagcgacgcccgccgaaaacgacgtgacgaattttccgcggtcgcacgcgtcacgtacgctttgttcgccgatcactttcgccgcgaggatacatcaccacttatcacatgatcgacacgtccatctgctctcttctgctactagtactggtaataattaactcttcgacccggccgtcccggttggattaattagtcaccttaaactgacatattaagaaaatgattaacacatgttgttgctttaattcactccctctcgccttctagattaaactaggcacgatcttttctttcctttgcttcatctgtgttcagttcaacgtaaagtttagattttggttaaaattaaagataatatgatgaaaaagtacagtttagattttggttaaaattaaagataatatgatgaaaaagtactgaagtttagatacaaactcagtattactccgtggcagtacgagtagccggtaaatgtactggagtagtactgtacaagctagcgataggttccggcacgtacggcgtcggaaaccacgcgtacaacgccgaatactatttggggtccgaaacgtgatatgctccgtgtcgctagcgtacgcttcatgtcgcatcgtcaagctgtgcctgttgcacctgcacgtcaacgtgatagatggagtaatatttggatgtactgctataccatggtcacaaagtcatcgcataagctcgaaatataccgataagacatacccttatattttatacgaaagatatttcagatactttatcgtactatataaaagtattatatatctaatgatatacgagaagttatcttttaattaaagcaacactgtaaatttagaagaaaactgtattctcggaaaaatgcgttagaatcctattagataagatcttcttagtctatattttggcctaattcttcggattctacttggaaaaaaaatgatcatcgctataaatataagacctccctcgtggagaagagcatcgaattacagccataaccagagccacattgagatacaattcggaggaagccgaagtcctagtcgccgattaaatctttctgagtcgttctcggggagtcttagtcaccgattaaatcttgctgagtcgtcctcggtgggttctagtcgatggattagatcaagtcgcttctttgtccttcattgtaatccatgtgaatcctgctagcaatacatataaactgcaagtcatcttgagatttgaatcgatataactttttgtctcttgtctacttgatacaatcttgtgtatatcttgattctaacgttccatatactctataaataccgtgggaaggtataacccgtcgatagtttgttgtaaaggatcggagaaaaaaaaatgcctataggacttaaatactactccagtataaaaattcagaaagcctcattgtcgttccgggccgcccgaaattactgttaccatctcacacgattttttatattttagaccatttaaaaaacttattttatagacagatatagaaaaagttatttgaa

SEQ ID NO: 64347 - DNA, 1382 bp, Oryza sativa
tctaagttagttaaatttgctaaatattaggcgtgaaaaattatgacaaaatatgggtggcaaccaaacaatcctttaaaaattaagaaaagactaaaatgtcccttatctatacattttataaagttacagcccattgtaccttaatgcttaaaattcaaatatgcgactcattacacactaaagccccctttgattcaaaggaaattcataggaattttagaggatttcattcctatagtaatttttcctatatagccctttgaatctaaggaatggatcttatggaatcctatgaaattcctatggaatacctaatgcaatgcaagttttgaaggaattctaacatgaggtagaagctcatgaaaactttcctttgagtctttatctcttttctaattcatgtgtttttcctgcggtccaatcaaacggtcattcctgtgtttttcctgtgttttgcaatcctctattttacacttacattcctatcaaaatcctacgtttttactattcctacgttttcttgttcatgcgattcaaagaggccctaattaatcctatattttttcttattccttagtttttttatttctacgattaaaggggaaggtatttttatcttgaggcatagttagtatccagctaacaagatgctagccatacggctcatggcagacactgacccgagcatgattaacgggtcttgccggaatgcgtcgggtccgggcaggcacgatccagatctctacagcatacatactgtagtatataaagccgagtcagctcatgcctggcgcgactacgcaagcaagcccataccgcctctcactgcccctgtggacaggagtggtagtagtactagtaccgtgcttgccgtggaacagcacagcgttagcatgcatgcatatgatgcgtaaggagaagcagtactactactagtagtagagcacgctcgtacagcgcaaaacttgttgcgactagtagctgtgcgcctgtgcctgccccatggagccatcaatcccagcagctgcagcagaaacagcagcatctgatgcatggtctgaccaaggctgactgttcccccacaatcctgggccctgctgcacgctgctgctactcctccctccacctctctatactccctgcaaaaaactgcgagccctcgcctcgcagtcgcaggcaaaagcgagaaagttggcaacctgccactgccaccagcaagagcaacgaggacggaggagaggagagaaggagcagcgctactatcgctacctcgaccaaacgacacgcaacaaagcagcaaacaacgatcgatatacacacacacgtcgtggtacaagttcatgcattgcatggctatctcatcatgctgtggatctcgt

SEQ ID NO: 64348 - DNA, 6334 bp, Oryza sativa
ggtggccagccggcgagcgacagtggccaggaggaggcagtactacgttccccgccctgcggcctgccgctcgtcacgctgttcccgtttggcgacgttaatgcgcgggcgcggtggtggcggtggtgtggagagagagagagagagagacggtcatgtgtacagggtggtggcatccgcgcgcgccgagctgaaccaaccgcatcacgtgcgtgcggtgccacggccgtggtccatgacctgccctgcccgtccgtccggcctgagcgagcgcgatggtgcagcacggtcggtacgagccatcaagcgtgcgaggacaaacgagaccgcaccgtgcgagacggaccaaagagggcgcagccgcgcaggggggccgacgtaaatgacgccgtacgcacgcatcctgcctgtgccggtgaccgaggaagcctatggtgacggtttttattaacctcggtggttgtagtagtaacaatatttaaacgtccgtacgactcgcggatcttaaaaagaaagcctctccagtaaacaaaccgcccggttgaaacggaatcaaaaggcccccttgagggctgtagcgtaaccgtacgacgataaagtagcgtgtaaccgtacattgataaaaggagtatcatttgtgagccaacgccctttgcttcggggagtaatgagttgatgtcacgttggtgcggccaaactagtccagatccgggtccggggggccatcgtgatcacgcacttggcgtttcgggagacgtattcaaacccgggcgccgagcaagcatggacgatgcggcccggcaatcaatggtctgcccacgatggatgagatgggttaggttaggttgtgtgtgcgtggggacgtctgctgtgctgtgcctctcggcatctccttggcttgggccgctgaaactgcatcgaatctggagaaaagagagtaatatacggttcctatgctttagtccactgctcaagtagacaatcttgcattaataattggttcaggtaaacaccaaacaatataaaaatttataaatgcagtggtagactagatctttctgggatggcatgatttcttcctaggacgtctagtttatccccacaatacacgttgaaccggatataaatcgatcggttaggacttgggtggttcataaattacctcccccaacagcctaggcgctgaagatagcgagcataaataaagaaaagcggaaaatagagtagcgtcaacctcccagaggcgagtgggccacctttaatagtactccaccgagagggaccaccaccaccaccacaaggcagcgagcagcagcagccccactctccacatctcacgtcacaccggacgaatcaatcaccacccccgcaccaggcaacaaaaaccgaacagggaaaaagaaagggaaaagagccaaaagatttccaccgtaaacgatgaccattattgaagccgatgaaaaaagagagagagaaagcgataggccagagtgggggccatagccatccatccgttgggttgcttgctgctgcttgcctcccccacgtccaaaataaaacgaggcagacagcttttgtcccctcgcaggccaccccacctcccaacgtgtcttccatccacgcctcaccgccgtataaatataaccctccctccccctaacccatctgcctccacgactccatccgttttccatttccactcctccccccacccaactcaccatcgccattccttccctccttccaccgctccctctctcttccatggccgtgcaggcgcagtacctctcccacgcctccttcccccacgacctctatggcctcaggtaaacgcttcgttcgatcgatcgacacctcggttggttttgatcgatggcgtggtctgatattggtgtggcctgtgcagggctctggagggtgcgacggcggcgggttctttgttcttggacgaccacggcgggtgcgcgccggcgactccggcggcggccgcggctgggatagggcacacggtgctgagcgaccttccccggagcgagcttacctgcaacgacaataacggcgcgggatacggattcgtgccgaggaagagggcgcgcctggatgcggatgagtcggccggggcgttgatggcggcggcggcggcgcagcagcagcgcatggttcttccgccccatggccttgtctttcccggggatgtgcagagcagggcggtgggttgcggcgccgcgtccaccagcgggagggctggcaatgccgccggcctctcgcaggggctcctgtctcagctctatcatcagggtgtcgagatcgacgcgctcgtgcgactcgaggtacggccttgttcgagattttgatcgagcgttcgatcggttcgccgtgatgcgcgggtgtctgactcgatcgacgtctatgttggctatgcagagcgagcggatgcgtgcggggctcgaggaggctcgccggcgtcacgtacgggcggtggtgtccaccgtcgagcgcgccgcggccgggcgtctccgtgccgcggaggccgagctcgagcgcgcgcggtgccgcaacatggagctcgaggagaggctgcgccagatgaccgccgaggggcaggcgtggctcagcgtcgccaagagccacgaggccgtcgccgcggggctccgcgccaccctggatcagctcctccagtcaccctgcgccgcccttgccgttgccggcgcggccggcgccggtggcgccgagggcgacgccgaggacgcgcagtcctgctgctacgagaccccgtgcggtggcgacaacgccggcgcggatgacgcggcgtccaagacccccgccgccgcgctctgcaaggcgtgcggcgccggcgaggcgtccatgctgctgctcccgtgccggcacctctgcctgtgccgcggctgcgaggccgccgtcgacgcctgcccggtgtgcgcggccaccaagaacgcctcgctccatgtcctgctgtcctgagagccagcctggcccgcgtcgcgcgtggccaagctcctcgtcgtcgtcgtcgtcttcccccaacctctcggccgctctggcgcgccacggcggcacggcacgtgcgtcaccccacccatgtgatcttggcggacactgagcttttgttgcacgccagtagaagtcacccacaaagttgcatctagtttaggttaaatcctcttttgttattacctgtaggtttacctgtcaatgtaatcagctaaccctactttgctgtccataacccttcacccccttctacatgattagccccaacttttttgtggtaaagaaaacccccgattgtattctcgatgaaatacatgcatgcaccaggtctagccttaaaagaaaagcagtgtcgacactgtactgtagcactccaatcttgtgtgtacctttttggctggtttgcactattccttttccatgtgaaaagatgctgcaagccgagaatattactgtcgcacaaaaatctactcgtacagcgccccggtgtagaagatatcatactagtagtggtagctgcactgctgcggtgcagcgccaatgttgtcatgccgtgcttgtggttgagccgtgatcttgactagtcttgcgctgtgtgcccccaccccacgtaaatactgggcgcctcggcatcgtgtgatcgcatcggccgaacccgggtgatccgtatatgcgtgagggattacttgggctgtgtttaatccaaagtttgatctaaactttagtcttttttcacatcatcttcaatttcaaccaaaatctaaactttacacactgaaataaacacaacctgttcgttgtactgtgcactgcagctgcatgcacggccactgcttgcccacagcgcataaatggcatgcaggtacatgtggtacaaatctctgtcggtacaaatttgactttgtccggaagctccccatgtgacggactcgacggaaacggtggcaaattttaccgtgtggctaattcgatccgtggtcgcttttacttgtggtaacagggattatggtgagatgtcgagattttgagaaagtttgaggcctagcgatcacgtgtgtgcacgcatgatgcttggtcgcggaactgaaacgagcacaagtgggtgactgcgtcgcgtcgcgtctgatgtgtgcgtggaacgccgaacgcgcctgccgcgctgccagcgagagcgaaagagacgagagctgaaagcagcatatggcatcctttgtgtgtgcgcgcctgggcatgcaactttcgttttgcagttgcaggctgtcgtagtagttgcgcgtgaaacggcagcagatgagggattagattagactagattacgggtagcagttgcctccacatgacgagaagatagacttgtttggagtacttttaagccttatctctgtctacgcctgcctactctcctctgcattactcgatctactaacctttctctgccgtcgcttaagccaagccctggcgttttcggagaaagttacgtgtactgatcgcactagtagatcagtgacaagaggggtttatgtaaataaaacatgtacgattccagaactgacgacggggatgagaggggtagagagatggaaagcgagaccttcaagaacgtctttggaagtcggagctgggctatagctttgcttcgctttgctagcttttccatcctttgcatttgcttttgcatcttgtcccttgtgatgcgtgacgcatcaaggcagcagcggcaagaaacgttcaacgtatgtacaccttggaaacttgggacgggatcgacgctatcggctcgcaagctactctagccgcagcagtcgtacactcctactagtaggagtagcttttcgccctttcggctactgctacgctagtctatgacgtgtatcacgtactcctactggtcatacacgctgctagtactactactactaggaggagtaggagtagctttcttcctatacttatttcaagtccctgttaaatcggatcaagtccctgttaaatcggatgtttgatattaatttgaagtattaaagatacactaagaccctgtttagatgggactaaaacttttaagtccctatcacatcggatgtttggaaattaattataaatattaaacgtagactattaataaaacccatccataatcttggactaattcgcgatacgaatctattgagcctaattaatacatgattagcctatgtgatgctacagtaaacattctctaattatagattaattaggcttaaaaaatttgtcacgcgaattaggtttcatttatgtaattagttttgtaagtagtctatatttaatactctaaattaatgtctaaatagagggactaaagttaagtccctggatccaaacaccacctaattacaaaactcattctataaccttggactaattcgtgagacgaatcttttaagtctaattacgctatgattttgaaaatgtgatgctacaataaacttttgataattatggattaattaggcttaaaaaattcgtctcacggattagctctcatttataaaattagtttttttattagtctatatttaatattctaaattagcgtctaaacatgagcttaaaaaagttttagcttatctctacgccgattttcgcgcacgacgggcattaactgtgcagtacgcacccagctcacaactcgatcgggtacagtcatcgagcaaacgagatcttctggccggcccgctctattgtttttgccttcttttgttcgcctgcactgaactttgtcatcactggccactgcctgtggttctcttttgcgtactgccttttgtcgccgcagttgtcactggtcactgctgttctttcacgtaaactaatggaaactccctttggccccgaatgtgaaaactggagtaaaaatgtggttacaagcctcttgccgaaatttcctttgaaggatcagtgcagttccgcttttctttctcgctgaagttaacggatactcccacattatatcatatattttcaccaattcacatgtttttgattgtaccgaagaattccactaagttcctgcttttccctactttcacgcaggccatctgtgttcaattacgttttaggcagggtagtggatctccaacctgtaagatatggactcactaatgcgtccaagaatccagatataatagtcctatcaaaggagtagtcaattataaacccgagcactttgttgccttgtcacctttgtagttacgctgagcaaacacgtgacaatagattcgatcttaagatatggttccctctagcttaatctaacccaagttgccagcgggctgcaggaatt

SEQ ID NO: 64349 - DNA, 1199 bp, Oryza sativa
tagagatcacacaataaaacaccaaactgtactacagagtactaaactaaagaaggtggagtagaatagaatatagcagctataattagctagtgcccattatgggagactattatcagcagtagcaaccttttgttagacagtgggattaatcagggattaggcactgatgacaacctaaaaagaggtgtaaaaaaacttgtgcggaagcaacgaatagagtactctagttggaggtcgtcctgaagaatcccagaaatgcagtgcctggaaaaagaggttgtgcacgcttttccccgcaaagaaaagaggaggaaaagtgcttggaatgtgggcctcgcacaattccttggttgggattcttgatgggccgttgaaaaattttgcgtgtgctatccatcctatcaaagcatccacctgcgtcgatccgtgctttttttggggggttgctctcgtcgagtcatcgggacatattttctcccgtgaaaaaagaaaagctcgtttgcttcctcgtgaaaaagtcgcctgctattcgctggcgatatggccgaattctaggcaagaacacgatccgcaggagcagaatcgtccgtgcgcttttttccctcttcccctttttcccagtgatagaaaccacatgagattgttctcacgccaacttgtgatgatggcctcgacgattccttgcgtttcaaccatgatcattgcagctaagctcatgaccatgtttggagaactagtcaagaattattttaaaagctattttttagcacaagaaaatagcccttcaataaaatagctcttatttgtttggatcccagagttattttgagatctattcggcctttaatgcagcttcccatgaagaaagaggaagagaaaagacactttttcagctccacccgaaatagctccaattagcacctcttgggtgtaatagtttttttggtgggttatttccaaataactcattcttttagatccttttggactatttggactatttaaggaagggctaaaaaaaaatatccttgtattcaaacagggcctatagcgcgagagaggatcggtcgatcgagcttgtctggtcggccgcgaaaagcagcggcggcgagcgaggcgtgagtggcgtttttttttctttttgttgccccccttcactttcggttttcaccggcagaaatggcgaatccgtctgc

SEQ ID NO: 64350 - DNA, 4010 bp, Oryza sativa
  unsure (1)..(4010): unsure at all n locations
acacacaatagaaactacactctacaacccatggtttcttaaagtggaccattaataaatacatcatctctcttctttaccaatcatatttattcttcatctattatgaagacaccattatctcccaatgcaaaacttgatagtgtctagtgtatagtttcttgtgttgaagctgtgtcttgcatgagacccagtttcttcctctcttcactctctctcttaattaatatagtgccacataagctaaaagtcctacatgacaatatagttaatgccatagacaccatcctaaatggagggttgtgactgccctaagacggtctcaataaaaacgttttgagttttgcctagcatgtgagtttgaaacggtttcgagttccctaattaaacggttgccattgtgaattgtggttaaattctagaaaacaaaactataaacttccgaccctatgcaccaacaaatgatgtataaaaccatatttatgtacattaggatttgaacgttgataaactaagttacgaaatgtggttaatcaacaatattcgaccatttgaatacttcctctatttaattttatgagtcgttttcactttttttcatagttaaacttatttagatttgattaaatttatagaaaaaaaatcaagcaatattttttttacacaaaatgaacatattatcaaaatatatgaaatattagtttggctgaaactaatttcgtgttgtagatggtgctaattttttttttataaacttggccaaacttatagagatttgagtaggaaaaaaaaagtcaaacgacttataaggagtagcaatttttttgaacatgttgacgaccaaatttgatattgagataaattaatttatactataacatgtacaattttgaggaccgtcagtatgggatcggtctgaccaagcagaccaatcagacatgatggccggtttgataaataaactgcatggcggtctgtgagcaagtttaataatatagccaactactagctctaaatcatctataactaatctaatagcccatttatacaatagttaactataaaatatactacaccattaatatttggtcccacctcttatacacatataacgtattggagtccgtgttgtagctggctacaaatctgtagcccactttcttctctctcttcttttttcttcttgatatgtggttatagctagtttatagcctgctattgtacctgctctaactggcatagatcgcgtgatatcagccgcagacttcgtctcatagtataattaaagcaatttctatattttttaacttaggctcttagtcattttttttgtaaaccattggaatgaggtttttttagtcataattgagttctaaaccactagaaggtggagaggctcagtgttgcaagcccaaaccctttataatggcaaccaatcaacccacacataataaatcgatcgaattgttcttttttttcatactagtatattttgctctagttttagcccgagttagtgcatcttcattggtttatgctgtaaatcgtccgtccttcatgaattagaatccgttcattgttttgttttggaaaccttccgttttattcacattttaccccaaattaatctaaatcggtcctgccagccaagttaatatccccttgattaaaagtctctcaagattaatacggttagtgactatgcacgcaccgattatttcattgtcgtcgtgaccagcgcaaaaaaccatcaacaaaactttactgaattttattttgaaccgttacagataaagcctcctaagcatttcctctattttatattataagtcgtttaagtttttttctagtcaaatttctttaagttggactaagtttatagaaaaatatagtagtatttttaacacaaaacaaaatattaccaaaatatattctatgttagatttagtgaaactagattgatatttgagatgttgctaaaatttttctataaacttgatcaaagttaacaagatttgactaaaaaaagatcaaacgtatgaaaagatggagtagtagagatcattactagctactctcgctccaaaataaatgcactcctctaattttaggagtatatactcccttcgtcccaaaatataataacttttgtttggatgagatgtattctagtactcatccaaacaaaacttgatatattttaggatggagaaagtacttattttgggatgaatggagtagtttttttttctacaagtattgaggcattcatatgcaattatgcatcgagctaactcacgacgtccaacgagtccggacagcacgccacgaatcaaatgcacaatgatggtggatgcaacacgagtgggagttttaggaccaaactgtgcgcgccacatactgctactagcaacgctccacttgcttgacaaagcctgaagaaaaaagcgcgtttcctgatgtgatctttatttaggtctctctctcccgcatctttcatgccatgacatgcgatgctatgaatgagatgagatgagaactcgacatgcatccaaagggaaaaaaaaagataaaaaaaagagaggagaaccgagaacctctctgtgtcgtggtggagcacactgcacaccatgactcgactcctctgacccccaaaaaaaaaatggcaacaaatcctgcgtttgaggccaaaagtcgctggctcgctgctgctaaaagcgagagactgtgtgatcgatcgataaatatatatccgtgagtgtgtctgagacggatcgatcgatcgatctcatcccttccatgattccatgcgtctttttccaaccttgtggatgctttcgatcatgcatatgcccccactgaaaagctacagatatctgaattactgaatatatattgatcgatgcgccggagggcggagaggtgcatgccggccacaccggtcaccatccaccaccacagggaaatgaaaccgcatcatatgtatccatggtggtcttctttatctttacacattgcctttggctaacctgtgctgttttgctgctcgaacctttctatctacctacctatactacgcaggcagctactagctagtagtactatcaatcttagtgagggcgatgatggagatgtgtgttgtatctagacagatgagaatatcatatcagtgtcacctttgtgctttgttggcatcagtagtatggatagacggatccattttggatggaaggaactcaattcttctcgctctctccctttttttcaattcctctatttgatgatggagagagttttgcaaggtgaagctaaaggtgtccaccatgtagtgtaaagctatacagctagcaagtggaggaggaggaggcaaaagtgtagagggtcccatggccatggatgggttcaaggatggatgccattgttgccggtggcagtggctgagtggccctagagcgagcagccgggacgccattgctggccagtgggtatagctttggtcagcttccggaaaaaaaggtgcaaaagctgtgcatgcatgcgtgctgccattggtccggccgagatctcctggctccatcttttgctgctactgtgttgactgaacaagttacaagtgaacagtgcctcttgtccaggattgcaatatctttagcttctctcaactcactttccctttctgaaagcttcacggtctcctaaacggataaaacacacacgcatttggagaagtttggcatgaggctgctgtttgctgtccaaattccaatgctgttaaataaaccataaaaatggaaaaagaatagaaacgaaaaagagaagttgtcagtagaaactactagcgcaagcatgtttgcaactgatggaancccatgacaaacctggcacccataggaaggtaaaccaggcccaattcgctgaggttaacgaaggtatatgagtatacccatgcaaggaaaaagctacacgtaccaaaaaaaaagttacaaacttcttattaatgctgatgtggc

SEQ ID NO: 64351 - DNA, 1041 bp, Oryza sativa
attcggcaactgcactactatctttctctttactttctgctttattttctccttcacttcacctttccgaaagcttcaaggcttaggttaaaaagcgcacacaaacaatcacaaattcgaagtttagaacacttgaagccatgaaggtcacctgtcgctgtcgaacgccattgatacaaggaagattaacggaaaaccagtaaaggagcaaggaggagaccatgagtgttcctgtggtatacgtttagggtccttttcaattttctgttcattgaaaattatgaattggatttacaagggttgattgggaaattgtgagctggagtagttcgcattgtgtgtttcacacactgaagttcaagcggtctgacttgaaccgatttgtagcacaaaaaaaaaccgaattttgtgatggatgcacaatggaaaaaggcccatataaactactgtgggccggcatctggcccgtattgtcacggcccatttcctctctggtggtctctctcgtcgttcccgagagaacaaattccagaaatctccatgggcgattgcaggagaagaagctgagcaattcgattccttcctcccactcccactccacgcaggctccgcagccaagatcaaggcaacgaccgggaagaacaaattctcgcctgaagaaacgagaggaagcagcaaatcgccgccgattcgctcgtcggaatccccaccatccaatccaccggcggcggggggccctcaccctaggggagggggtgggtagcgcggctggtggccggaaccctatcctatccgatcggcgtgggcgagaccacctcctctttttgccgccacgcgcgcggggcggcggccgtctggttttgcggggcggatgccggtgggcgcgcgcgcccactggtctggcaggcatcggcggcgcctcgctccgcgtgccctcgcgctcccggcggcggcggcggccgttcagctacttatgtagccgcttgctactagggcgctttcgtcgctcgcgtcgtcgcgcgtcgcctttggttgtgtggt

SEQ ID NO: 64352 - DNA, 1960 bp, Oryza sativa
tttcgaaacagttttctcaaccatgaaaaatgctccttgctttactttgatatggacatttggcgtatattttttttccataaactgaacaattattttttagcagataaacacaggcagagaattatcaattggatggatagcactggaggactttgtgctgcatttgatttcacaacaaagggtattcttcaggttagaaatagaaaattgttctattccttttttggggtaaatgtctacaggttagtttgatcagtttactgttgttttcaggaagctgtcaaaggtgagttgtggcgtttgcgtgaccctgaaggaaagccgcctggtgtcatgggctggtggccttcgagatcagtcacatttgttgaaaatcatgacacaggatccactcaggtataacaattactttatcttccttctatgctcaagataagcttaaccgtgctaatatttgcttggaaatggtgaagatgggctagcaaacagaactaattaaattctcatgattgcagggtcattggccattcccatctgatcatatcatggaggtatgttgtaagaattttgattgcttcatttatgacttgtaccctgcgattgaattacaaaactaattaccattacgatgatgactatgttcttataaaggttgatgtacattgtaacggccatggcaacatagaacagcccctataaaaacaacttgatgtcaataggaaaagcttttaactcagttcgttaatcttggagatatgcgcttatattgatactggaatatatatattttatgatcaggcattcttggcctcattcttttgtgttcgaacatgttgataaacatatggtatctcagggatatgcttatatacttactcatcctggcatccccacggtgttctacgatcatttctatggcaaagatgattccttccatggtggaattgcaaaactggtattgtcctgaatccttagtgctcaattgcatatctttggcagctgccagcactaagtttcaaatgttctgtactcagatggagatcaggaaatgccaggacatacatagccgctccgcagtcaaaatcttggaggccagctcagatctgtactctgcaatcgttgacgataagttgtgcatgaagatcggggacggctcctggtgcccgagcggcccagagtggaagctggcggcctctggtgacagatatgctgtttggcacaagtagatataccaacatatagcatttctttctgctgaacatgagatatgctatttcttcagagcccgaactgtatatgctagtaccatggtaatttaatcatcttcaatgcaataccagagagcaaaccacttgcaatttatcacatgctcacagcagatagtgtaaactgtaatgcgaagtgtaaactgtaatgtgaatacgtatactgtaatgcttgtgtgcatataggaataagagagtgtttatttatagaaagcattcttggaggttgaattctctttctttttgaacttcttgcatgtgccttttttatcatctgcatatatttgagtgcctttgcagaatttcatcatctgcaggctgaccgccttcactggacctggaaatcttccatgggaaggaggactccgcttccttccatcagaagacgcagattaaactggcattcttgcacagaaacccctacatttatcacacatttaacccattgttttctaatatttacaatcagatcccttgagtgagtcaatagtcgattctgtttcagaaagagaagaaaacttgaattcttgaagtgctcgtatggaaataaatggcgggaaaaatacataaattcaggacccaattcccgccctcgccgtcatctcctcctcccctcccttcccatggaggcggagccgccgccggagaaccgccacgacgaccaccacccctccacttccggcggaggcctg

SEQ ID NO: 64353 - DNA, 3785 bp, Oryza sativa
gcccgagtcatgatcctctctctttcttgagggattcacattgtgtggagaacggcagcgatgatgttagggtgaaaaaggcgagagaagaagatgttttcttgcccctgaacctgaatgctccaattgaccctgttgccgtggagggtttactgcgagaagactgtaatcttggccaggggaaattggagcactgcactgattcagcaattgcaaaaaatgaaactgatgaattgattcaacggagcaaggggtcctgcgatggcaatacagagcagaaggaatacagcaatgagaacacagagcagcagcacaatgagaatgagggttgctattcagatgggagcacattcttcctgaatcgcctcattggtattgggtctgatatgagggtggagcaacggagtggagtgacacttccacagcttctgcatcccatggatagcttggagcgagtatttatcgcaacattcacctccgatgtttcctggtgcgtcttctctctgcttgtatatcttcctttgcttgcaacattgagagatatatgattgaattattgatgggaatacaaatttgtgtatggcctaaggtttctggattactgtaaggttccacagaacctgccggtgacgatagcatgccacaacaaggagaggtgctggagtgcgagtcgcgaaagtagaaccgctgcccctttcggaagttatcctaacctactattagtgtaagtagcaaccttgtgttttgttcagtagttgtctgtatatatatctcatgcttctgcgaaacatgcatgataatgaaacactgatgctaatgttaattttcccctcaagttacccccaattcccagaggagatagcatttggaaaggataggaagaagcaaggagtggcatgccaccatccaaagctcttagtgctacagaggaaagacagcatgcgtgtcattgtcacttcagctaacttagtacctaggcaggtcggtatctttctgtactccatgaatgtgcttgttactagaattcagttcgcacctaggcaggttctgcatttctgatgcactctttaattgtttgttctgtttgtggtgatttctgctgttattctcggtgaaagtaaattatgctttgtgcagtggcatctcataacaaacacggtgtggtggcaagatttcccttgtaggacatccacagattattcagctctttttagtaaagttgaggaatcaaaatcagatttcgctactcaattagtttcattcatagcattccttatcaatgaagttcctagccaatcatattggataaatgagatagccaagtataattttgaaggagctgctggatacctcattgcttccgttccagggatatatgcacgcaatcctcactatctggagtccaattattgcctttcagtaagtcttatttcagatagcatttgttgttccctccttttactgaagccatttcactaagcatcttaacatactaagttactaactataatttgcaaagattatcaggcaaatatactatggctaagtggattatattcctaatctaaactagacactactgctgttctttcttgaaatagttctaatccagccctattatcttactagccactatccattatttatgcagagaaaacagatattacacaccaaatcggcacataggatgtttcttggttctgtccaaacatccgtagttggtctgtcccatcggtttcatataccatctgatgctggttctaaactgaaagccctgtctgtacttcttagtaaatgccatgtgaacatgcatggaactacagaagtgatcttgaagaggaatacaaatatacctgcagatgctaatgctgtgagtgtcctagttgctgatctggataaatttaccgaggaaggtatgtactatgtacacctcaaggtttacatcttttgctaaacaaactcacctccaaaaatattgtgttgcatggttcatgtggcaaacaaatacttgggattttctgttatggtagcaaataaccatgtccaatgccctgaaatagattcagtccatcttggtttcctgcctagagaggttgcaaagtgggtatctcccctcagtgacttggggttcttcacattttctggatttatctaccccagagaagccctggaagctgcatatggagcaactaacacaaaagtgcagttgcttctctatgtatcaaaggtatgtaaaagattcttacggatgccttttcataagtcaagagtactactgtgaaattgtccatgcatatcttacagtcataaaattcagggtccagagttttctcaaatttcaagactgatccaggatgaacattttcctcttctgtgctcattagtagcatccttaaagcggtcccttggactttggcgattagaagaggtttgcaattttatatgggcaatatatgaccttgatttgataaattatgctatgcgtaaactgaattacagttctttgagatgattattctaccatattatttgtttttttttttgactaaatcaccggggggggagagattccccacctgaatttgtcattgcattaagaggaaataagttcattacaataaattgagagattgtaagggggaggagaaaatttgtttccaaacagatattacataacgatcttcatcctttaagttctccgcccaaagagctgcctcgcttatgcaacgttgcaggcaggatcagatggaggggcttttctcgctgaaaacgacgtcatgtcggtggttccaaatagcccacatgcaaagcaggaagaaaacctggcagtgaagcgccggcactcttgaacttgggcccaaacgatggaagtgcctaacgtcttgaacttgcggttgaacgttaatcatcgcccagaaagcttgagcgaacggacatgaaaagcacatatgattagctgtttcttcctcctgattgcagatgtcacattttccgtcctgaacaatggttttcttcagcaaatttccctttgtggacagacgattgcggactagtaaccatgcgaaaagtttaactttgagaggagctctgcaattccaaattagttcccaattaggcgaatgcaaaccagggggcagtcgtgcctcatagaatttttttgttgttaacctccctagctttgtactgagcctgaaaaaaaaagaccactagcagtagtttgaaggtgattgggataatccaaattcatactaattgctagctctattgtgagataatccataccgcctgttctatttacttgcattaatcgagtgtcaactgtattttccattggttcaaacaggtgttgtcacatttcaaatggcctgaaacacttgagactgattttttctacagtgagtaaaacatttttttttcttagctggaatcaattgtcatattcagggattccttacttcagatttaaaatatttgtaggtgcttcatccattgggacttcaattaatccacaattcattgcaagctttgcttcagcagctggtaaacgatgtaatcaggatttggactccgaagagtctgatccagaggtaaattttaactgtttattgaagcatcccctattctaataaacccctgcccttttttgaccaattcttcacgcacataacttttaccaattttcattggttgtcctagtggggttgctggacagcaaaccatgagctaaagaagccatctatcaatttgttgtttccaacaattgacagagtgaaaaatggggctgg

SEQ ID NO: 64354 - DNA, 2385 bp, Oryza sativa
agaattctgcagagtaacgatttagtactggacttgtcacaggatacagacgaggatatacctgatgaagatgatgagcatgtgattgagctgtctgattgctcccctgaagagaaggaagaggagaagatctacgcagagacgctgtgggagcaagtagactcttcacaaagaccaggctggccagtgaagttgaagtccagatgtttcggatgacaagttcctgtcatcgcatctgatttcaagtgcaggcagccgcacgagatctgacgattctttcttactgaagatatttgattcgattgtgatttgttagaattgtattttacaatgtgtagtatgcattcgttgtcaatctttcttgtaagtatctcaatacatctatacttgaacttcacagcgtatatagttgaagtttatttcaaaaacttttattgagctctaatctgaaattctgaatcagtctgctagtgctagggggtacatgttttacaccacagaagaatcacaaccgtccaaacagttctggacggtgtggatgcttcgcctggaacttgtgttcaccaccccaaaaaaataaaaataaaatccaccgtgtcaatccccacgccacaccagaggccacacgccacagccacaggaaacacacaagcaggcgacgtggcagccagagaggggctaagcctccaaccccacactcacagccgcgcgccgcaggaaaaaggtggaaaaccaccgcccacgcgggacgcgccgccgccgccgctcgccgccgcaccctcacgcgcagaggaggagcccccccgccggagcacctccacctgtttactctgagtgacatgtccccctcgccgctgctcgcccggccgccggcgccgtcgagcccgagcacgtacccgtccctcccgcctcgccggtgcgccccggctgtagcttccgcggcgctccgcgtggctccagccaccgcctcccgagccccattctccaggtaacccccccaccttctccctctgtctccttgttcactggctcactgcgaaatttgggctagagtttacagtgacgcgggtttctctttgatgccgcaggctggtgaccaagcggaatttcgctgcgtctgatattagagaagactactccactccgattgacgtcgttgccgatgtgaaaaccgagaaggcatgaacctgagcagctgaaattctatatcttgcttgttaggtagtgccgttttactccctcccccaacattctgaagcgtttctcgatgtcttgcagattgtggtgttgggagggagtggattcgttggctctgctatctgcaaagctgctgtctctaagggtattgaggttgtgagcctcagcaggtaccacaaccttttctcgtataccttgaaccaatcaccatatgttgtgtaggtcatcactactgagaaatgcaatttttttcatcatgttcctatatgtttccaatagcttccagtctagtcttattacctcacatttcgcaccttagcttgcttattttcgtaatcggatcaaccaacttggtctcgcagtgttaactttctgaaggtctttcttgcatgacttcttgactcttgggtaggctgtccagtgtgagctcctaaagtcttcatactcagcacaaaccatagttttgtatacacattttttattgagggtatgattattggcatcaggggggttagacaaagctttgaaaattggtgtgagtccgagaaaaaaaagagaacatgtatatactatatatctgactaccaaatctgcgttctgtcacatttgcttcacagtgtgtgttcatggcaggtcagggagaccatcttactctgatccttgggttgatcaagttacttggctagcaggtatgctttagttatgtaaatcttctgggttactggatccagcttactaacataagttcactctccaagcctagtagtgttttgttgttgatcgaaactggatatgctacatgtcatgatgctttgacctgcaaataatggctttatcaagtagattatagcgcaacttacaggaagaatgccaatcaccagattttatccagagataatacttttacagaaatatgtacattatgtgtaacagaatctgtggtactttactaactttatgattacgccattctttttacctttcgctttgttggccgatggcatgtctacagtatttctttctgcttgttgctgagttctgatagatgcatatattgtttgtttggaaacaactctgcacctaagtacttatcattgcctctttgttttggccatgattactggatttaacattattctcacagagaccaaacttgatttatggcctcagtaattccgggctgcagga

SEQ ID NO: 64355 - DNA, 2484 bp, Oryza sativa
attcctgcagcccttgttcctgtgacttagtcagatgactatattggatttccaagagtgtgatttatatactgtgtttattttgtgctgctctgttcatttaagcatcttactatgttgcaggagatgttttctatgcaagatgggatgaagtgttagttggtgccactgctgttgtgtctacccttggaggattcggtaatgaagaacagatgaaaaggataaacggtgaggcaaatgtaacagcagtagatgctgcaaaagaatttggtaagtaccgcattatgacagtggtgtgccaatttgtttgcatatgcatatgacatcaggtgcatattatgcaattccatgcttaacctaagtttctttgagcagtcacactgaaagatactctttccttcgaattttataaggagaaattttacagtcattgataaagtacctcgaggtacctaaattctactctaatttttttagtaacttgaagtactaagtaattggagataccaaattctacactagaaaatgtagtacctcctggtacgttttcagtgatagtaaaattacccttttttgagggttctttgttttgcaatcatctgcaaattataatctgttcatgtattttgttgctattctcttctactattatttatttcgttctgttctgtaaaaaaataccaggactaaccacataaaagattgtcttatttttcgaaagaacctaatgatacattagtcattctcttctataatcttctcaatctcacaaatttcttaatctatgcatgggtcaaatcagaaaatatgccttgtaaaaattgactgaagggtgtaaaaattgactgaaggggtagtatattgtgctgtatgatgcaatcaaaccaactggattttttaactcaaaatattcactcaaatgctctgataagtaccacacttgacaactcactgtaatgtgtctacgaggtgtcaacaaatcaaaatgaattactctatgttggtactatcattatgagaatctagagagaaaattgcagcaaatgtacccaccctattataaagtataggctcctacttttacttagttttgcaatttaccaagtttctaattactgtaaagctgacacatgctttgattttattgtagtttaaattatataaatttgtaagcctgaaacttgaaggtagtctggcacgcgttgtgaaataaatgaattttgctaggaaatttgttgtactgattactatgacagattaaatacctcaaacagctggaacttatccctcgtacaactgtgccactgtctcgttaacctactctttccttttttattgaaacggataaaataatgtaacatagcttctttggtgtattcttctgcaggaatccccaaattcattttaatttctgttcatgattacaatcttccatcctttcttcttaactcgggttacttcactggtaagagaaaggctgaatctgaagtcctctccaaatacccaacctcaggttagactatatttatgcctccaaaaaaactcactttacatttttgtcatgtttctaatctatatttttttaatcaggtgttgtactgaggcctggtttcatttatggtaaaaggaaagtagatggttttgagataccactcgatgttgtaggacaaccattagaaaagctactttcctctgttgaaaatttcacaaaaccgctgagttcattgccagcttctgacttactccttgcacccccagtgagtgtggatgatgttgcctatgctgtgatcaatggagttatagatgacagcttctttggtgtcttcacgattgagcaaatcaaggaagccgcggcgaaagtaagagtgtaaactgggagtctttattgccaagatggaagattcaaacatgcggctccttattaagagatatccctgttctgtcttgcactcttgcagtcttagatcatacattcaatggttaaagttaaattcaaaactttgtacagtgtatgaatgtggtgcttgttccctccaagcagagaggaagaatgggctttgatggcaaaggccaatgcgcttcatttcttacgagatgcattgccaaatgaatgttcttctggagtacttgtttaaggtggaagtaatcactgattctctgaacctaaccccgtattcaggttgacaccatatccatatgctcatatgcttaacatggacagtaaaaaaaaatttagataggttttgtgttacgagtgcccctagatatggtgttctatgatttttttagataggttttgtgttaagtgtgagtgaacttgttaacttatcactcgactgtgccgagtgctcttctgagcaacaagcacaactaaatatacacatgtaattaaatgaaaaatactcaaacaagcaccatgtaacaaatgctgttgattttttttggtcatttcaatgatacaccaatgttacatgttcatgtgat

SEQ ID NO: 64356 - DNA, 2290 bp, Oryza sativa
aagaaaacaggtagctgcttgcttgcggcgacatggaattggtggatcaggattcaggaatcacaaaattgataccagagatctgtgaaatttgttatgtgtgatgtgaccaagattcatcatccaccacatgatatcttcttcagattgccacatggccttcttcagatttggtatgctacttgattggtagtacttgcaactttgcaagtcctccatttgttctgggagtggcctttccatggatcatctccacatatctataatatcttcagattaataacaagagaaaacaggcaatcccacaccatggctcatacttggattgctaacagtttttttttttttaaaaaaaacaaggaacaattataacaacatgagctaatgaaagcttcagactattccattctgctcttctgattgtaatgccacagaagagcatcagtgtttaagtcatgtgcaaaattatgacaaacaaatttgccgtccaccttttgatctaacaaaagggctggtcactcccaaaactccagatggatatatacacatcatttcgtttattaactatcacacgagattcctaaaacacattcatatgcgaacatccgcaaaactttttaccagttgataagcttgttgcatgaattctgcatcttcagagtgaagttgacgctgtcattgtcctttgagcatttccaaggatgataacaatgatggtaacatcatcgtggtactttctcctgctcccaacaggtatcctcatcaattcttcagctgttaaagctggcacaacataggaagaacaaaaggtgaagagttagttaagtccctgatatcaacataactccaaaaatggagcaatgatgctaattatgcaaaatataaaaatcatcaaaggtgtaatttctttcaaaagagattattaactgtccctgcatctacaagatactatagagcttaattaattaagtctaagggtgtaataatatggaatatgcatttcagcgcaaaagaatcttaatgctaactatttcatattttaatactaaaattataaaactgataatatatttcggatgatacctgcttccttcgctgctttaagtaaaagttgctcaatgagatactttgcaggatcaccaattggattatcatgcataaattgataaaccaactgaacaacttcgtcattgctgaagaaatcaaataagccatcactaccaagcacaacaaacaaatcatcctctgtgactttatgactaactgtgtgaggatttgtgtacacataaggcgggctgcacaaattacgaactcggagaattcccatgagtgcatcgttcaacttcttctgcaaattgacatgtaaagcatgtgtattagtaaaatcataagaacagagatgcattaatgctctttcttcccaaacaaaattatagtacgttacctgttttagatagccaactccaaaagcacgagtaaccttcagcttcccctttattttgttacccatcacaactgatggctcattaggatgatcagctaaaagtttttggtactccaatggattttcaagtgagtggatctcagtcaattgaacagccttcaatttatccattcctgaagacggcactgaagcaagcacagctctactatccccaagatttaagatgcacaaatctgttccatgtagaagcacaaccagaacacaagacccaactgatactaaatctggtctatcgtccatctcttgttcaaccatgcataaaaagtcattttcagcttgctcaacagcagtagtgaggcacttaagcacaccagctcgaaatgtttcagaaaatttcacatcttcattttctgcaaatctcatggccagtgttaactcacttttaacaccattaagagagccctctggtgaaccatatagaccattttcttgtttaatccggcactctaacaaatataggtaatatactatattatcatataaagttactgccaaaaagtcagctgcatctcgtccattaaatccatcatatattccacaaatcaaccatccattcttctcagagcacacagcttggactctatcctctccagcagctccaccagccatttttatctctgtacttgtcagaaaattggatgagacagtagttggggcactggacctccagatatttttactgatttcaaatatagagctctcagtcgatacagggctgccttgtgaggtggataacaagtccaatcttgacattgatggggatgaaacaattttctgaaagaatta

SEQ ID NO: 64357 - DNA, 3976 bp, Oryza sativa
ctcacagatgcatccatcaagttcagagcgatgggaatcgggccagttgacgcagcccctcctttccccccatccctgaaaaccccaaccccaaccagcgaaggaaaaaaaaacaagactaaatttttacccaaaaagctcccttctttctttagccgcccgccgacctgcgcagcgcacaacacggatcaacaagaagcagcacgcgaaatagggaagatcactagaacaggtcgcgcaccccctgcaacagaacgcaaaaaccagacgaaacctgagcgcgattcgcttacctaaaaaaaaacccggttcgttttttttctcttctcggttgcaaactgcagatatcagctcgcgggccaaagaacaaggaagagcagaagctgagaggcggaggaggaggaggaagtggcgggtagatgcagacgggacgggtgtggagtggagaatgggagaaattgagaggaaggtgtgggcttgcggggaatatatcgaggaggtggtggctcagctcagctggtctggtggaaaagagagagagagaagcaacagattcattctccctttccctcctcttttttctattttcgcggaccggataggcttagaatctaaccgcgtcgctcgctctccacatcggagtggtagttaaccatcgcagcgacacaggaggattggggcgcggcggcggcggatgaggagagatcgcgttctcctttttacttatttttttcactttaaccttggggtgaaaatttacgtgggtactcagttgataggtgggttcgctatattttaacttttaagggtatatatgtactttttttttgttattataggatccataatacaaactccaattgatatcataatataaattaaatatcataagagccgacacgtagattatcagttctgaaatataaaatatactaagaaagtaagaagtggtttttattgtaggtaggtttttgtgtagtattatcctatatggcaggttgagattactagtacgagtgtctctattgtacgtgccctaaagtagcttcctttttcagttttttccagtcataaaaaacacaccacgagttatgataaggaagatacatgactcattgatcaaaaatttgcttgagaagatcaggtcagatgacgagaagttgcaattgtgacacctaagtacctaactagaggtggaggaacgttatgtgttcaagcctcgatgggtgcatgacactaggaatagaacaaacataagctagattgatctatgatagattttctattggttcttatgtgcttttgccccctctggttaaataatactccatccgtactcgtaaaggaagtcgtttaggacagcgacacggtctccaaaacataaatttgacttcttttttctataaaaatatttattgaaaagtgatatatgtatacttttatgaaagtatttttcaagacaaatctattcgtataatttttatattttcaaactcacaactcgagagttattcatgatttatattcccaaggtttgacttaaacattatcctaaacgacttcctttatgagtacggagggagtagtacctaagcaagtgagttaggattcaaaactcaatttgtttggcatatgtgactagtcaccaggattcaccaaacaattttaggtggggttatcgctaccccaccgtaagacggttatcacggtaaccgtgcggttaccgtgagggttaacatggtttcaaaaacttgccccttgcctcttgctacacgtttttgcaaaccctgttagccacttgccccttccagtcgatgggggttgatggtgtcaccacgatcaataaccttaagattaacaaaaatgtattgttcatgttgagcttaaaccatctctaataaatttgtacctaaaaagtggtcgaaaacctaactttttgtagatttatgctaaaggtcaaacgcattaacactgtggatatgcgggggcctctatattgagctgatgtggtactatatgaatctagagcatttagaatagtccacttagtccactatggattattgaccaagcaattattcttattcatgtatgaggagatcgatataatacattcacatctctatctatttagtagaaatatagataaatatatttattattatttcttcatgtttaggatttaacacggtttccgaaatacattgaaatgtttagcgataaatattataataccatttttcacgtaggaaatatcaatatatattttggcatgtattaatatttaatagtactttaaggcctgctcggcccttctaaaaagttgcatccaattttaaattttgctacaatttagggtttatttattctagctttattttcacgattgctaagaaaaagacctataaaacaagactagctattcacgaaaattacatttaaaaaatgttctttttatgaaaaaagcagcaccaagcggtgcctactttcatagtatttgaggggagtagctcgcataaactgataaacatctctgtttcttaagttataccgcatggagtccatgttactgtcatcatgtagctattccacctgttccaatcggcagcaaccaactattgaaatgggactgtcctttctttgtttcgccccatgtaattaactacgagtctgtggccacagccgatcagccaatggcaccagtccgtgtcacaaaccttcgctttcttaaagggaaattataggataagcatcaatgcatggccgctgcagaatttagtatattggtgagatgtggcgagcagcagatgcgatgaactaaccggagtgagctcgaatcacgagaggcatcgaaaacgatccccacgaatatcagacggccatggcgatcgacagccacatatgctgatgttaggtagttctacagtactctcctatgatagttggccattcattattatatttgttttgggttgtttgtatggatcagaatagatgatcgctgacgaaatgcagattgtttttggtactagtagcgtgctgacctcgtggtctctcatgccgtacgaactggagtagtactgtagaggattagcctgcagacttgcgggtgtcatctgtgatctatctactcaaacagcatgtgagccgtctgatataaaaaaaaaggagggaactgtgatgttagcacgagttcatatacatatagttctcccatgtactccctccgttccataatatagcaaaaaattgggtaggtgcaacaaatcctagtataataaatatgaacagaccatctgtacatattcattgtactaggatatatcacatccacccaaaatcctttatattatgggacggagagagtatatggtccctcggctatagcataagttcagtttttctagtttcaaatgtgaattgttgagactggaataaaatcacatcaacacattaatttttcaaaactggataaagtcaaaccttttgatggtgattcgtggtggttcgagttttttttttcatttcatcttgcttgttgaatcatcttgtaagatcgctgcaaagtaatttttgtaagcattactagctactccctccgtttcaaaatataaaggattttggacggatagaacactttttattactatgaatctggacatggagcacatctaaattcgtagtattataaagtatcatatccatccaaagtctcttatattttttgatggagggagtatgtgacaacactttcaccaaagtactccgaatctgtgataattgaaggggtgtattttgtcaactttttctcagcaaacagaaaacatttgaaatcactgtcctgtacagttatgacaaagctagagcatggtttgtttgtttgtttgtaatttctgcacaacagtcatgtccagaactagaacatggcataatataatgcaaataacgaaaattaggaataaagggctgcaggaat

SEQ ID NO: 64358 - DNA, 4758 bp, Oryza sativa
  unsure (1)..(4758): unsure at all n locations
atttgtaatcagcaaggcgcttttgatttgaaggaaatgcaatactccaattctatagaatattttcctttatgatcggattgaaaattattgaaccctacaaaattcctgaggtttggaggatttttaagatgaggtcaaattcttatggaaagtttccctaatgtatatttctctcattcaatttttatgttttataattttttttttgttttgcacatatattcctgttaaaattttatattttttctcttcttccgttttctaactatgcgtttgaaagaaaccctaaggccccctttgattcaaaggaaattcataagaattttaaaagatttcattcctataggaatttttcctatatagccctttaaatcaaaggaatgaatcctatgtaatcccatgaaattcctatggaatgcctcttgccatgcaagttttggaggaaatttagcatgaggttctacctcatgttaagaattctttgagtctttatctctcctcaaattcctgtgtttttcttgcggctcaatcaaacggttattcctattattttcctgtgttttacaatcctctgttttacacttgtattcatgtcaaaatcctatgtttttcctattcctccgtttttttattcctgtgattcaaagggccctaatcaggagtttcttttcttccgattcacgttgcatgagctgagcgaacccagaggcaaagccttgataagatggtgccacgtgatcgttaggaaatatattcgttatcttattttgtactggtaccatgagctgttcttgtaatcttgttggtgaatcaagtccagagaacaatgatctgggtgcgattatttggaagaaaattcaaattaagcacgagcttctgacaaaataattacacacagctaactatgatcatgcatctccctgaatatctggaacggagtttatctctgtctaactgcagtacagtacttctcttttgagcatgatggcctttgcttacagtcacattactgtctgcaaggtcagtgaacacagtggacagggcacgcctgcgacaccatcacatgactgcataatcgcctgagctgccccgcatgtgtccgtcacagatctaccacgctggtgatttctctgcactgatccattgctcaatgagccgtgaaaagagaacaagttcagaaagagaaaaggcgcaaatgctcatgccagaagcggtgtcatgtgaaagatttgttgatcttctgaacaaactctttagctcgtacttccatgaatgtccagtgacttgccatctgcatcaccgactcgccgtatcaagatctctatcaagtagggtgcatgcctgaaatgaatcattgtggggaaggaaagactgcaccttgcattgccggagcagtaataaatctgtcgatttgatcctcgcgtgctgcagaaatgacaccgggcgtcgtggctgcacagcagaacagcacaggggaacgcgatcttttcctgaaatcggatccaatgccatggttgattggttgttctactgctaatcatgctttttccctggcaaaaaggaaggaactttttcgtgcatcatggagattcgagggaggcatgctgcatctgcagttccaattggagggagcatcatttgcgtactgtgtttgcgtctggtgtatgcgccttcttttgcttctctgtcctggtggcacctgtgatcttcttggaatcttggtggtggagaagaatcatatcattctgtaaccactcctttcagaggaaagtttcagttctttggtggtgacagtcaggcgaatcgggtcttagttaacagaaaagaagggtccctgctatctctgaagatcgtgcgtccatctgtttcagataccgagtgatgctgcaggatacttcttcgattagtgcatgcttgcacagagcacagtgccatgaggccattcacaatgcgtcatgggtttttcctggacctgagatgccacgttggatggaactgctgctaagcaactccatccagaatgcaaagcttgtactccacagtataagctactaatgggtcccaccaccaaacacttttgctctctctctttggttcagattttgcagcaaggaactcggtaccaactttggtcacacggaccaggcaaagccacgatccccactcttctccctcctccacgtaagccaggaacaacattgccacacgccacatcgccgcattgtaaatggcttgaccgaggctcccttggcaggccgatctagtaatccatggcatggaatcttttgaaccacagttttttgagatacattgtgtggttttaacctcacgatctcatgctcaatccctaacatgctcataatttctttaaaaaaaaatatttgaagagatgtctctccctccaaatctccttttttttatccttaaaccctaaacccaataaattattgtatacacatttcagggcataaaaaccagggttttaaatctcctgttatagctgtttgaaaagagttctagctatttgatctcatatacaatttgatcgctatagctccatttagcccactataactgtttgagaaattaatcgctaaatgtcttagcccgctatttaaaacattgataaaaacacagattttcagaaagcacagtacatatatagcacatgttcttaaagtgttttctaatattcagacaagttcaacgcatcgcgaagaagttaggtgccatcgtccagtacatggtccttaccaggatcagctatgaggagtgggtgctgctcatgacagtgaaggtgatctctgtctgatttctagaattcttattaggcacagcacaagggctctaataggccatggagccaaggaggtagattaccaggaggataagctcacgctacacatcgtaaggaccatgccacctgagatgctcagggcactgtccaccaaacagacggcgtagtcagcatgggaggtgatcaagaccataagtgttggcgtctaacacatacgcgaggcgaaagagcagctgctaatgcaagggattcggcgagatcgagttcaagaatggtgaggcaggtcagtgatttctccatccgcatcaccggtctagccaacaacatccgcgtcttcggtagcaacctccctaaagctgatgtactgaagaaatctctgcagtggccctgatcgaacatctatctcgctggatgagtcattgacatcggggagtatatctcagttgcgatcacgacctaggaaaaatgttcgaggagaacttgtaggggttcttcaccacatcagctttgggggatcgtcgtccaacatgcagatgctatcggcgaggacagttcatgcgtatggagaaatcgtcgatcgcctcgccgtctctcattatatgttgccctttcccctcgcatatatgttgagaggctaagatcaacatgtacggtcatgatagcctcacatgccatttgtatctcccatttggtgtacatacctgagcatctcaggtggcacgacccatgggatggcggccagcgcaggactatcctgctagtagttcacctcctcgtcatcgtcaggctcaacggtctgccgtagcccttattgcctacaagttcaccttcatgagcattgtccactcctcgtagttggcctgataaggaccgggtattgacgttggcacctgactccttcacgaccacgggaggaaaaaaagctcgggctcgtgagctcagctttggcttggctcgagttttgtttgtttggctcggctcgtaagccaaacgagccaagtccaagtctcttttttatctcgttgctgaaatgaatcgagtccaagctggctctcgagccgcttgttttggctcgcgagtctaggccatcatgtgtttatattgattattttattttttatagagttattatttgtcaacttaaaatttatcattaagatttgtaagaattgatatataaacttatttaatttttacatattgatgatttgtttttgctttttttaataataacaaaatatatatgaagaggtgtttcaacaggaaggattgcaagccagctcgagctggcttgaaccaggaaacgagccaagccgaactcaagttttagcttgtttttctaactgagccgagccaagccaaacctagtttgttgcgagccacttcaagctgagccgagcctagctcgtttccacccttattcacgacgcgccgccaggatgatctcttgtgtgcgtgcatcatggttgaggctacagagtgggggccaagggagagaggtatgacgacacatgggtggtgtgcaggaaagccggttggctggtgtagattgtgccgacacggcatcaaggtgcaatttggctcttagagcaagtttaatagtatagtccactactggctccaattcatctataccaattgttacaattgagaccagaaatcacaaacacacacgtgttggaagaatgcaagaacacgcaaagggctattggtgagttgcagtgttttctgttgcattataagaacttaagtgcccctttggattgtaggattgaaaaaacgtagaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64359 - DNA, 1805 bp, Oryza sativa
cctgcaccccagaggttgaaactcttgctaaattttctctaaaatctctatagaattatccattccataggaatttcaaaggattggatatgattcaatcctttatttcaaagggcatcataggaaattttcttataggattgaaattctccaaaatacctttttcctctaattcaaatgagccctaaatagactacatgctaactgtttctctaggcgttccaggccacgcaacctacaattctgatatgcttaccatgccctccaacttgaccgctccatcatatcgccgagggcatgtgatgcacacaatgttgcctaggactcgggactattttgacgtgctccatgaactcgcttgggtaagaggctatcgacacgacacaacgaccaaacctaatcttactttttgattgtttcaatgagaaaattattgaaagggaaaataagaattctagaaatcagacagcgatcgtgctcaacgggaaaaaaaacagagaataagtagtaggattgattcatcacccagtgtttatgagcatcttctattctgaacttttctgaacattgctgggcctaatcaacgcgggccgtgaatttaggtgatctcaccggcaatttagcacgcctatctttaaccttcaccttcatgcatggctttactttcactggttcacaactagatcacatgcaaatcgatctaacagaaaagctaatctttctgttgcctgaatccagatagccttatccatgatctatatatctgtcacttcagagagtgttcgtttcaccacaattctatcgctcccgcgaagcacggtgtgcctcgccgtgcgattgattcagtcattcaggccatgttctagagattttgtaggatctccattgctacatatgcctccaaggtcttgacatgcattgatgcatacctaaaggtcttgacaatgtatgtgcagctcatgattgacaaagcctgcatgcttgatgaagatgacgccatactgtctctgtaaaaaaaaacccaactttttttatacaaatttggatataacataggtctagttgatttttttttagactgagggaatatgtctcttacataacatatcttgaatgctgataattttaatcagcaaaatgttcttttcactaccctctgctagtatattttaagcttgtggttgtgctcacatatactgaactgattgaatctggccctgcaagctacaataactaaaatgtgcatgacaagatttgcgacccttgtatttaggcaattaactgccctttcgactcatcaatggtcaagtgacatactgacatatactagatatttgataaatgaaagcaaatacaataccctcattccattaaaaagtaataaaataaaataaaataaaatcaacaccataccctcacagcccactagtccacagagaacatctcgccagttgcatcattggtcattatcaacatcgtttctatttggttgaaaatttttacactagcttgcattacagcattggtgaatcatctttgatggcagtatcgatcatcatttacagattaacataaagcaacttgcagtaataagtaagatcacaacaaagttgactatttttcgacgcaacttccgtgatgtcatatatgggtgcttaattcaataggaatgtgcaatatatagaagttcataacttgtttagagaaacacacgttaatgctaggagctatatatgcaggactaaccagatctctgaatttttcacattcttttatacagttaaacattaagggtcccattaaaa

SEQ ID NO: 64360 - DNA, 2567 bp, Oryza sativa
atggtagaaaattttcacatgattgcattcttatcatcaatttcataagatatatggttcatttttccttgaggtgtaaataaggaacatctctttcagattttttttgttttcaattcatgtagtattgaaaaaccatactaccccgtctcaaaacatagcaaaactctcattttttaattcgtagtattaggtggtctattatagtactccctccgtcttaaaatataagtgattttgatcggtatattttgaatggagggagttgtcagggttatggataccacatatacctaatagtagttgactaaatctcggcaggatccaccacataccatgtcttatacggaaactgacctcgagggagttccggataaggaaagataaccagagttctacatgaaaacgacaaggactactcggattgtatccatattggtttccctagttctacttggacaaggggacacctatgggtataaatacaagacccaccatggaggatcaacacctaacacaatcgacatagaagcctacatacgccaagacacgccgccggatgtcgacttcagggataagcacgctagtaccctacggtgtctccggatactgttaggagagacgaaagcgctatctctgatctcgccgggcacggattcgaggaggaaggctaccctgttgtcgactacgagtcagatcgtcagaccgccatgtcgacaacagttatataggctaccccacatattgtactggtgtgattatcatgaataagagcaataccggcttcggccaataggatgtagggctattacctgacagctcagcggcccgaacctgtataaaaatcctcgtctccatctcttttacctcagtctcgcgtatatcctagcaccaatgatccccatactgtccaaatactgtagtcgagacatcaaacgtcgacagtggcgcgccaggtagggggattttggtgcttcaggatttcgacgagttgggtttaagagatggactctccgacaacaagctactcgacgacttcggctgtggggagatccaacctatccaagtacatcttccgacgagatcggaaccatcgtcatcaataattcgatctctcgagatcgaccaagctttgaagacgtcaccgacgcggagaacggcattttgatgttatccatcatgaagcctcggccagatcgactacctcgagtggatattcgccgacgacggcatcgagtccgatatcagggtctttgttgactcatatcagactcggttatcctgggtagaagcagcagatcgcaaccgaccatgacgacagacgagataacaggaagctatggccaaatttcctgcccactcgtgcgttgccacgtcaccaaccggtcgacgtcctgacgtcaggaggcgtatcagatgtccctgtacagagcctaacacctatgcatacaatacacatacatgtctacccggacatgcatgtacgcgtgtgcatatatattggtacgtacagtgctgttgcatatgctttgaccacacgaggtcgtcacaacattaacacaggtaattagtggattgattttttaaattgatctactaattccgtagatatatccggcatatatctacacaggtatgcaataatttatatgcaatttaccgtacctatttttccagtctatacaatattgtcagatctataatttattacgtttacctagagcatgttttttatacaatatctgttgcgcgagtgtccccgatgttaaatcgactacaatttaatgctgggggctcgctctattttcttccgtataaatcatgcttgcttacggtttacataatccctgacatttacatttgctcgttatatcctgatgatactagaagatccatgcagtttttgagtacatactcgatatcctctgctatatgtcttgccttctagaaaataattttcaggaacaactgagcactcgagtaggttgtggtcgagtacactccattatcgagaacattctcgacaaatgcggagttatcgcacccaacctactaaggaagaccgacgacctatctcatagcaccggccatcactggacaactcgagaaaaggttgttaacggataattcctcgcaaacgccgtcggcttgatcacccgatatgattgcgagcggacatccggatatgctataagttgggtatatgagtcatgctggccacatgatatgcacatgtaataaaccaactttagcgcccctataggtgattaagagactcctactcctggttctcgaaccagtaaaacgtagtgatctttctcgcctcactttaagtggtcgagttacgactactgcctggtcctcgactagcgatgtcccactacttccactttaagtggtcgagttacgactactgtctggtcctcgaccagcgatgtagcgtctctcccactacttccactttaagtgatcgagttacgactactgcctagtcctcgaccagcgatgtagcgtctctcccactacttccacttcaagtggtcgagttacaactgggctgcaggaat

SEQ ID NO: 64361 - DNA, 1510 bp, Oryza sativa
aagaaatggggtacccgccgagataaaatttcttgacttcaatccaaattctcgattacaacaagacgggagacttagtcgtacgttctgtactttctcggtcgacatcagagattgacttagacaaaccctttcggtgcccgcacgaggctaataaaggaagtctaacgttatctctaaactcaccgagaacggtcacatgagctcgataacagttcctccgaagtctgcggttgagaatatgaattcgttcatttgcatcgaagtcgggggctactgtcagggttatggataccacatacctaatagtagttgactaaatctcggtaggatccaccacataccatgtcttatacggaaactgacctcgagggagttccggataaggaaagacaaccagagttctacatggaaacgacaaggactactcggattgtatccatattggtttccctagttctacttggataaggggacacctatgggtataaatacaagacccaccatggaggatcaacacctaacacaatcgacatagaagcctacatacgccaagacacgccgccggatgtcgacttcagggataagcacggctagtaccctacggtgtctccggatactgttaggagagacgaaagcgctatctctgatctcgccgggcacggattcgaggagaaaggctactctgttgtcgactacgagtcagatcgtcagaccgccatgtcgacaacagttagataggctaccccacatattgcactggtgtgattatcatgaataagagcaataccggcttcggccaacaggatgtagggctattacctgacagctcaggggcccgaacctgtataaaaatcttcgtctccatctcttttacctcagtctcgcgtatatcctagcaccaacgatccccatactgtccaaataccgtagtcgagacatcaaacgtcgacaggagtacctttaatttgtgtgtgtgtgtttttttttctattacacatttcaaatgataagctcacatactacatctatcccaaaaataagttcaaacttaatttagaacggagtgagtaccatgtaacagtacacattatgacggtaggttcaacatggaaaaaaaaacacaaccatcctccaaaaaagaaagaaaagaaacaccctaccagcaccatgatcagagtagcttccaaaaataaataaaaagaaaagaacggcaatactgaaattcctgtgaagttcgtacagacaacgtgtactgctgtgcaacacatgttgtccagatccacaagatccctagctccccaccaccattcctccgtttagggcccctttgaatcgtaggaatgaaaaaacagaggaataggaaaaacacaggattctaacatgaatacaattgtaaaacagaggattgcaaaacataggaaaaatacaggaatagccgtttgattggaccacaggaaaaacgcaggaatcagatgagagagatagactcagaggaaatgttccaaga

SEQ ID NO: 64362 - DNA, 1180 bp, Oryza sativa
ccataggattgaaatcctccaaaattcctacattttttcctacaaatcaaaggggcccttagatccttgcaaatttcacacggattctacgggccacaagtcccatatcttttgtttgtgccgccccaatttttgattcttctcatttcaattcgccggctggttaattaatcaaatctgcagctccgattgccgtctctctctctctctctctctctctctctctctctctctctctctctctctgtgacgtcgtcgccgccgcggttgtcttcttcctcgcgagcgacgcaaaatagaattcgttgacctttggcaagtcgggtagccgcggcgcagccgcacaaggttctccagttctccccccctctctctttcgtgttcatttttgttttatatctatatacaaacgtacacatatataaaattaatatgccattaaatatgtcacccaataatgcatcaccgatcgatcgatgcagatccaacgcatacgcacgaattgagaaggttcatcctacgtacgcatatactgtatacgagagattaattaattattaactaactaggccgcgaaagcgacggcgatatgtatatatcggtcgttaaacctatatctagctaggctagtgtccctgtcaatgtcaatatggctgcagccaaattattcgatatatatatatatatattcctcttcgatcagaaaaggaaacgcgactgcaatctaggatgaaaattaaagggttttctgcaagcgcgcactagcaactggccgggcaggtgcaatgcactgtccttgtgccgtgatgcattggtgaggtcgatgccgatgtatcggccgcgggcaatgcaaatataattctgcactatagatcagtgccgtttctgtctgtagatacatcggctcgtgtaacttgttcattcaggaataataattttgctctaaattcataaaaaaagtttaatagagataggagtagataagaaatatattctaatagaatctcaagttcaaactcaactataaattttgggtgaatagtaacctaacactgttcatctgaaatctttcatttttgcttctctcaaataaagttgggtgcgtacttgagaattggtgagaatatattctatatgtacacaaaactagagtttttaacacttcaatcattttcacaag

SEQ ID NO: 64363 - DNA, 743 bp, Oryza sativa
ttggtcctaaaatgtaaaccgttggaatttgtcctgtgcagcagtcaaggctgcgtaagtagatccactgaattttcaccataaaatccatctttattcacttgcactgttgcacatgtaacatagacataggctagtacggcttgaggcagtcaaagagacggtgacccaccgtctcggcagcttccgccgccgtcgcgctcgccgtcggtgacccgactgtggtcgacggcccgccggtcagtgtcaggcactgcgccggcactctcgggctctcccggggctccggcgccggcggagacacgccggcgagcgcctgctccatctgcagctgcttcctcctctgctccctcctcacctcgttgcgcttgttcacgtagtcctcgtggatgaatacctccatcctctcccagaactctaccaaaactaactactacaaagtacaaactaacctcgaaaccgaaagaaacttcacattagatcgacagtacttgacacaaactcagatgaagaagtgagagttacactgaagaaaactgcatgtttatatgggtgtcaaagagaggaggaggtcgccatcatcggtcgctttaacctttaaccatttttacaaagcgcagcctgctattagtctatgccaacgctgcaaaaaaaaaaaaagcctgtattattatggcatggccgaattgcttcatgcttggtggagaaatggttaaaagagaggacttcagggctgcaggaat

SEQ ID NO: 64364 - DNA, 882 bp, Oryza sativa
agatcattggactacctgactaatgccttccctaacccaaaaaaggaatgaacaattctgattatgttgttattttcgctcactctgtcaggcttttaactgggaatcccataagcacaactggtggagcaatttggaggaaaaagttgttgacctagcacaatcggggtttacatcagcgtggctgcctccaccaacacagtcattatctccagaaggtaagctagtcaacaatgtattgtgtcactcgtagctagttacagaaacaagtggtctgaatatctggtccctttattctgacaggctatctgccgcagaacctgtactgcctcgactcttgttatggttccctccatgacctacaagcattgcttcggaaaatgaaagaacacaatgtaagagctatggcagatgttgttattaaccatcgagttgggactactcaaggatcgaatgggatgtataatcgttatgatggtatcccagtatcatgggatgaacatgctgttacatcttgttctggtggaaaggtaatcgacttgtttttatgcaatgtaatcctattgttctcagcctcataattgcatcgtatcttaatggccatgttttgttaataaactattatcaatgtctctacaactttattaccagggcaacgaaagtaccggtgataacttcgatggggttcccaacatagaccatacacagccatttgtacggaaggatattattgactggttgatctggcttcgagaaagcattggttttcaagatttccgctttgatttcacgaaagggtaaatagtcaactcgataggttaacatcatctgtgataggggacctccaaattgctttgttaaaacatgctgatcagccacaat

SEQ ID NO: 64365 - DNA, 745 bp, Oryza sativa
ttcctgcagccctatttgtgttagtagcggtattattgtattatgtgtttattttagagtattttacggtacaatatactgctagtatatactgaaagtatatatgatctaacagtgtacattgatttgatttttttaaattagattgcagtgtaaagtttgaaagggtaattttgtcttttcttcgttattctattatcaaatcgtgctatcgtcacgtgctttgtcatcaaatgactctcagaatgctcctcccttagtgcacgataagatttagaaccaggtactcctaattagattcaatttaaaccaaaaattactaaagtgttattttatttcctataaaattcctaacatgctcttctacatactgccagtatatactgatagtatattgtaccgtaaaaattctcttattttattcttatagcgtgctgatggagacaacgactgcagttacgccaatggatcaagcaggccaaaatagacgtgcccctaatcatgttttagggcctgtacggtttagagaaattttaactcataggaataaaaaagtgaagaaatacaaagatatgtacacattaattcatagatatttttcaaaagatttaagtggatgaaaattttcctttgtgttttctcaatacaacttataaggaaaggaaaaaatcctttagtttttacatactacctctgtcccataaaaaataaatttttaggaaattaagaatatattagtgggata

SEQ ID NO: 64366 - DNA, 4416 bp, Oryza sativa
atctccctcctcctccccctccacctcctccccttcccctcccatccccggccctcttctctccctttcccttcccacgcagcaggcggccggctgggccgcgcacgggcccagtggcgagcggcggtaggcggcagacgctgcggcatctttttttttttacaatttgtgattcactaagatgtataattttataatttgttgcatgatctgagatgtataatctgtgatgtatttggtttgtgtgtaatttttttaagatttgtgatgtatttgatttgtgtgtataagtaacttaagatttgtgatgtgaatgttttgggatgttactttgatttgaggtttgatttggggatatgtatcccacttgatttgggagaaaatacagggattaaactctagctaaaaaacaatgaaaaaaagagacctaatgggactgacgctaccctctctttagttccagttggtaacaccaaccgggagtaaaggggggttaccaaccgagagtataaatggtttcttcaccagtgatatgtgcgtggccggctgggccagctccgttaggcaaacgcatcttgggggtgtttagagtatgtttagttagtgaaatgaaattttattttagtgttatatcagaacgtttgatcggatgtcaaaaggagtttttggacacgaatgaaaaaactaatttcataactcgttatctggaaaccgcaagacgaatctttgagcctaattaatacatcattagtacatgtaggcacatgtaggttactgtaacacttatagctaatcatagactaattaggctcagaagattcgtgtcgcgatttacatgtgaactgtgcaattagtttctttttatctatatttaatactccatacatatgtttgaagattcaatgtgatgtttttgggaaaagatttttggaactaaacagcccattagatcccaccctaaaattttacaccctgtcacattgaatgtttaaacacctgcttgaagtattaaatataggctaaaaaaataattaactgcacatattgcgactaatttgcgtgacgaatcttttaaacttaattgctccatgatttgacaatatggtgctactgtaaacatttgttaatgacagattaattaagcttaataaattcatcctgcggtttactgacggattttataattagttttttattagtgccaaaacacctaatacgacacactatataatatccaatataaaacgtcaaaaatttaaacctgtgaatctaaacacccccttcgttttcgcagcctgcgtactctccggactccggccggctgcgcctgccgcctcgtggtggtggtggtgggcgcgtgctttgtagttgcgcgcgcgcgccggagagaaaaacgtacagcggcgaaggagacccccatcgatggagtcgcgccattaatttgtcctacaccgccaagttgcatggagtaatccaagataagatgggttgcttgctataggctaaagtcacaaggaacatccgcgaaagaaaagaaacaaaagagagaaaaaaaagaagaagatcgatcaccttggcgtcggcgcttgcgttgcccacggacgctcctatactgacatgtgggtcccaactctaccgcgagcatctttggcttggttacatgtgttgacacggcgtgtgtaccacgtcgactgaaatgaccggaatgcccatccaagccacgtccggctcacgtggaccacgccccctggttacaccgaccagatttattaacgtggtagtctaccacgataaataagtaatttcatccttgtcgccgcgccttcatcatgtcccgtgtgctaccctaatctacgcgaaaaataaaccgtttaatatttccataacctgctcttttttccacaacgatccagtaagtttagaaacggactttttcgcccatctcgctgtgacaccaccaaacaaagtcgtcagtaccagtaacactattactccatggaatacaatacagtactccatagttctatggtactctctccgtcagtggcggatccagaaatcggtccgttagtatcatgatatatctatcggtgttatagtatactaattatacttagatcatgatattataatatatggataagcagttttgctataggttttaccgaaagtcgtcggtgtcgcctgacaccgattcttatactgtagctctgcccctgctctccgtcccataatataaagaattttgagtttttgtttgtattgtttgactacttgtcttattaaaaaaattgtgcaattataaaaaataaaaagttgtgtttaaagtactttggagaataaagtaagtaaaaaaataaataataattaaaaaaattgaataagagtaagacctcgaaatccattatgttataggacggagggagtacttctactttgccataattaccactacggacctggacccacgtcttgccgaggcaactgattaacgagaaagacagggggcaaagcgataaactccggtaccccacgccgtgccaaatccgtgcactcgtcgcatttgcacccgtaatgacggaaacaccctctctaacctgagacgtggcaccgtagtgacaggaggggcaaaacgggcattttcatccactcgaggtcaggcgccgcggaggcgcggaatttaacgcggcggggccccacctccggtcgtatacgcagccggtggggcccacaaggagtaggcctcgcgcagcgcgacgtctcggtcgcaacgagggcgacacgtgggctttggatgggccgcatcggctcggagtcgggctccgatgtccgatccggctcggggataggcatggacacctactactacgccgcatccgatctggatccgatcccgtgccgtgcctgccgcaccgctacccaagccacccgcatcgagaggtttttacccctgtgccactatcggtttcttcgtctcacctcacgtgctctggcccacaaaagtagtcccactatttgacacgtaaaactttttctatataaggggtgattagattcagaaagttttggtgtactatatctagtatgatgtcgtaagggtgttttgcaataaaaaactaattacataattagttagtaaatcgcgagataaatttattaagcctaattaatccgtcattagcaaatgtttactttaacaccacattatcaaatcatgaagcaattaggcttaaaaaatcgtctcgcaaattagtcgcaatttgtataattagttatttttagcctatatttaatatttcatgcaggtgttcaaacgtttgatatgacatggagtaaaatttttggttgggatcaaagcagggcctgactctacaactatgatactatcttcgtttttaatagatgacgccattaatttttaacaaacttttgatcatttgttttattcaatttcttttacaaatatagaatttaagttattcttgaataaaattgataataaatcaatttgtaataaaataaaatataattattttttctttaatatgataaatcaaatttatcggaaggaagtattattataaatctccttgctcagctagtatctggttggttctgttcaatccgttgagctgataattttactgttcttttagatgaggtgggatcgagttgtgatgagattcaaccgatagagggccttgcttgtgcaactcttttcgatcacgatcaagaatgagttggcagccattcttttctcaatggttggacgtctaacaacctctaaatttctccctaattttgtcaatctaagatatatcaacacggacgaacagtgttctgcacccgtaacttccaccgctagtccgctaaagtgtacatacctagctatagccttccaagaaagaatcctggtgctatgcatgcaatttagctagcctaattaaagttgcatgtacaagcaacgaagcaagggacaaatttagatgtggccaacaaaacggtgactaagccacgcgtgtctgctgtgagaattactacaggcacgcgctatttcattgtccaccagcagcttccaaacaatattctactacagtaccacgtaacgatccttgcgtttcacgtagcatctaataattggatgaaaaataaaaatatccaaaaaaaaaacagctcaattcacacacacacacacaagcgaccttcatgaaagcccccattattttcctagatgttgtacttctactgtctacgtatgaaaatattactgtttacatcagaatctagcaccttaatttccagaaaacagtatttctggaacttccgtcgttcatatcgaaacttcttattggatagttcgttaagagatcgcatctccccacgtcgcccttgtgcaggcgacacggggggcgaacg

SEQ ID NO: 64367 - DNA, 1732 bp, Oryza sativa
tggcgtgtagccggcattggggcgctgcagtgtgtgtcggtgggcgaggccggcgcgcgcgggtggcggaggctggcacgcgtcgccctttcgatggtccggtgggacggtcgtcgtcagggcgcgttggtgactctgcgcctctctagactaccgtggcgactctggcgcctctccaggtgtccatcccctcccccaacccacctctgctgccacctcccttcctctcctcctcccaccccttccttttcctcccttcctctttttcccacctagttgtctagttgctctgctgctctactcgccccagctcttcgctgcgttggtggtaaagttggaggtggttgtcttagttgccagggacggtctcttgcaaagcccgatggttcttggtggagatgtggcctccgccacaaagctcttcttggatcttgtcggaaacatggaagactccgatgtctctgttgccctgtcttcaactttcagttcctcctccagcaggccagacctcctcgccttccttgatgctccacccttctgttggccggtctgcttccaaaccttggtcgtggagtctatcggtggatgaggagacgtgttcgtccgtgaagttggtccaacttgttcgtggtcagggctttttggtctcacccgtgcttcaagtgccttgtgtgctagtgaacatgtcatagggccgagtttggagcggtgtgctttgtcctctgtagtgctagagttttagtgcttaggcggagtcggagctactgcatcgggtctaaccgatgagctgggcaacgataactctcggcacttttgctctggtttcttggaggttctgcacctttcgagggagtctcaggcgaaagccctacgtagtattccaggatcggcgacatcgacacctgtgggtgccgtgtcctccttggaggtgtcgctttgtttgactctcttccccttcaggttaaaacccaatccagttttggatgggcgatggcagcggcttctatcgttgcttccctccttggaggcttcgctttgaaggtctagctcttacctcggtctcttatgtggctcgtagttgttttatcacatgctttttcgctttgtcttctatgtgggtttttgccggtttccccgtagtaaacagtgcagttgtatggtttttgggcctggttttccttataaacagggtcaattctcttatgcttataaattccgatagatctcctaccgtcgtttcttaaaaaaaaacttcttattggaattatttgataaacaaaacaaccctaaccagaatttccgagttatggattggaattctttttcaggactggggtttttagaaagatttaggtcgattttgaaacagatttgaacccgattttaaaggaaaaggaagagaaataatatattagttttattgatgggctattgtttcaatcggcattggcttaattagaaggtgtggtcttgtcttaatagatcttatagttaaattaaaacatcgtccaattgacaaaatcaatttattagttttaccttttcttttttctccttggccctttaccctttgaatctcgttctctcttttatttctactacctaggtgtgaagatcagagatactgtatacgcgcatggatagcatatccaactaaagataggaggtgggctatatatgtatattatgtaaatatagactagacttgtttatccaggcatattccataagt

SEQ ID NO: 64368 - DNA, 6125 bp, Oryza sativa
  unsure (1)..(6125): unsure at all n locations
gaacgaaaggaaattgccatctcgtatgaattgttgactttgcaaggggcctgtctttcgaaaaatattaatatacacgagaaattcacttctggtgtttatccataaatgtcgtttttaccatatttttgaagataaccacactttagtgatgagttggtgtattacaatggcccatataattatggatggaccggaaatgtggatcaacgtaaaacaatttatcgaactgtttttttaattaaccaaccgcttgggtttttgttttctgttttttctcaaagaaggttgcgcatttcacataacataaacaattcttttatagtgtaataaaaaaagaaagccgtataatatggcgtatcaaataatcttgttttatttatttagcatatgttccgatatcaaaatgtactgtaaggtgtagtaaataacatgccctaataataataaggtaaatagtcaatggtgtgccttatttaaaaattttatgcaaatatataagatataaatcaagcttaaaatatattttaagtgataaatcaactcacaacaaaaataaattataattacgcaaatttcttaattaagatgaatagtcaaacgtgtgataaaaagtcacaacattgtttattaaaaatatggagtagtaaaccaccacaaaattttctctccttttcttaggaaacactcctcatttctattctactatactacaaacacggccacacgcacccaccccccaccaaacgtctatgctgtgacgaacaccaccaccatggacgccaccaccaccgccaagcgcaagcgcccagccgcctccgacatcgccgacgacgcccccaccaccgtcgacgaggtctccgacgccgaggtcgaggagttctacgccatcctccgccgcatgcgcgacgccacccgacggctcggcgcccgccctcccccgccgcgcgcgccggcgtggcgccccagcttctcctgggaggacttcgccgacgcgccgcccaagcaggcgccgccgccgccgcagcagcccgccgaccacgagcgcgtcgccgagaacgccaccccgccccggcgcccggcgcccggcctcgacctgaacgtcgagcccggtccgacgcgccggccacgccgcgctcggcgcgcgccccggcataggcgcgcgccacgaggaaacgcggcgcgtcgcgcatgcgggtgctcactgattacaactactttgctagctagaagcagctagctgcagtgttggattgatccatccatggcgctgccttgtcctccttgtgtgtgaacaggtgagacctggttaatcaatcgctcttgctgggaagaaacaatccattattggtcccatcatggagatgtactatcatgtaccaagacaaaatgacgggtttaattaattaccccctatattattcgttctgtaattcagtatatgtcattgttcattagctagtgtccacttgttatccttgacgggactgggttttattttctattgttatttcttcccttttctttggaatgagcacttgggcatgatcttgtcttaaagctttaaacttagttacaacatttctttgtttacttgtacatgcgtcgattaaatcaatatattctgttactgttgaacggtaaaaaaaaaagaattttgtaaggtattcgtaaagtatgtctgaactctgaatagaaaagcactccgttttagtgaatacaagagcacactgttttttttctttttattcagaaaatatattccttttttcagcaggggaaaagaggcaaagaaattaaagcatactaaagagtgatatgaatgtgcaccatcttttattcccagcgtcggcagccagcatctagctatacgcctatatatatattttccgcgaggagcacctagctatatatttttgcctacagcaaagatgtagtattattcttcaattttaaaaaatgggagagcttttgaagctaccattagggctttgggagaccctaaccatcacctgcaacgacgaagacaacgagcttgggggagcactactccaaacagatcaaaaggtagaaatttgaatcaattttgtaaaaagaagagatagttaagccgaatactttttcgttgttttctcttggaaggaaactctttcctcgtctattcttcgttctgtgatttgacaatatcttgtgttcctttctatattctgaaatgaaattcaggtggagaaactccctcctccccccttgacctttctttaaaaaaactccttccatttattttttctttgaaattaaggggactcctttcaaattctaaataaattgtcttaactatcttacctttctaacttgctatgactaagctacttttccaacctccttccctcttatgacgactttacaagctgatgctatcgttctcgtgaaaaatgtacatcatttccattgtgtaacattcacaagggagaaaaaggataatcgacatgcataagaatacaacaaattcgattgaggcattggcatactcgaagaaaatgacatgacgcctttatatgagctcggctcttcgttggcttacaagcggtagctagaaaagggctcaaaattaatgtgaccaattcttccaagaagctcaaagataaataaacgtttcatgtctgatatggtgacatgtttaactttggcatgtaaaaccaagcgttttcttttcttgttgtctacatatactacctctattattttttttttcacttgatgcattgatattttctgtctttaagatgtgaattttgtttgtgttagaggtgtatgagacaaacattactgtgagcagtgttagaggtgtttatattttgatataaattttaaatacgaaaaacatttttattttaaaacggagggagcagcgctagtgtatcacatgcagctaaataacgtatcactatcgttctagtcttctagatgaccatattatgaattcgaaagaggttgtactgtgccacagtcggtagctcattgtagccagtcaagtcaactaattagccatgcaaatccttattaccatggtgcaagtgggcggaagttgtataattattctggtgcagaaaaagaatttgagccgtcgccactcggacgaaaaacaagtgcaagttccacttcagaaaacatgacaacaggtatagctcgccacaataaaaacaaaatttacgtgagcttctactccctttgtttctggaaaaaaaatagttttagactaatcatttgttttttaaaaaattatagtttaaaggtgtttaaaatagactaagaatccctttgttcgtgtttttaagctatggaaccgatagtactccctctctctctctctccttgttttagttggcttttaatctctttatttaacatgtatttcaactagtaaaaatatatctttttttaaagaatagatggagtttttttaattttttggcttgaccgtgggtggtggtcaatgacagaggatcctggtgctatgcacgcagagcggtaaagacaaaagaagtctctgtggcacaaactgcgatgatatatgcacatggctcggcgttattgcgccgaaatgaaataggagtactagagcggtgtggacggtgcagacgtacgtgcagctagcaggcgtcgacaccaaacccctcgccgtcgacggacggcgcgacacaaatgcacatgccgcatttgacgatgagagttatctgattctatctttattgtttctgaaaacagaaacatatacgcactccaaacacgtgaaaaaaaattgcgtggttcgttcggttcaaactctaaaccaatcttttcttgtggattgacgaactgccgaaaagctctgccgacatgcacactgaaactccaaaaccaacctgttcctggttaccgatctgcgtgtgagaaaccattttacgagggatttgacgtcgtgtgccaggcctatcgggaatgggatatcctctgtgccctagcccttttagcccaataccttcacccntttattgcgccaattaagcccaatattcaagtcaaaatgggccatgccatgcgacagaataaagaattttgtccattttaagtcccttaacttgacagcgagttcgattgtcttccctaaaccgatacaacgggtcccttaactgtcaaaatcagtgcaaacaagttctctcgatggtttagatggtgtttttggctgacgtggcgttcaagtgacggtgatatgacactagaagcaaaatataaaaattaaaaattaaaataaaaggtggggttcacatgtcagtaagacaaaagataaaaaaaaagagtagcatcacatgccagtgggtcccaccctcctctctgtctccatgcacgagcgcacgcaaagagggagaaggtcgaggggcggtggccatagggtgtcgtgatgtacctcatcgcgatgcggggtagttgttgtcgccgctgacagtgatccaaaacctgagccccctttccacacatgcgttgcacggccggccagtggagatgacgactggggagattgaggtctctatcgccgccctcgccacaaagaaggcactacaagaggccttcgacgtcctcactgctgcctgctcgcccttcacctggggcgacctcaactcctacatatcctcgctccagtcatcgattgactaacagcttggccggctttgggtcctcgagacgcccctcccagcgattgcaggtcccattgtggacgtcacaagcaatgacgagaagggctggccgcccctccccacccttctccctctccgcgctcgctgggtggctgacaagggagctccaggaggaaagaaggatagccaggagggagagaggagaaggaggtgccgacgcgccatggagattgagtgggggtgggacccactgacatgtgggtcccactatttgttatgttttatttgattgacatgtgggtcccactgtttgttatgttttatctgattgacatgtaggtcccacattttttaaattttaaatttttatattttgcttccagtgccacattactgtcacgtaggacgaagactaagtcaaagcaacaaagtaggcgtcatgtcagccaaaaccgtcatccaaatcaccgagggacttcgtctgcaccggttttgacaatttagggacccgttgtatctggtattgcggttgggggatgaaaatcgaacttgctatcacgcgaagggacttcagatgaacccatccttggcgacacaacaaactattgggccagagagagagagtctttcttgcatctacttagttgggtcagaattcgatcgtggttcgcaatcgcaccggcaaagcctacaagatttgagctacctgtcacatcctagctaagatagaatacctgatttgttgaggcgagatcgccatcaggaccagttgatctttgcaaatttcgtcaatatcccttgtttcaaatatctgggggtagttgttttatatacatctcttgttgaaaggctacaacgaggtgcggtggtcacaagagttggatcacccaattaaggtcgtcgtcgcaccttaattggcagctaatacaagagatgagcacatgttgtagagtattccactattcctgtacctatcaatgcgcagtgagtgacggcacctataagacgtgtgtaaagcgatagcgagcgagagaaatccaaggcgtaaaaaccgcctcgaaaccgtaccgcgcgccgctgcacaggagtgcgcgccgtgtctcatctgcatcgtcatgtcccacttaatttgattaacaaactataagtatttgtctatgaatggctggtgtgtgtatgtttgcaatagggagcagctgaaaaggagcgaagcgtgacgctgatgagaagaaacgcattgataaataagacgctcgatcgatcggtgacgcgaggtcggcaacaaaaaaaacccatcgcgtcactcttaaccgtgccacttcttgctgcctccatccggttcattaatttcgtagttttctgataagaagaaagccaataattacgggccgcaagtcagccaaatcagttactcctccttgcatgtctcgtgaaccagttaggcggttaact

SEQ ID NO: 64369 - DNA, 4988 bp, Oryza sativa
cgactattgaaaccgatcaactttcggtgatcagtagatagatgtggagagatcgatccttggcgatcgctaccacgcgtgcccccagacgtatcagtcggtctcacgcccgcgcgcgccatggatatattctctccagctcggcccagttggacatttcgatcggatgagtacgatcgagttgcgtgctcctgatcatatcgctgcctctgcaccggcctagccaccagcagcaagcaggccatggggagccgaggacgacgcggcggcggggagagagagacggagacggaggaggatgagacgtggaagctgcgggtgggcgacgacttcaccgtcccggagcgcttccaccgcaagccccccttcttctccaggatcttccccgccggctcccatggtcacctactcacgcctcccatcctcaatcctctctcccctttcctgtttaatactagatggttttttttctcttgattgatttccctttgagatcaattctcttagattttctgcatatatactcactcgtactacagtaatactaccagtttagtaatcttcagggagaaaggaaacaaaagatggaaaaagcagctactgctctgatcatgcttcttcttttccagctttactttactcgtgcagcttttttacctcttcccttttttgttcaattcgtgatcgattatattagaatctcggtgtcttgtgatggcttgacccgcactaaacaacacgattgtctttactcatagtattgcagtatactagttgctcggtagactcagctggactcaattctgtcgatccactagtgtctagtctttggttgtagactgacgttaacagcacaagcattattttgatgcgaaggggccgtcatttcagtactgtccatacttctgcatattaagaatatcaacgaagaataaccattttgtctcttgagtcttggcaactaatacgtgaggtgctgtaattctcaagcatcgatgctcatatgaagaatcaaggtgctgacgatttagacacctgaaggaaatttcagtaaattgtgttttaggacatcttttattaaactaggagtggtccaacgtaaaacaacgctaaaattatctagtccaaagtaaaaaagattgattaaagggtgatctaaaatagatcgattaaaagatggcacagactgcaatttactgtattgcaattacatatagacatacttatcaaccttatattggcacatagcattagagatggcccaatggggggtccaaaagagtgatagattttgaggcccagcccgaaaatataatgggccagacagatttttatttgaggaccagcccaaaaaaggaaggaaggctcatacagtcttgttcagtcttttatcttcacctatgaataatgttcttactcaactatgtttgctaattacgtccactgcattaggtccattagtagcaaggaactgaaggaagacacttcccatgctgctaggactctttccaatctggactatatatatttttccttgtgtgaaactgtgaattagcatatgcatttatcctagtggaataccatgtttcaatcgaacagtactttaacttgattgatcaagctgttaaatgcatgtggaacatgctatggactgaaaaatgataagttccattaagcttaattaactatttggtttaacactctcttctttctttgattatttcgtttattagtacttctgagtactgaaaaagtcggtgccccataacaggaaagcatcggaaaattgcaaaatactacaagaagcaggaaaatctcctgaaggatttcagcgagatggaaaccatgaatgagattggttccttagatcagaatgctcctactgaggtaaaatcttgttaagagaacacatttcctcaatgcaatatgcaattgccagatttgtaactataaattggatgctgtatatttctttttttttttgtcttctatacacatagtgatatgaagtatatcttcatgttgttttgttaggaagagttgaggcaaatggcaaagggcgaacgattggccatcaacctgtcgaatatcatcaatctgattcttttcattgggaaagttcttgcatcagttgaaagtttatcgatggcagtaatagcatcgacactggactccctactggatcttttgtcaggtttcatactctggtttactgcacatgctatgaaaaagcccaacaagtatagctatccaattgggaagagacgaatgcagccagtggtaatgactcggttaattaaaatctgttctcttttatcagttttgcattactccgaacttaagctgtgcttttatgctagagatactaaaatgatctagacaaaattccagagttttcagatttcagattacctgcttcttattgcttcatgacaactattggagctaactgaataacctgttattttcagggcataatagtatttgcatctgtaatgggtacacttggcttccaagtgctaattgaatccgggcgtcagcttatcacaaatgtacccacgaacactcttcgtcaaattcataatccattatttatgtgatttatcagctgacactagcttaatctattatatgcaatggccttacaggagcaccaagtgttcgaccacaggaaggagctgtggatgatcggcagcatgtcctcagtcgcagtggtgaaggtcttcctgatgctctactgccggtcgttcaagaacgagatcgtgagagcctacgcgcaggaccatttcttcgacgtgatcaccaactcggtcggcctcgtcagcgcgctcctcgccgtccggtacaaatggtggatgatccggtcggagccatactggtgagtgcccccattgctgcctgcctgccactctgctagctactccatgtgagaattaatggtggatatgcagatcgcggtgtacacgatcacgacgtgggctcggacggtggtggagaacgtggggacgctgatcggcaggtcggcgccggcggagtacctgacgaagctgacgtacctgatatggaaccaccacgaggagatccggcacatcgacacggtgagggcctacaccttcgggactcactacttcgtggaggtggacatcgtcctccccggcgacatgccgctcagccacgcgcacgacatcggggagtcgctccaggagaagctggagcaactccccgaagtcgagcgcgcctttgtgcacgtcgacttcgagttcacccatcgccccgagcacaaggccgaggtctgaattctcatttatgcaaattttctcttcacttcacttcacttctgtttctgtttggcttgtacaagtcatcgtttccctgtgaaacccacaaggatgtcagttttactaccactgtctctgtagtctttaagtagctgtgggtgaaactgaattcttgttgttcttgttttattgagaagagaaaactgatcgaattcttctagtggattatatacgctgtcttttgctggaaaatggccaaaatggctgggcatgtgtacatgttgtacccatctgaattgtcatatctgtgatcagaagtactactatatatatatttccatttccggtggtcatgtcactggggcagtagtgatgaaccggactagtttgtcattagccccaggcatgtccattcaagttagcttgggccctatccaactagggcagaaaaactcacaaaaatacaaagggcaaaccatgcatgaggacagtgcctgtgacttgttgttctgctggttcgttttattgggcgagttgcagctgggtgttactatgtgggagccctaagtgacaggacaaattatcaatagcttcttcagctggaaggaaaagaaaggacatggccattgtagctgtgatcatcactaggatccaaacagccccacaccttgtgttgttgcttctcatcgatcagctgggattggaaagaatccagtaatttttttttcacgaatgcgcaaaatgattgcatgtcaatatattacaagaagacataatatatttttaaacaatgcaattggtcatacggtcattgcctggggacaagaaacaaagaaaaaaaaaagaaccaccaaagtaaaggaaaaaactactactggaaggctgttcacaactcagaaggtggaggcggagccatactgctcttccaacaagcctctaaagacaacggcgtgttcacaactcagaaggtggaggcggagccatactactcttccaataagcctctaaagacaacggtattagtacaagaccacaaacagccttcctgaaggatggactttcaaaccacagagacctaggagagagaaaaatcaagaattctagaatttcgctcctttcaatgctgccaaaagatgaggactagatagtcgaagcccactcgaagatgctcaagcagtagaaagcgagcagccatgaggaggaacgaggacggccagcccgaaagaatccggtaattgtaacaaaataaaattaaattgctgggtgagatggatgcacacccttgtgcatcagcagtagcatggacttgtggtgggaagcattcatctgacagcattattggtaacaatggcaccccatgattgaattgccatatgctattaatttgttctctttacggctatactagacagtccacgcctaatgtttggcggttgttttgtttgatatccttttggacgttttctaatttctagtgcagaaaaatagcagcagcagcagcagcagcaaaacaggggacgtttgagcgaataatacggctataaacgactcacctaaatgctagaacaaatgccaaacattgttcatgacattttacaattaacaccggtttggaaaacaaaatgctgaacaaccaaagagaactgaacaccgaacattagatccaaactgcatacccctgccttgttttgtacttcctcagtttcgcaa

SEQ ID NO: 64370 - DNA, 3851 bp, Oryza sativa
atttttgagaagaaagtacagcaattggtgttcgtccaggcaagttcatcacgtgcaaaggagaaaggtagcaacaaggcaacctatacgatggatggattgagatggaggccggccgtggcgcatgtgagctatccgtcgtcgtcgtcgtcgtcgtcgtcgctgggtccgggcaaatggaccccgggcgaggcggggagccgtacaccagcgtcagccccaatcgcggcacggtgtaacgcgccgcggcacagtcgtcgtcaccctgcagcatctcttgcacttgctgttgtactacactagtagtactacctctcctcctctcgatcagtaactcattattataattactattattctactctgatgaaggtcctacgtcgtactgccagagattaaacaagttccctacttgcccgtgattctcagtttcaggactgctactactgttcttctatactgctcaggagtaggactactgtacttacttgtattagtattttttttaccaggcaatgaggcattcagtctctagatgtaattactctttccgtcccaaaatataataacttttagctctcaagatttatcctaaaacataacaacttcttcaccaacattctttttccaaccaatcacaatcctccaccatttactcctacatacttttttaataaccatgtcaaactgtaaaactttttatattatgggacggaggagtagctaggagtaacacagtaacttaattaatatcacatctgcacccatatgctcttaactaatgtaatttacctaggattttcaggtggtcaaccaagtaaattgttaatgtgttgcacctgtaaaatcttcttcttccagtagaaaacgaagtgtattatactactccaaacttatatacttggggcaactctccttgattcccgcttctcacacgcattatttgtttcagagcggaaacagccaacgctaacctaactagttaaaccaaaagcctagctttccaagcacaaacaccgaccatttcttcactctctaagctagctcgatgccgccaccgccggcgacgacgccgctgcctcgccgtcgcctcgcgctcatcctgtgcctggcgtgggcgctctggctccacggcggcggcggaggcatcagcctggcagacgcgttccaggcgccgacgccggcgagactctcgtcggggtcgtcgtacgccgtcggctcgcggccggtccccgcggcggcgccgaggtggagctcgtcgtcggcttctgaagctgccgcccggttcgccgacgacaagcggcggattccaagctgccccgatgccctccacaacaggtagaatataagatacatacatgcatcgatcgattcagctagctagacatgagtacgctcgatcagatcgatcgtagctagcaatttgtagtagcttgtacgagcagagaatgtgtgtgtgtcatactgcttggctgttcttccaaagccaactcgatctaaattgccggctatggtgtgttgcacggatcagtgattactgcaagcacggcggccatcgaattgggtgcctttgatgtgttctgtacaggttcctgcagggaagtgtgttcttactttcagtcatatactcatatatacaagaattcgtcattgcatattgtcgttgctcctgttcacaccagcttcatgcatgcggcggagatcagaaacttataatttgccatggttatttcagagagagagagagagagagagagagagagagagagagagtaattctctacttcaaattgctcactgcatcagttgagtgctaatgtactcactccgtttgaaattagttatcgttctaacaaatttcacacaaacctaagagatatggcagattacatagttaccctcgtttcaattcacacatcccattaattttctaaagaaatgagccaattaaagttgtgacagtataactatatcgatgaaggtttttttcatagcctattctttagccttggtttataaactgcaagcaaataacatataaaatatttagctataaattaattttagttaattcatttatttttttatatctcattagccctaactcaaccacaatcagagccgaatttaggggatggttattctcaccccgtaggtattggcaaagcttctgaaaatagataatgatccaataccatagggaaaaaaactgcatgaacttcataaaaactgcaacaatgctgtaatgttattctcaagtttaccacaatatatattattggcttgtagtcaaatcgtcaaatttattataaaactatttttttacatgttctacttctatctacagtttcatatacttcacaacgcattcgaaagatacggttttgcgataattttgcgaatcatttgtatttgatgaaattacttaaaaagattttatgatcaatgattttggaaagcaatctgcacggtgtatgcacaaaatgaaatcagccttcctccataggggtagtacaatgtcaggatcgatgcctcatcaagctagctctccatcgatgcgatggttaatttccagatcgagcatcttttgtcccgctctcccactacgctaagctcacatgtagaggaacatgtaggatgactatttaatttcttaatgaatttgtacattaaattagcgttaatcagctgagcgagtgcattattaattggagcaatcatcgacagagtctgcaatttcagacaccaatgggtcaagcttatattaattgcgttgccaatccccatacgtgatcttcatcagggcgtgacgcgtgcctctccagcatgcggtagacagcacgatcagatcactaggccaccatgtcgtcctcgactaattttggtttatggatgcgtttagatttaggttgaaaatttttgccatgtcacgtcggatatacagacacacattttaagtattaaatatagtctaataacaaaataaattacagattccgccgataaattacgagacgaatttattaagcctaatgtttattgtagtactacattgtcaattcattgagcaattaggcttaaaagattcgtttcgcaatttatacgtaatctgtgtaattagttttttctatatttaatactccatgcatgtgtctaaacattcgatttaactggattaaaaaacttgctagggcatctaaacaggtcctatatatatatgtatgtatgtatgtatgtatgtatgtatgtatgtgtacacacactacactagtgctgcctacacgtatatattggtgtaccatttcttcactgataaaaaataaagattaagttaatgtacgtacaacaagaaaagatattagcacgtgactaattaagttttaattattacaaacttgacaaataaatatatttgatattttaaagcaacttccacatatcttaataaggtaaaataattgacaaggatcaacaatggagatccaaacattgtcatggaatcctatttatttttgaacttttagcagtttaaatacttgaagttagtatagcatattacaaagtatattagttccacatcaaatatttagaagttttcatggtcaaaatgtgaataacgcttgtggcaacttaaccctgaaaaatatttgaaaaatactttcttcgttctaacaagaattaacttattatggctatatgcaaattcatagccataagttattactcttatcatctactatattattaggataaccttaaaattatgcaccacattcgctatagagcctaaaaatttccacattaatcattaaaaaaagagtccaggtagaatataatgggctgcaggaatt

SEQ ID NO: 64371 - DNA, 16605 bp, Oryza sativa
aatccgtcatctaccactttatattaaacagtgagccatttggatcagcatcaacaattcacatagaattccaacgaaaatatgaatttttctattaacatttgaaaaggtaataatgtgatttattttttaattatgttgcaaagaatgagcatttagctagtcaaaagaaaatcatctaaaggctgaagtgaaaactaccgaaaagagggggaaaaccatggcttccattagttgtcatgtcctctttccaccttggcctcgagtgacattttgacttcagaaaaaataactcattcattttctgattaattggaccagcttcgtactagaaccgaatgagtgcgttttttagctttaaggtacaattatggagaataaagggtagattttgtaggtccacatggatgtagattattacttcctctaacaaaaaataattgacctattcgttttaaaaaataataaatgacctttgtacattatatcgtctctcaaatagtttccataactttaccactatggctctgtttagttccgaagtttttttccaaacttccaattttccatcacatcaaacattttatacacatacaacttttctataacatcgtaccaatttcaattaaattttcaaatttcagcgtgaactaaacacagcctaacttcgaatgcaaaatatttgacacctgatatagtctataagtttataaaggtagtattttcaagataaatcttataatatgatccctatgcatcaaatgtagatatttatatacatcgacgttaaaattaaaattctgatttgaaacatatcaaatttgatatgttatcttttggctagagggacacttgaatttggtaaagcaattccagaccattttcgtagaagtgtgactgtttcactgtttgtaattcactatgtataattttttaaaaaagtctatatatgcatcgtatggaacaactagatatttaaattgataaatatgaaaaatcctcaaccatgccgagacagttttccatagaaatgatatcgtttttggaccgttttcatccatagtgggagaatccaaccgtctgggcctgcgaggcgccagcccagatttcgtcgtcgcggcccgctacagatgggctgccccctgctctccttttacatgttgctaggccgaattggctgggccaattgccggggtacacacacaggtggtcgcctctgaaatctcgcatatatgcccccatagatggcacagtgaggagagagcggtacagtgggcagcagcacggccacgtgcagcgtgcgtccaaccccaagccgtctcgtgagcggtggtctcgcacgccacatgtgagctttggcctttgggatttgggaggcagcagtgcgtcgtgtccggcccggtcgtggcaggcagacgccgcaatggacaaagagaaaaactgtactacaactagtagccagtaggggccatccgcctaattatctggtccatacccgcacaggcaagcgatcgctcttgccacgccaccacttgtcccacacatccttccgcgtgatcaccaacttacaaacgtaataagcgcctcttccggaacgggatcttttcaacgtattctcaacgctagatcgctaccgtagcagcaacctcttgcgtacgtgtgcttgttcaaaccttgcaacccctttataacttggaattttgtccatggttcatgtgaagattaaaggggtgatgtgtgtttggtgaagatgggggggtccaaattaacttggccgtgcgtgccgggtgatgtgggcgcatgcgacgagccagcggtggttccagctttgtcaccttgtaccgcgtttctcggacacgcagcgcgcttggaggatccttgtccatttttgatccgtcaaatttaacatctctctatagcttagctgaatgccattgccagcgagagcaagtcaatcgtcgatgagtgaagcatcattcacgcatgggctgtcagttgcccatgcgcgccgattgcttgcttcactgtgtgcgtcgttccgcttaatttgctcgatcgattcacgcgagcacaatcgcatgtgcgtgcatgcgtgcggcattcaatcaaaatactcctcctatcattcatgatcctctcgctacaccacttacaggatctgcagctgatgatgatggttgatgagctgatgttgagtgaacaaaagggatggaggacacggccgggcacgcggctggccgccgtggtccgccaatccggcaagatattatggcagagatgataaggtgcgtgcccatgtcgcgtgcagtccagtgctctcagcctctcgctatccgttccagtcgcgattctcgtctccaatgccggttactacgtgtcttgccgccattcatttattttcttattccggttttgcaattacgtgcttatgttttctgttaatcattcttgcaaatgttgtgcaagtacagtaccagtactagtagtagtgagttgtgaaagctgacgtgttgctgtgcccaaggttgtactagggttgtagcacctcgaggacgaacatgcccacatagacatttgttgcgatctggggcctattctgtttttcggtgattctccaatctatcgttgagtagcgtgcctgacaccattcttttttatctttacagctaaagaaacacagctttcgatccatttgtttaatcaatcttgtgcttggcttaacttgagccaggtggatgcatgcagatcagcagatgtactccaccgttgcaacattggcactgctaaaagcatgatcagtggttcacaagtatagtagggatgcaagtgggccgaccagcgaatctacttacttcatccgtttcacaatgtaagtcattctagtattttccatatttatattgatgttaatgaatctagatagatatatgtctagattcattaacatcaatatgatttggaaaatgttagaatgacttatattgtgaaacggagggagtgtatgctaaataattcgtgggttttcatatcatagctcgacttgccacgtcatagagatgcaaatgaattaacccataaacttatttataggtcaaaattagtaggtaaccctcaagtcaacccgcgggttactcactaattttacctataagcgggttcacgggttggcccgcttgcatgtctagtgtctacgtaatcatcatgcaaataactcatatatagtagtatgttaatagtagtataacatactactataattaatgatttagcattataactgatgttgattttttattcttacaatttttcactcctaacatatataaaagaatcttttccatttataattaagtatatgcatcaaccgttcaacatttaacgacattccagaggaccaattgccccatcagtaacctatttttaaaatttcttcacattctagtgcaatccatcctcccactcaatgatggcacaaggcatcggcagtttgagccctagacctgacttcataatccccttttgaatcatgtgagaataccatacaatttgtgaaaaaaaaatgacgaatgcgacgggaaaaggtgaggagctccagtttatatgagtagggtggagaaacatcaagccatgagctcttgccagcaatcccaatggtgatggcgactgtggtaaggtcctctcggtcatcctggtatgccttccaattgttacatactcctctcttcttcgaaactatagttagatccaatttgttcggttcgttggcgcaattgtggaacacgtggcaaagcgacgaagctacacaacaagatgctcaggccatgtctctactcactacgtgtatgtgtcgaggctatcatgccttctataagacacgagaaacctttgcaagccattcgcttttttccctctctcctccacgtcaactcttcgccaacgtggctgagcgaggtcacacgttagcaggaagagttgtttattcccttatgtcattaacaatgtggtgcaaaaatagtacataggtaatactccatccgccccaaaatgtaaggatttttttagggttggacaagagttataagaaagtacgtagaattaaatgagagaatattatgcttggtagagaaggggaggtaggtaagaagattgaacagtggagggttgtaattgattgagaaaataatgttggtgaataaattgttatattttgggataaacccgtaagggctaaaatttgttatattttgggaccgatagagcgagtaatattttattcagccatctaataatattatgtaagagaaataataaaagatacccatataaagtaaacaatattatctatatctacttttcttttcttttttgcctaatactactttgtatatatatatatatatatattgcgaggattgttataataaaagttgatttatttaaatctaataccccgattggtgatgcgctagtatcacagtatcactcagctggaccccctgtcagtcatagcgacagagcactccgattggatatggggcctataaaacagagaaaaaaagcgccccatccaatgaacatgcatgccactcaatgcatgcagtgcagtagaggaggagtactgacactgctcagcgtccctctccctgcacatttactcgtatgcacagcacaacacacactcctctcctctcctatctccaggctcacagatgagctgtgagctgtgtgtgtgacacagtctactgctctctctgtacaaagggagagggtgagaggaaattaacagaggaaggagggagaagaaatgcgagaaatgctggcgtctctctcttcttcgtcccgtgcggccatctcctgcatcccgttgtgtctcctcttcctgaccttggcgagcagcaatggcgtgtttgccgcagcaccacccaaggttgggtccgggtacaagcttgtgtccctggtcgagcaccccgagggaggagctctcgttggatacctgcaggtgaagcagcgcacctccacctacggcccggacatccctctcctcaggctctatgtcaagtaagaacagagtaaaatcttttttatgcgactagtgatcacttgttgttcgattccacatgccttgatctttctgtgcacagtgttctatacatgttccattgatttggctccctcccaattgttatctaatagagtaagtgatagtacttacatttgaggagaatgttcgtggctgtaacaattgatagtttagttgcatcttttcttcaatagtaataaagaacgacttgcatttctgatcttgcatatcataatcaagctcgattgaactactgctcgaagaagtaagattggaccacaaaagttcgatgctttgctcaattttttttatatattatgttacaatgtactcatcgtgctcctgctgcttcacagcatgatttccatatgttctaaagattactgagtcatattcaacgctagcgctctaatggcgaaattgcaatgctgcgcaggcacgagaccaaggacaggatacgagtccagatcacggacgcagacaagccgaggtgggaggtcccctacaaccttctccagagggagccagccccgcccgtcaccggcgggaggatcaccggcgtgcccttcgccgccggcgagtacccgggtgaggagctcgtgttcacctacggccgcgacccgttctggttcgcggtgcaccggaagtccagccgcgaggcgctcttcaacaccagctgcggcgcgctggtgttcaaggaccagtacatcgaggcgtcgacgtcgctgcccagggacgcggcgctgtacggcctcggcgagaacacgcagccgggcggcatccggctgcgccccaacgacccgtacaccatctacaccacggacatctcggcgatcaacctcaacaccgacctctacggctcgcacccggtgtacgtggacctcaggagccgtggcggccatggcgtcgcgcacgccgtgctgctgctgaacagcaacggcatggacgtgttctacagggggacgtcgctgacgtacaaggtcatcggtggcctcctcgatttctacctcttctccgggccgacgccgttggccgtggtggatcagtacacgtccatgatcggacgaccagccccaatgccgtactgggcatttggtaactactgcccaacttcattttctttgttttttcatcatttttggatgagttctggtgtcctttaattacgttttgtctggtagttttattagttttgttttgtctgtatagtttgatccatccatcaatactggagtatatttattagtactatgattagctaattttatagtagtaccatccagattcaatgatgagatactccaaatctccaatatttggagacagcaggggtatgggatgttggtcacatggcacacgctaatttaggctttttggaatttggggacagcaggggggcagtttgattgtgggttcatttgtcttcagtcaattcttactatgcaatatggcatttttcacctgtagtagttgattgcaattagtaactggtttccaatagatgcaatattcccctgcagggtttagtagttccaatagatgctactccagaatgaagtcatgccagctgctaggaatagtttctggagttgcattgttactctgtagaatatgacactgacaatgtttttcataagttatactagtgccctactgatctacccagctcactcaaaatgatcagagacgagagaaacaatcagcaacacatcagttgtcttgcctaggcatttcctgcaataccatgtgttgtcattttgctttcaacaaagtagtactcccttgttatcacgacagtaaacactgtttagatgcacatattgccagatgcagatcataagtactaactttaactgtcagcacatcgataaaatatggctcccgctgcacaggatcagatcaagacagtaattaaccaacaaaaaaaaatgcagagtcggtgctctaaattgtactgcaaaacaaatatgcaaataccaaataattcgtttcagataacgatgcgactctctaatgttcttctcacatgcttgttctcagggttccaccaatgcagatggggatacaagaacttgtcagtggtcgagggcgtcgtggagggctaccggaacgcgcaaatccccctcgacgtgatctggaacgacgacgatcacatggacgccgcgaaggatttcacccttgatcccgtgaactacccgcgtcccaagctgctggaattccttgacaagatccatgcacagggcatgaagtacattgtcctcatcgaccccggcatcgccgtgaacaacacctatggcgtgtaccagcgcggcatgcagggcgacgtcttcatcaagctggacgggaagccatacctggcgcaggtgtggcccggccccgtctacttcccggacttcctcaaccccaatggcgtctcgtggtggatcgacgaggtgaggaggtttcatgaccttgtgcccgtggatggcctctggatcgacatgaacgaggcatccaacttctgcaccgggaaatgcgagatcccgacgacgcacctgtgccctctgcccaacacgacgacgccatgggtgtgctgcttggactgcaagaacctgacgaacaccaggtgggacgagccgccgtacaagatcaacgcctccggccagacggcgcggctcggcttcaacaccatcgccaccagcgcgacgcactacaatggcatcctggagtacaatgcgcacagcctgtatggattctcgcaggccatcgcgacgcaccaggcgctgcaggggctccagggcaagcggccgttcatcctgacgcgctctacgttcgtcgggtcgggcgcctacgccgcgcactggaccggcgacaacaagggcacctgggagaatctccgctactccatctccaccatgctcaacttcggcatcttcggcatgccgatggtcggcgccgacatctgcgggttctacccgcagccgacggaggagctctgcaaccggtggatcgagctcggcgcgttctacccgttctccagggaccatgccaacttcgcgtcgccgaggcaggagctgtatgtgtgggagtccgtggccaagtcggctcggaacgcgctcggcatgcggtacaggctgctcccttacctgtacacgctcaactaccaggcgcatctcaccggcgctccggtggcgcggccggtgttcttctcgttcccggacttcacgccgtgctacgggctgagcacgcagtacctgctcggcgcgagcgtcatggtgtcgccggtgctcgagcagggcgccacctcggtgagcgccatgttcccgccggggagctggtacaacctgttcgacacgaccaaggtggtggtgtccaggggcgagggcgccgtgaagctggacgcgccgctcaacgagatcaacgtgcacgtgttccagaacacgatcctcccgatgcagcgcggcgggacgatctccaaggaggcccgcgcgacgccgttcacgctggtggtcgcgttcccgttcggcgccaccgaggcggaggccgagggcgccgtgtacgtcgacgacgacgagcggccggagatggtgctcgcggaggggcaggcgacgtacgtccgcttctacgcgacggtgcgcggcaaggcggtgacggtgaggtcggaggtggagctaggcagctacagcttgcagaaggggctcctcatcgagaagctgtccgtgctcggactggagggaacaggcagggacctcgccgtccatgtcgatggcgcgaacgccaccgccattgcaacgtcgaggccgtactttgcaggtgccgaggcggagctgcacgggcaccgcgacgtggagggacacaagaagagcgtgatggtggaggtgggagggctggcattgccgctgggcaagagcttcaccatgacttggaacatgcagatcgaagcatagatcgaagctttcttatgctttcatctgcatttctccattctgtctctctgattattttaggttctagatcagcaaggttatgtcaacgtgttcaacgacacaccaccatctctgattctcttctgcatttgaatccttgtggaaataaaacatgattctaaacatatatccttctttctgactcttacatgtgcgcacaagggagacagtcgaaagaacatcggctagattgcggatttgcggtacgaatgccctcacgaatacttgagagagtggtactaacttgagagagagtagataatactagaaaatctgtcacataatgtataggcagtccctagtagaaatatattacatctcccgtctctttactctttccaaaggaggaagtcgaaggtaacaaagtttgaatttaattcggattatgcttggacagcttagactgtccatcacaaaaatgataagagtgaattttgcatatgaactctgatttgaacgttttagtattttttggaaagctgttttgtgacctacttcacggttttatgttcggaatttttctctgtggtttggtacgaaacaaaccgatggttgctgcaggcttggttcatcaggaaaattattcgggccatagttatttgaagcccttgataaggaatggtcatgtcataccgcagcatgtggcccataaggaaataagcccatcagaaacttttgacaaacccgtgaacaacatttgtggaccaaatacaaaggtgggatagtgcgtggctaccaccaccgtcacgtcacgagaggcatagtagttgtgtacaaccctgaaaaattacacggctagtggtaactagtttgtctaaatcagctaccactctatctataagagttcctatccatctatacttcaaataaaattttctcttaaactactcatccaatttacgatccgattacaccgttgtatcgtaacaattatatctttataacaatatctcacgtgattatattttgatgaaaaattataaattacttttataatatatctaaattacttttagatttcactaaattacttcttcgatatataaaagtaaattcaataaggtttaaaagtaatttacatatattatagaagtaacttataacaaaaggaaagtaactttaatgcatgccttttttcattggacgtgactacacaactagtggtagctggtttgtactccatctagtgtttcctttcaacttgaaaaatgcaatatagtatgtttccgttttgttttaagatacttttataatatatataaattacttttagactttattgaatttacttttatatgtctaagaagtaacttagtcgaatctaaaagtaacttatatatatatgataaaagtaacttatgttataataaaagtaattcaaaaatataaatattttttcatcgtaatataatcatgtaagatctttttgtgaagatttaattgtaacgaacacactggtgtaatcgaattttagatcggataagtaatttgagagaaaattttataagaaggaagaaaaacacatgcatgtctaagaggaaaaacaagcatgcatgtcagcacgtgtagcagtccttcttacaaattggttcgtcgctggttaacgctaaactgagaggcttctcggtttagattttgccatgaaaaatgcgcgtatttctccgctctacacatctcagtttcgtttatcaacgacttaaatttagaataaattaattttacatgcattccaataaaaaataacaaaaagacttgaatgtttatagtttatcaaatctcaatgcaactattcaccactttatctatttccaatacaattattctctactttcataaatttctatgcaatgattatttaaaaggaaacttattttagataaatgatagtatgagtggaaataaacttaatatggatcagataatagtattacttcctctgtaaaaaaactactaccttcgtcccaaaatataagcatttttagctatgaattgaaataactgtgtttctagatttatagctaaaaattattatattttggcacatagggagtactaatttgaatattaatctgattatgtataagagctggtaaagtggtaaagtacgtactcctcatcctcgtgctaatcgagtcgacgggcgaaggttatcaagtagggatgggcattcggtctaatcgaaaatttcggtctcggttttcggtctttttagtttttgaaaagtgaagaccgaatttcagcgcaaaaatatcaggaccgacaaattcagtctcaatctcggtctcggtccaaaccgaaatttaacaacattttcatatatgcaaagaaataatggaaattttcaacacaaaaatcacaaaaaaaaatcgtaagcacttatgagtaaaaactcttattaggttacatgcttagaagaagtaggagtgtgaaaattagagtttaatcctattaaacatagtggattataggttacatttagatatttttctataattaagtcttttttgtctattcagttaaccgagaagactaaccgaattgatgaccgaatcttttagtcttagtctattcggttccgtctttttctaaccacctgcaaattgtgtcctcgaaccgattctgagttgcgatgtcgacgtcaagtacgtactcctcgtcctcgtgctaatcgagtcggcaggcgaaggttatctcaagtctggaaggttatctcactgcaaattgctgtggccgctctgctccttgtccgtgctccgcgccggacgacacccgaaagcgacgcgcggctcccgtcacgtcaggtcacgtcccccccactcgtgagccgcgcggcgccaaatcacgccacgccgcgccgaggcccgatgaggagtcggccgccatgcagctgcagccgcgccgcgcgcgggcagagcacaagttgccgaacggcacaccacgcgacgccgaaccagccaaccaaccggaccccaaaacacagagcgggcgccgcgccgttgtcaggtcaggccagttgcattgcagccgcagcgcgcggtcgcggtccgcaaaactccgcaccgcacctttcgtgccgctcgaggcgctgacccgcgactgacgacgacacacgaccccattgccgcgcgacgaaacccaccgcaccgcctccgcagccgccgcaagcccggatccacttggatgcccggtttcaccatcgcgccgaggtttgttggggatgtccggttcaagcctttcgtatcacctttattttgcctccttatcggcgcttagtggtggtggatttccggattcgtttttgcgatcgttggcgcaggcggttgtagaaagtgatcgtgccgacacaccgagaatggtcgacggagttacttgcttttctggaatttatgtgctcaccaacaataatttcctcgatttggcttggctagtggcgtacgtgatgcgacgacgaccatgtttgccaatactcggcatccgtttggacgttagcccggttttccgggcactgcacatcaccaaaactgtactggcagagtccaagacggtgtacttgctctgatcaatagagttcgagccccggccaaagactaaccaactctcgcttgcggtgtgccgcgcggttcagcacacgagaggctctccgcgtccatccatgcacgatccgtagttgccgcgcgcgagatcgacaagccacgagccaacgcaaggacagctacttttgccgcgaaacccgtgcagctacagaagagccaagccccggtttggggcgaaaggcgttttcttcttgttttttttttttggtccttcccgcgatattttaaagcctgcgtgtggatgggtccctcccaatacgaggaagccgtagctggtctagagtccgggagccgaggcctagtagtacttcgccggcaacggcgggggccaccgtgcagtgaaagggtcgtcagagaaagcgtccgcgataaggcttccgcgcaagcacaccacgtccaatgctctgttcggccatgccagactgccaccgtctcgtggatcgaggtcgatgaccgatctctctctctctctctctcgcatgcccctgtcggggatgagccttcaaaggggtcagaatcaccgctgtaaaaaaaactgtgttatttttacagggtgcgcattgtcgttttcgtcgcttttttttttttttaccgtggtggtggacactggacagggagcagttgtggtaggggtaacatggcgaggacgaggacctgacattttccggcgactgatctgtcttctcgttccctggcagtccggatcgctggtcacatgcagtgcagaggcccgtgtccggtcaagccgcggccggtgcggggcagtgcagcgctctgcgtcgatcggtccgtgcaatcagaatccaaaaccgatctcgatggtgcacgtactactgctccacaagttgtactgttccatggctggcgcggcggcagggttgggctggcctcgtcgcgtctccatcggacgccagaagctgctgcgctagctgcccgccaaaagccggagagaagcgccaagccaaaacccaggtgatcgatggaaccaacgattgctgctgccttctgccctggctgccgactgcatcgcatcgcatccaccgcgcacacatcacgcaggacgttggatggatatcatattcgtactaccatcgtactagtagtactagtcctacatcaatccagccatccgtcacgtgacaacgggtcgccgccggtggtccagcccaagcgggcgacccggtgatccagccgaaactttggccgtccgtggctggcgctggctggaccgtccgcaaccggatcgcagtcgcagcacgtaccagccatggaccgcaacgcacggattggggtctccgtctcggtattcctttcgctcgcctgcctgccttgccgccctccgccaccacagcctgtgaccaccaccaccaccactgccatccctttccgtcggtacgtgctgtatgtacgtgcgacgccgacggttgccacaggcgtccctgtcgcccaccgtggctggactggaccatctccgtctccgtctcgctgtacgaacgtatccctgccgacactgccattcggtacggcgtgatccgtgcgtgcgcaatggtgcacgtaattatacagtgttacaaggatcaagggacacggcgtgagcgttgtaaaggggcgcaatctccgccggaatcatttttagtggcgcctaatgattggcaacagctggagtagctcgtgctcaggccggaaaccgaacaaatgaacattggagccgcttttaactgacagccagtctggtctttgtgttggtagccggaatagtggcccagcagtagtcaaagaaaaggattcagcgagggtggagcagagtactcactcctacataaaggcaaaagcgacgatcggctgcgatcgattggattggattgcgcatgcaactgcggttgcccataaaacaatgccagccaggtcgagcaagcgaccaacgcaacgcaggcatgcagcacaacatgcgagcaatggagtgcagtccagacacaccgattgctaatcagtaatcacacacatggtcacgtccctttcccatatgtcggcgcgccgcaacgtgttgctgcgtgacactccggcccggccgggactactcccaggcacaaaggcagtgtagcacggccagtagccgtgtcatgactcatgcgtactagacagtgtggtctacgagatcgttcacgggatgaacatgcctggccgttccatcgtgtcacggaaccgatcgacgacctcgatcgatcgcccggacggtttgtacgacagcagcaagcacgtcagtcaatttggcgaatccaaggcaaaatcgccgagtttggacggtggatggtagctttgcctttgtacgtgcgcgtgccccaacaggcacacacctctgctaccgccaaaggagtactatgccgtcacaggcagcgtgcaccggcatgtttggtagcgtgtgacataccggtactaaatgggctatttttttttcttttagaatatcaaacccgtccccgggaggagggggagggggttgtcatacctgaattttattaaattagagggaaaatccacacagcaaatcgttcaaattacatattactccctccatattttaatgtatgacgtcgttgactttttaaccaacgtttgactactcgtctttttcaaaaattttatgcaaatataaaaatacttatgtcatgcttaaaaaacatttgatgataaatcaagtcataataaaataaattataattacataattttttttgaataagacgaaagatcaaacattcgtcaaaaagtcaacggcgtcatacattaaaatacggaggggtacaaattatggaagagaggaggaaagtaactccttccaagagaataattggccgatcgtcggagatgctcgcccaaagtgtgccgtcttcaatatagtcacaaggcgaggtagcgacttacgtggtgtttggatctaggatttaaatttagtctatgtatttagacactaatttagaatattaaatatagactacttacaaaactaattatataaatgaaagctaatttgcgagacaaattttttaagtctaattaatccataattagagaatgtttactgtagcatcacatagactaatcatggattaattaggctcaatatattcgtcttgcgaattagttcaagattatagatgggttttattaatagtcacgtttaatatttataattagtgtccaaccatccgatatgatagaggcttaaaagttttagtcccatctaaacaggatcttattcagtacgtgcaaaacaacattgtggcgacgattccataaaccccagcaacaaattatactctaaaacatttggtagtgcatgcgcggcatcctcacctggcaagaggagagagaggaggggggggggggggcgcaaaatcgccagctcctccatgggcgacattgttatctactactcccttccgtatttaaatgtatgatgccgttgactttttaatcaatgtttgaccattcgtcttattcaaattttttttataaatataaaaatatttatatcatgcttaaagaacatttgatgataaatcaagtcacggtaaaataaatgataataacataatttttttaaataagacgaatggtcaaacgttgattaaaaagtcaacggtgtcatacattaaaatacggagggagtatataccaacagattaccgaaatgcatttgtgaaaggcatggatgcacatatgcatggcagtttcctccaccttttcacttagtttgtacaccgagacgagccactgaactcttgccaaatccatctcgccgaggatgattcagtagaggcaagggaagagtggaaaaagggggggggggggaatttaactatttaccacttttaggtttggcaattatccaaatgttccttttaggtttgcgcttaataatttgacattggagagagatgatttcttaactatttgccacttttac

SEQ ID NO: 64372 - DNA, 2341 bp, Oryza sativa
tatacgtgtggctggtagctgggcacatcggggctgttaacagcggccgggtcaacaacgacggggcggggcgggggcggccgccggggaggacgaggcgcttggacagcttgaggtcgtcctccaccgcccttgcgaagtcctcatccatcgccgccgccatccttcgtctggctggaggaggagaggagttggaggaggggaggacgaggtgtctccgtcaagcctcctcctcctcaagacccgcgccatcgacgcccgccgacctcgcgccggccgctggccctacgcccgttggcttcgcggccgccggttcacctcgtcgaaggctagagagggagaagaagaaaaggggagggctaacgggtggggtccacgttgctttccacgcggacatgccacgatggcaagccacgtgaacaaaagtggcaaatagtcaagaaatcacctctctgcagtggtaaaatattaagcgtgaatctaaaagaggcatttggataattaccaaacttaaaattggcaaataccgggaaaaagtggttgggggcaatacgaggagaaacttgaatgtgagttagattaggtagctaatactttagattacctacactgcgaaaataaattaaaatggttgcgtcccttatataatatggggacgaggtagtaaatccgtaatatatgagcttggctactactttcaacggcaagtaaccatagcggcacaccatcaatagcatattaggtaagatgataaccaaccaacaaccatatgttacgatttaatccctccatccataaaagttttgtcaccaaaactaaagaaaaattaaatcattttggatattataaaatcaaaagtgaatttaaatatgcagccaataagtatttagattactccttgagttctaattaaatatttaatttatctaattaaaatcaaaaagtgaatgcaaatatgcaattaataagtatttagatgacgtcctctcattggagctcattgtgactccctttgttttatattataaaattattttaacatttttttaatcgaactttttaaagtttgatcatgtacgtagaacaacatttccaagacagaatacatatattatcaaaatatatttaatattatatttaattaaactaatagtattttgttgctgatgttgctaattatttttatagatttagtttatctaggaaaaaaatgatcaaaacgactagtttaaaaagagcaatatctattccacattccaaaatatatttaatattatatttaattaaactaatagtattttgttgctgatgttgctgattatttttatagatttagtttatctaggaaaaaaataatcaaaacgactagtttaaaaagagcaatatctattccacattccaatggccccaaactcttaaaatatcggccatcctctttattaaaagagactactcgattgttggaattgaataagcctcccattcccatcgtatgggatggacgaaaattgaactgataaataaatctttcaataccgacaaataacaaagttgtcacgagcccgatccatttcataactgtcaaccgcaaaatgctgggaatactgcattccacctttctacagcctggacagagaattccgaatgttgatagcaagccccactttgaatgatcactgatcagggatgacatgctgatcaaggaaggtataccacgtcaagtgtgatcgaaagcaagcaggcaaagaatgcaaagaaggggcatttggaattgcagcaatttgcaatctgggaattgagatgccaccacatcatcagctactccagctagctaacctcgtcaacacattgttggctacgcactcgacattgattcctgtaccacgcaacaattactaccaagtaatctaggggaaaaaaccaaagatgaatccgatcgatcacttggcggcgtaattgggtatctcgtagatttggtggatcctccaaatgtcgtcgtcgaaggccatctcggcgtcgccgcgggcgccgaggcagcggaagtcctcctccacgaaggggaaccaccccagcagcttctcctcctccaccccgaacgtccaccacgacaacccgttgctgagcccgccgtcgaggtcccactcgacggtggtcgccgccccggcctcgtatcccgcgccgccgccgccgccgccacacacgtcgggcacggtgggcgccatgtccgctccggaggagcaggaggaggacgccggggatgtcactgccgcccccgcccccacagacgacgacgacgactcgcgcgccgccgccgccgccgccgccttcttggctgccgccg

SEQ ID NO: 64373 - DNA, 775 bp, Oryza sativa
tatgggatacccaccaacttgtccatcttgcaagaattccaaattagacccaactaaacgttatgctttgcatatcaattgatgtacaatttttcatcagcaaaggtctttgactgaaaattgcaattaaccatgaattgacaccaaatcttagtattgtaagcaactatgcacctccagcaattacaaggaaatatctttcactcagagaaaggtagaatttacctcattcatccggtggtgtccgcacaacagatgagtagtaatgtgcctccaactcctttaggcttcctgctgcctcctgcccaatcctctccagcattctctctgttccttcagcttgttgactaaggatctcaatccgcctatccacattttcagttaacgaagcaagcccagaaaagatagctgttctcttaagctctgacactagtttcaacagagaatcagctgaatgtatctgaaaagcatgatagcatatcgcagctgaaattacacattcaacgggtttgccaaatgatactgattactagaactagcttccaattatattacaaaagcatactttgtagaatggatggttgcaatatgttaacataaaggtagatcagaaaatacataggcaacaaaatgtgattcaaactcattattcattaccattaccatactgtctatgataagtaaggccattgcgtgtctgaagtaggttcttctcaatccacagatatacacaaactatgatatcatgttctgaatcttactctgcgtgactaga

SEQ ID NO: 64374 - DNA, 838 bp, Oryza sativa
aagggggaccactgtaattttttatgataatgggaactcactaacaggtgggtcccatagttttaaaaatactttaagtgccacgtaggcgtcacgtcagccaaaaccaccatctaaaccgtccagagaccttatttgaattggttttgaaggttgaggggcatgttatatcttgttactttagttcagggatgaattcagactcgtcgacaaattgagggacctaaagtaaactttccctttggatgaataagtcttgagggaggcgattctacatagagcaagacaggaaggagaaaaatatacatattccttatttagaccagtgattgtgtgattgggcctcccaaggcccaacagatcgaagttttgtctgaaatctgaagcagagtaataacccttcagttcctgaatctgaccaaattcgacgaacagaattatgcaaaaacagcagattcgttcacccaagacatgggcctacactggttgatctgatatgtcaagcaaagaagagtatacacgagaataatgtttttttgggaagaaagagaaaaaaaggatcgggaacaggagttgacaccagctttgcccgattcctttctcagtctcccttttctcaccacctttcgatccatcgatctcgcttccttttgctttcttgttcctttccctttccccatctctctctgtcgtctgatgaactccgaatttgctgtttgctgctgctgtagctaagctaatctgctgttccgtgttgggtgctgcatcatgtccctgatcaacgtcaggtttaccatcacacgtcactgttgttaatcagccttgcagggctgcagga

SEQ ID NO: 64375 - DNA, 8589 bp, Oryza sativa
catggcctttttctccttgcaccggatccgtggatgatgtttacatttacctgcagatcgaatagttttcgagaaaaaaaatacctgcagaacccaatcagttcttatctatcggaacggtatcgctggttcactcctgttcctggctaagaactgccaagcgaatccaagttgccagagacgcaacaagtagccgccggaaaccatgaatacacagatagcgattgtgtgaggccaaaccgaaataacgtgtcacccaaaaagaacaaaaagagaaagaaagagagaacaactaggagtactctttccatttagtaccccaatttgaacgggtgttattacgtttgcgcgtgtgatatgtcacatacagagacgcaccttttattctcattttaattaattaggttgggttcctttgagggttcaaaacccttccctctcgacacataaaacggaatggttcattaatataattttttaaaaaataatgtttatttttttaaaaaaacacacacctaatttgaaaaatgtgcacataaaaaacaagaaaatagaagttacgaaagaggagaaaaacacacccttaagatttatatacgaactgaccatgacccacctggttaggttcttcatacgaaattgaaatgatagtagggagtgttgtctttccctacgtttgatttataatacggtagagatattttctttccctatgttgttcatgtccctcgtggggaacaatttaaggcgtagggtacagtagtgttggatttaagttataggtttggcatggataattatgtttacgggttattatcattgatatgcaatgtgttgattgatagcgagatacttagagatgctcatcaggtaagagatgtatgtgtgtttccataaaggtgtgaaagaaataatttagattacgcgacgctcagccagtaaggtctctgttggtaaaacttatccgaaatcaagtttggtgacataggtgctcacatttactatagcttttttgactggaattaatctagtgacacgatgctcgaatttttgatgacaacgagacgcttatggtgaattcgacaaagttgatccagtctttaattgtagtagtaggaatatagtgtgccgatatgtgtatatgagcgactaatgtattttttttaaagaaaataatttagattatggcattcgaagttgcaaacacggcgaaccaacgtgccgggcaaactatacgtgaagcaaagcgagcgatcggtcgatgcgtgcgtccacgctcgcgactcggactcgatccaccggctgcctgcctgcctgccttccttgatgccttccaacctgtggatctcggcatatgcaggcgacttgacttgtactccgttagcttagctagcatatctctagacccatcgacggatcgcgatgagtgatggattgcacgcaccgcacagcacacgggaaagcgacctccaccgtgtacgcacccatttgcatcaatcgaatatatcgtcatgcgtgtagccgcagggtcactagggtgtacgtgttcatgtgtttgacctggcctagctatccagtttcccaccataacctggtacacaacccacggcaatacggcgtttcaggatcgtgcacacacgactttgttccataggtacgagggaaaacgctcaaagaattctatatgtgttaaggctattccaatcagatgagttatcgtcagaaaagttaactgacgagtttgtctactgattgttatttttacctaatactatgttgttattgtatatgcaaggactaataaataggatatagtagattgacagaggactagtgtctagatagcgaattaaagataacgaacgctaagttccaatagcgaaattaaaaaataaccatacatttagattgtgtatcaatattaacatcaagtttcacttaaaatatagaagaaggcacaagatgcaaagttttcatattatatgtgaataatatcatttaagcattatagcgatccaacaaagttaatagtggattgctatagcggtcacgaaatgctataacaggctactataatggttgcggagcgctgcagtacctgctaagtttcaacacgctatcttcagtccgctgccttctagcagtaacggtagatgtccgctacactgttacaacggtcgctactaatactatttattaccttgcatatatgaggtggttaatgatctacacagttgctttggatgaatttattcaacttatgcaaggacgaatttaacgtggttgtcaaaattctttcctcgatccgccgctggtgcaattcttggatggaacacgtaattgtcaacgaaatttcttaggtgcaaaagatcaagtagtacaagtgcatcatgttcgtttgcaagggagcaaccaccagtcagggtgctttgttgttctctcgttctggcttgcggtcaatacaagtgatgctacaagtctctggttgtggttggatctgtgacaacgtgtttagaactaatcaatttgcaaatggcctgcgtttagttgcctgtctctattaacaagttaccacctgagcaactaatttaattaagtctacaaaaagttgttaacttcaacctttttctacacaatcgatacaatactaagtagctagggaacaaaccaaaatggcagaacttgatgacaaaagagttaaaatatactagtgtttggcacaaatatgtgctcggtcatgtttggcacaaattcaaaaattaacgaatgacacttctatctcaaaataaaaactaaaatcttttatattttaagacggtataatatctattgtatcgttatatcagttgattcctacatcttccaaacaaaccatatatgtacaaattggattatcgaggcataactcatcgataacacatcaccgtcgttattactttgagactactttacatatgaaaaatataattggaggtaccgattgtcttaactcatgttcatactttgaactgcaaatataatgaataccttttttcatagtgaaatttaattcgatctttactttaaaaaagttattacaactaactattatagagttcaaaaaaatacaaacaactattatagagtttgtaaaacgaatatctattaattacttcctccgtaccaaaatataagtatttttagctatgaatctggataacatcatagtagttgttcagatttatagccaaaagttattacattgggatgaaggtagtagattactaagaatacgatcttaaaagatatactagcttgctttttatgtacgatctttaagtatatgactggcagagtactggtagcatccatgactatataagcatggataattaaaaaaacacaaatacacaaaaaaaatgaaactaaaaaggggttatactatttttcaaactctagaggctataatatacaagacaagatcctggtgagaggctgctagctgcaaccctatttacgactaatcatcagacaaaccacaacttggtgatggttacgtgggtgtgcattttccataaaactagtgggcaaaatgcagtctcgcgcacagttggccttgccaatttgtaaaagcgccgagaacccaccgttgaaaaatccaagtcaaaaaatagaaaaaaagcaaaaccaccagccgtagttgagccggctccaagcgagccgtccactcgcgattggtcggaaaagaagatcgctatcggctcatcttgggtcggctcggctcgcggacgccaaacccgcggacttgaagcgcagcggatagcggacttaagaatcgaaatttaaatcgggaaattaaatagaaactggaaaaaggcgacgcgcccgtgacggatggccccagaatcccgatctccacgctcccgccactttttgcgctttagcccctgccaagatttcttatcttatcaatcctctgaataaaagtatttgaaaaagtacccactgttctggtgcttgaatgtgcggtgtatttgcgtttaagaccccaagattttcatgttttgagaattgatccgacagttggggtcacatgcttggcgctttggctggttgggttgggagcgtggtttttgcccggataaagggtagagtggttggttgggtacttgggttgggttgggtggtccattctgtacggtgcgccgggtcgtctccgtttttctgcctaagccattttggacaacaaagaaaccgtgcttgaatactgttttcttctttcttttttgtgagggatgctttttaagtttttgggtgttggtcagatcttcacactgttccatgatagctgccggcactaacccttcactgtcgattaatatatatggtcgattctatagttgtagtatccatttggaatcctaattttgtcattatcactccaaaacaattaattaagttttttttgttctaaaggtattcctttcaccatactgtactattgtaaaaccatataaatgtgcacagcagtgacacacacagaacaaaaagaagaaatatcaagatccgcgtgggtaaaatatagccattcttttttcccctcttaactaaaaagagacccgttaaaacagcaccgattagcaattacccctcccacgaggcagagacggatgactttacagcgaatcaaaatccaaaccggtggcagaaaaatatcactccctttggaaggcgtctccgttccaacccccgtctagaacgcacggcacgtcaaggcaaaggcacgaccacatccatagaaacctgacttgccggctgcttgctggtcttccacatgccacacgcacccctccccgaccaaaaccaaataaagaaaacgtctctccgctcacgagagccagccgtgccaaccaagccctcaccgcaccgcgccgcgccgctcccacgcacgcacgccacacatgtttttgcgcaaaaacccccccgcgagtgcgcacccggcacccgcgtccaacgctatatattacgcggcccccaactcggcgtcgcaccgcaaagcaacccccccttgctttttgtactcttccatctcacaatctctctatctctctctctcttccttacgcggcaaaacacaccgtcgtccatggacagttctaataacaacaacaacaacaagagggcgcgcgacgccgaggatgaggccgacgaggccaagaggctgcgggcggaggacctgctcgacatgctcgacgatgataccgacgccgggggcgccgccggcgacctggcgtccgtcatgcggagcttcgaggaggagattgttgctggggatgtcgccggggacgttgcccccacgacgcagcccgagctcgggttccttctcgaggcctccgacgacgagctcggcctgccgcccgccaccgcgtcctcgtcggaggaggaggccggggctggggagcccgaggatgccatcgggttcggcggacagatctgggggttcgaggacgagattggcggaggcggctacgctggcttcgccctcacctcgccggaggcggtcgccgccgccgccgccgcggcggagtgggacgacgacggcttcgacgccggcttgttcggcttcggcgacgaggtctcggcgcttcgccacgagaccatgccggccgtctgatgggcctgggccgaagtggattagtttttttttattttcctcgttttttttaaatttggctaaccttagctctacccttgtttaaccttggatgtaaagtttctagtagaaggttaaaaaaacagaggggaggaaacttggaaaaaagtttcatggatggagaggagaaaaaaaaaacagatgtaggcatggttaaaagaaaaaatctgatgacaatgcctcacgaacaaaaatgagaagaatggcttcatgccttcataccagtactacgaccttacaaatattttatttcaagcaaacgaaagatttaatttaatcagctgccacgataaattacatggagcagttcaaacttcaaaaggatattgtgaacggaagagaaaataatttcatggtggatgaactgtcgacgttgacctgcacacatgacaaaccgagatggaacaaaagatctgaaatgaactgtacagcactaaaatggacggaaaattcgaaatccgaagcttccagtcctccttggagtgcatgaaaaaggtgaagctgggaaattgtgaacgtttaattgaaaaggagcggataattgaggccggcatggttgacctagaaatgaaatctttatgcaatttcgtggagcgagataaagcccacaggaaaagatggtgagccaacgtctttcacgtcggtttcaggtttgccgtcggcttgaggtaaatgggaacgctggagaagagttcacgaaactcccgtggaatcatcctttctttactactcctaatctttaataaacaaaataaaaaacaatatcttgtgggtgcatatgatatcaaagtctaggtcgtatgtgcgcaaaccaaatcttgttctgaaaaactccctactagtactacttgacattgattaacacttgcgtttttaagttaggcggcaattcacatgacataacgaaaatcgagtgttcttctttttttttttttcgttccctctccatttgtgtcttccatgtttggttgaagatttccagtgcctgtctagtgctatcattgacgctaggggccaaaccacaaaaatacttttcctgcaactgcaagtataatatttacgggtcatcagtaacttattcgcaatcaaaccttctgtaattctctggcaatatttattttgggagcaggaaagttggattgggagatggaaagctgatagggccatttaccaggaaaatttaattgctgtgatcgcatcgcacacgtcgtgcttgccccggattgcaaagtagtcctaccacaaaaggttgtgttcaaaccacgcaagctaaagccacccacggcgttgtgcttgtttaggaataatcggtgcttgatttctctctctctctctcgggacgtcgttttctcgtatgagtaaggccggtttcagatgtgcgttgccggtgggttttctcatttcgtttgtagcgtgtgatatctcgcctgctctcatgtggttcgcggcgcgccgatcaaaaccattactccccggcaccaactgcacccgacccatccaaactcatcatgtacactgtatagatcgatggacaccaatcttggctgtttcctcgtcatcccccctcacgaaacacataaactcatcgatccggtacagtaccccatatctatagtagtccagaagcaacaaactgcaccgcgttttttctcggtcaagtgcggtacggtttttctcttggcgttttgcgtggtatgcaatagggagagggggtatagtacgtacgagtaatgcacggtcggttggggaggtggttggatcgcgagaggacggcatgcgagatcggttaccgcacacggccacatggtgggcagcggcggtggcgaccgaccgctgccacggcggtttgcaacgcaagcaaacagtacgtgacgggaggtcgagaggaggcggcaataatggcggaggaggaattgaaaaggtggaggtggagtggtggcagaggctgcatctgatggccattgcatgcgaatgtgtgtgtggatatctttattaccggtacagcgtctaaactggccgccggcccatgcagcgtgcgacgagctgcagatcacgcacatggactggtgccggtgccggtggttggatcggggatctcatctaaataaccgactttgtgttcaactcattgcaaccgctggtggtggtctggtctttgatgtgagctctccccctttctttctttacttgttcaaacgatcaaaggtgggtggtttatcagagagccatgaaccggttcaggatgtggtgagaaaacgatggtctgaagtgggtgattctgtggctgatgctgcccatattataataatatcgagctgtaactgcaaacggtgcgacctgttgcaatgcagtgacgttgaatagtttttcctttggttctgatgggctggtgcgtgacggtgaaatttcgggagcatatcactctcactgaactacccccggtctactctactgaaacatagtccagaaaagacatacgcttggtgggcctaaggcccaatgtatcaaggaataagttcatctgaggtcccttaacttgtcaacgagtccgattttcgtctttcaaccagaaaaccagatacaacaggtccctcaactatcaaaaccagtgcagatgagatccctcgacggttttgagagtggttttggctgacgtggcgcctacgtggcaaatttgacttggtcttcatctgatgtggcattaacgtggcgcatctgtggcaatttgatccgaaaaaataataaacttcgtgggacccacatgtcagcctcacacataaattaataaaaaaatggtgggggcccacgtgggccccacatgtcattctcaggatctccctctcttcacctagagcccctcttgttcttcctatctctcccttatcccatccccgatg

SEQ ID NO: 64376 - DNA, 7525 bp, Oryza sativa
tgaccatcgaggacgtcggcggaggtggccgggcgaggagggaggtggcgcgtacggctactaagcgaggaggggcggcgccgtccggctgggcatcgcgggcggagcggccgacggagtgtagctgtcgcactcgccggcaacctccgctgcctgcggcctgtcgtcgctccgcccgcccctcagccccgccgccgctccgtccgccggcatgctcctgccgccgctcccgcgaggacgaggaagagcgaagaggaagagaaacgagagccgagaaggacttgtggggcccacgtgggccctaccattcttttattgatttatgtgagactgacatgtgggtcccacgaagtttattatttttccggatcaaattgccacgtatggcgccacgtcaatgccacatcaaaagaagactaagtcaaattttgccacgtaggggccacgtcagctaaaaccaccctcaaaaccgccgagggacttcatctgcactggttttgcactggttttgatagttgagggacccgttgtatctggtttccggttgaagcacgaaaatcgtattcgttgacaagttaagggacctcatatgtacttattccatgtatcaatgactggtaagggcagctcggttcccttagcccaacacggcgagcgaatatggtgaaatcatgcggcctgttagcccaccgtgcggatctggactgtgatgggccaaacaaatatccggccaacctttttctctcgaaacatgttcatgccattcgcatgaattgttcatagccatttacgagcacacgcaaaaacgagtagtacctcacaaaaagaagcagtgcgctaacaaactgacatttaccgcgactgcaaaggtaaaacagcacacgaacctttttgtaacggtaaatccccaccggcacgcatgcgcgctacgtataccctgcagttaacctttggcccgcaccgtccactgcattttttactcgtttcacccgcctttctactcctactcggcgtgcaacgcagcggtgcaactgctgcacgctgaccggtccgctgtttgtgttcgcttggtcaccgcaggggatctccactccacgcaccgcacgactccacgacaaagttgggaatccatttggctgcataaaatatttcgcaccttccttcacaaaaataaaatatttcgtactgtaccaccatatgagaaagcgagagtccgtccaagtgggtggcgactcggccgcgcgtcacgtggcgcgcatgccgccccgtacgtgcgactcatcggatccgctcgtggtcgtgccacgccgacgccgatgcttttcttcgccgccgaaacaaaaaccggcatggtctactctactatactgtctactactactcgaccatgcatactgctgcagctgatgatactgtatattatcccgtctgaaaagagagagaggaaaatgaaaaactaaaacggcgcacgcagctcgcacgtgctgggccatgagggaaggctgctgcgtgcacagtgcaaacagcttgcacgcctcgaaaagggagaaaagaaaagaggagaagaagagaaaaagggacactaccggtactagcgagaaagaaagaaagattagtcaaattgcgcacaccaaccgacaagggcttccatctgggacccacccacccaaccggaccggctcgcttcactccctgggcctcgtgagtgagcacctttgggtctgggtctgcgtggcggccgcctacgcgcaccacatcgagtccacacatgacacacctcacgcgggcgggcgtgccagctgcaaaggcgagccgaggcccatctcctgcgacaaatgtccacgttggtctcgccacgatgagaaattccttttgctttttcctgccgaactaattccttcccgaatattatctccctctttatttttttctcctccaacgtgtaaatatactcgctatattccaggtatagcatattagggtttaaatgtttgtacaagattagtgctcgtgctcctataaggagcgaatattttgttcgagtcactgcattttgagtaaagaattttttttccatcttatgcatattgagtaaaaaaaaatacctttacatagaataatttccaaggtttcctaattactccctccatctacttttgatagtcatatttctaaatctgaaaaaattatttttgatagacatatttcaatccaacaaattattatcttaatggctttcttgaatttaatgcgtgactctttattcttccacacaagattgactatatgggcatcgagaaatgtaaatattaataaatcgcttgtttatgaggaatgattagtagcatgtttagatggatgataagtagaatcacttatcgttggtctgtgtgccaaaataaaatatgactatcaaaagtagattgaggggtactacataacaagtgcagaagttactgttagtatacacttttttttacattggtaaccaaccttaaataatcaaaagaaactttttttttcggttttcaatatagatcgaatgtacaaatctttgactttttctgcgaagaatcctgtttacggcgcataataagatcgaagaatcacgcctaactgcatgcagatacagtgccgagaacagaatcagatctgcggattaacggaagacttgttttagcttccgtctttttatctggccatatgaaacagtctctcctaaaaatagaatcactgtatagtaaacaaatcttgggattgtcagcaagtgccaagtccacgtagaggaaaatcttccaaaatatatcgtgggtcatcagatgagagattctcgcacaaaacatgcttacgtgtcaaacgaggcacgctacgaaaaaagaggaagctgaccaatcgacggcccctccgtggccacatgtttttgcccgcttttccaaaaaaaattccgttccgttttacggtgcccgtttaccttggccctcaagttagctggaaacacaaaatccttccaattctgtcgtggggcctctcacgataatttcagcattaagtactttatttattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcagtgtgatggggtgggggataggcgcgtgagggagaggaatgggtggaggagtgggaggggattaaatatcggcggaggagacgagcccaaccccttttgctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcaggtgcgtccgggtgccccttccccaccgtgaaatttttcatctttggcgaggtttacgccgatctggagtggatttgaccgggtttcgcggccggttcgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggtcatgtcgtcgcattgcaactcgtctcgtctgtatgcattttactctgctggtttaatgttgagattgtgtagttaatgagctgttaccctgagattcctgcactgaggatgtgcagctaattttatgagtttgactaatgaggctagatattttacctatgctgtgatcgtgcagctggttgttttggacgctggtgggcagatcgtgcggtttttttttacaggtgctggtatacaagatgcggctagatccgatacgcatgcgtacaagctgctagacaaagtccgggttcagtgttagctgtgagcagtgatgcgttttgtttatgtggagagagcttggtcgttgcacggtggtgcgtactaaaagtattttcagaggttgtgacctgttagagagggactgagcgagtatactagtattagtacagtagtagtgagctgagccgcctgagatttttattgcgagacttgagcatattggagaatggagagagtatcaagcaagttggccataggcatcgaccgagtgagtgagagagtgctcactcctttcttcgtttataggtgcacttttgtgaaggcggcgtgggggagagtaggccgcgacaggtggttcgctcgccctgtgccaaacaaaactgagccccacgtgacaaggtacagcaaatgcgtacccagctcacggctgggagcagtagcatttggtgtgagtcacggaggtgtgggcgtgagtcacctcgcagtcgcaggccagccgctgcttgtctcgttttggcgcggcgcgcggcgacgcgagacggctggccggctggggccatggtttttcccccgcgggggcgtgtggtgctgtgtggtgtggcgccgcgcgcgcgggtggtgataaggttcccgatgagaccgcggctcaccagggcaaatcccgcgcgtggtcacgccccgcgcgcgtccgcgcgtcctatccccggccgcgaaacggcgtcgtgtagtcgtgtacgtagacatgacgcggcgcgggataacccgacggggaggcgatatacgggcgataccgatacggatggcgtggctatcctattctaggaccggccgcgctggtacgccacgacgtcgacgcctttggcatggcaccccgcgttttgttcgcttcctccctctctcgctcacatgccgtccatgccgtttctgttgtgattttcccacaagcttaacctttttccgaaagaccatttcccagagcttaacttgttttaatttgcgaaaggactcgcacgcatcggcacacttgggacggggtacggcacagctggaagccacgctgcgaaggtggagtgaggtgagtgaatgcgttagctggtaggggacggggacgtggctgggttgggtcaggtgggtggaggatgaatcgaagtcggatgtcagcttggcgtggccgtgcaaggtcgagatatcgcgcgcttgttgctccacggttgttgacatgtggcgcggcgccgatcgaattgccggctcgcgcacggctttgttgcctctgctttttccaccttttgccgcgcacgtcatagcgtgtggctgtgttgtctcgttcgacgtcatggcggctgctgctgctcatctcttgcgcccggtgcacgcatcgaatcattgcgctaagttggtttaggctacctgtggcagtactaggtttggctaataatccacgtgtgtaggtaggttagttac

SEQ ID NO: 64377 - DNA, 3549 bp, Oryza sativa
cacctaacagcactaggatatttggaaaggaacagtcctaaccccaaaagaattggaacccccaacttcacttccatgttgacatcttcactccctccgggaatacgagtgaccgagtgacgtgtcatttttctttctggaacgttctgtgcggaatccagcagacatccaagcttaagaacttggcgtgttcctacttcgtctttacggagatacagtgtatccatgcgatttttgccgaatcttgttacgaagtactaacagttttcgtcttctcgtttgtacgctatctggccgtcgagtgactcgccaccactcgacgatgtgtgtggatcgaaacggtcgtctttgccgcatgccgaaacagttggtggcggcatgcggcgcatcgcctatcaaatcgcaatgttgcgtgttggaagaggagttattgccggctccatcgtccgtatcgttcgttcgttcgttgaatcttccttcaatcccccggtgcggcgctgctatttgccgatcgcgacgcgggcgccgcgccgcacggccgaactcgacggagacgacacggtggcgcgcttgatggcgcgtgcagctgccacgcagatcgctcgcgcttcacgttagctcatcacaggcatcgcacgatgggcgcttgttaatgcggccttgaattggccctagccctgtttggtctgcatcagatccggatctacactaatcctgctcgagttttgacaggatctatgcttcgtgttgccgtcaggtagacagtccccatcgcgagcgacatcccgagtcaaatcggtgatggaaccagggggagaaaatcgcacaaagtcgtggcttagtccaacttcttccaattatccactcttttcctggaacatatcgcttgcgtcgatggaaaaatataatccatttgattagtcggccgaaacctgtgatataggagtatactactgctactatccctctggctattgccgcttacggcgaagacaaaacatcaaaatcgcaaacgtgtccatatactactactgctggtgacaagtccgtcctcctgcgagaagatccaaagctgccggtaaaaggaatcgcggtacatcgcacagttgtagtactgctcgttgctacagctccaagcaagttgagacaagattcagttttaatttttattttttttctccttcaacgacagcgtctgaccgaccagctgccggtcgacatggtgagctccgcccccgatttctcaacgttttcctgacgagatttgccgtgtggtaccgtggtgcccgcaagcagggccagtggtgtggtcgctgtcacgtggtgttgtgcgcgagatgaggtgagtgtgagggctcgagggagacacagagcaccagcctctgaccctgctgatgatctggggtcaaaacgactccggaggctgcagccaagttggacgaacgagggagtgtattattggcgtattttactgtcgtggaatcaatcattcgtgacctggtgtggagcactctcactcgatcccttggcttggctatcacctggctcatctttgccgttgatatttttgacctgtgcaactcatggattgtcagtcgtagtaggtagtagccggttgctttgctttcactctagagagctgagcagtgcgtggatcactgtactgaatcgcttttagtagaaagatccaagcactaatgctgtcactaaagtgttgtttacaatttcctgcggcttcgagagatgtcaagccagctcgctactttggtagtatcgcttggagcaatgttcctctttctgtcactctaatcaaactccactgttgcgcatatcttcttgtacggagcctgtttaggatatgcagaaaattgaatgtttcatcataaatagcattcactccgttctagtaactttttttcctctcacgtttgttcccaaacaaattcatttttaccaattattgtatcgagtttgtgaaagtacaaataaatgtatcagaaatagataaattaatggataattgtatcgggatttaactgaagcgggatattatggtcctttcgattttatatcgatatgtagggtgagtggaatataacttgttttaggacgaaggcattactagtaataaaatagagtcgagtttatttcaatatattgaggaaaaaataatcatatgtactaaagtgaaaatcctaaaaagagaaaaggggacagcctcaatgtttttttccccgaacatgttgaactaattttgagtaaattataccgttggcggagctacaaggtaggtgtagcctgttacatgaacatgtaaaaacctcagaccaatacaccaaaacggcaaaccgcatcaattcttgctgcgtcgagtacattgagtaggatatcacgtagtcgtaggcacacacatgaggaggatgttatgcggatatgtatgtgatcagtccactagagactaaggtacacttgattatttaggttgtgtttttaagtcaatgttcctaatttcacttgtttctttttcacgtgtatgttttccaaaccgttaaatgatatttttttagaaaattattataggaaaattgcttttaaaaagttatatcaaactatttttaagcttttatacttaattaaccgcacactaatgtgattgttataaaagtacgtcgatataatggaacgacaattaactttttcgatcgcttcagtcattggtcacctaagacacgctaaatgacgacataagaacacatgatatttgttaaagagatttagcctaagcctacatgcatcccagggctctaattatgggcaacaccaagacgctacgagtctatggcctcaccgccatagtcttcctgcgtgtctatgatacattatagtcgccatcttttatattgtggtgccctcctctctttaagagaataccgggttataaagtccgactttaacttcacccctaccaaatattacaactccaagtccaactttaactaaatagtactagtatatttgacatttattctaacaattctcaaccccttctcccgaacacaactagagtgactttcgtcccaccttaaatgaagcttactcgcattatatggtactcataaactgaaaatagaatctccctgtataaatcacattgggaaatcaccctcatcttattgccatattatgcgctagtcgagatgaggacgctcttggcgtcgttgacatccattgctaagtcccacgctataacctctatcacttgaacactaaaaactccactcctcgtctcctcctaactcgaatgacttccatcttataaaccgttattgaaatttaaaatttaaaattatttttttcagcattttttgtttttaaaattacatttgaaattgttaatgacacacatataaaaaattcaaccatccgtgtattaagaaaacacatactctattcgtttttcatattataagtcgtttgacgtttttcctagtcaaacctttttaagtttggccaagtttatagaaatataggactagtattttcaacata

SEQ ID NO: 64378 - DNA, 2152 bp, Oryza sativa
tcagtctaatccacgagcaaacatagacacaatttcaccatttctaatcggacggcgcgcaagtccgtgcactcgtggcagttgcaagatcgccgtccgttgattcacatatagaaaaggcgaggaaaaaactcgagaggaaaaagaaaaagaaagagcccgaaaagaaaaaaaaagggaaaaaaaaactcggagcgatgcactcttgggtgcagcggctgttgacgacggcgacgacggcggcgctcctcctcctcgccgcctgctgcgccgcctccgcgctcgacgccttccacgtcccctccgtccaggcgcaagcccatgtacgaatccgtctgttcttcttcttctttttgctccctttgcactatcacgcctggaatcatccgcgactcggaaccctcgaaattggggatcttctctgcattgcgcagcatgttgatatggctgagatagttctgaaatgtttaggtatttgttctagccggttatcgtagtctatctagcaacgcgaaattgtacagttcactggaagatctttatagggttagggtttagggttctgtgatgtctgggaggtcattggtgtggcaaaataggtggtattttgggggttataggatctttgatgattcttgtttacaaatggagatgctattactggtaggttgttgtcattttcggctagatcatgtacatatagaatgtagacactgatttgtctggctgaaatgtagaattttggaaggttgggtgccaaattctgattctttcaacaatggtaaaattgtgaatctatcagagtatcagttatctctgcaagcagtgctcggttatcatctctttgttggtcttgttgcctattgatattagcatcaatgtgcttatgtaatttttttttcttgtaggttacaaagataaaccgattccacaagcagctcaatggcaacgacaaggtctgtgccttaaggcccttaacctttcgtgcttgcgtgtgtgtgctgccagaggcctaaacgtatttagtttcattatgcgataatttcaaattatccaaatcacagtttcagagtagtgtcttctaaatagagcaagatttcaatatgtgctattctgttataatcttctacgctgtataattatgtcatagtacgtttttttaccttttctcatcaagtagcctgggttctgccattgtgtattttcgccttttcagtttagattcaatacatttcattatgtgctatggagagtttgcttggtctgaagttccgatgttatgaattaacagtcaaaggcttgccttcgctttcttttaatgcaaatctgctttgatatctgtaatcaagaaatacattttagtaaaaaacctttcttgtgcaaaggcttcaaatgttactatcttatactgaatgcaaaatagagtagacatgttccaacttccaaccacctgcagaacaaaatctgtcaacttccaatagcatgatattcataaatatacaacaatgatttttccaaagtaatattatctcactttcatatctagaacagagtcttgtaaatccgcttatgatataatatgtttctctcctcaactactaatatgcacatctgtttgaattacttgatgatttgctgttgcaatatttcctttgtgaaattctgcgaatatatcgatctcataaatatactgtgttacttcctttgcaactacaatgaaaactttgtaaatttgtgtgacaggtgacactgaccttcaacttgtccgcaaatttggagtcactattcacttggagcacaaaacaggtgatattttgatttcactagaatatgcagctcatgtttcaaatgtggtatatcagaaaactgcgctcacgtttatccctgccagtccggcgaacaatattagctgaacatcgcaagtaacatgctcgggtagggattgagcaattcacataatgttactgagaaactggactgctgtcctcaatatagaagcattgaaaaacttgagcaatgagtgaccatcactatttgatactttaacattgtcatggttcatgattgcttatcctgtgaaaccagtaataaaaagatggtcaccgacgatctactgaatgttattgacttgctacatacatatttaatttgg

SEQ ID NO: 64379 - DNA, 1469 bp, Oryza sativa
attcttgccccagctcgattgagcacatagagatgcattacatgtgctggcagagtgactgtcagtgaagtactgacatcaaccagctacatcttcactcactgcgtagtacatatatctaagaaacaacggcttatttgttggcatgtaacttgggacggcatgcgtatgcacgaactcaagcaccatggccatgctctcacagcacattggagtttggattgagaggatttcagtgcttgcagggagggccgcacatgccgaggaaggtgtcggtgcacttgaacttcttcacagggtgagtcttgacgacggcgcagctcttgcagacggggtcgcacttcttgacgacgtcctcgcaggtgtagagccccgagaaggagaagttgcagttgctgcagcacttgagcttgccaccgttggtctcagtgttgcccttgctctctcccacagctgcaaccaattatccgtgcaaccattcagtgattaatcagacatttttttacactaatttggatagttaaaacggtgaaagttggttacgcagcagtagaaacttgggttgaattgttgggttctttccggctttgagcctatatccatttatgtggatgaatgatgcttgtgtatacaggctgttaggttggttggcatgatggagcccagccaatgcatgctttggatgtttttgtgcatgtcgagtgccagtgacagtgagcccagtgaatgagagtggccgaccccaagatggcaagatctacgagcctatcctctcgacggcgaccttgtagtttcattcattcggtatgccttagaaaaatctctaaagtatacgatgcataatcatcaatcaccgcaattccgaatcctgataacaacaacacagtacgggaatggaaaggcacactccatggttgttctttctaaaactgtaaagtagttgactggcttttgttggatccagttattagaaatctcgtgagagtgtaaatccagtttacagagcaggttaactagcattttcccgggccaaaacttaatttgacaattaagaaacacacgtaaccattctccttagccacagctgcaaaaatccccatgaccaggacggcctggagaaccaggatcaccatgagcgtgctgctcttcatggccacctgtaaattgttatcgtgctatagctatgcacaaagctttgcccttgctcggtctacttgcagagtgctttgagcggttgtggttgctgctggctaagcgcatctgaccagctctatttataggtgtccagatcggatttttttttctcttggaaattaacttcgtcaggtgcgtctttttttgaccctggtctgcgatctggaatgcacatgtcagcttggtgtttctcccaagcttactttctaaagtacaagaactgtagctattaggagacatcagtgcttaattaacctcacttaatttggcaattg

SEQ ID NO: 64380 - DNA, 3962 bp, Oryza sativa
ggtatcttgagataccaaactttacactagaggtaccaaaatttacactagaaaatatgccgatgtaccaaatatttgtggtacactatgatttgtggcacctcttatgcactcaagcatacataatatttgtgcacactatgattcaaatctggtgggtctgtgggtggaattatgggatgcttccccgttcaaaggaatatttttgttatgaaaggtttaatcattaattgattacatgaaaaagattctctatgttatatagtactaggagtatatgtaatatgttcttctgacatgatgatgtgctaatcagtaaagtgtaataaaagaagttgatctttttaaacttgatggttattaaggtagacagattttccttgctgacagataatatagacaatatatatctattatcacaagataatattaacattgttctcatgtccctctcaagtccaggggaaacacaagtctcccaagtaacatgcaaacaccttctagcttcattatttttatttggtccttcactcagacaacggcttattgttcgagtatacagtatactagcatcgagatatgatatataatgcacactgtatatcacacagatcacagatatatgacagcaatggctcgcgttcatgcattattcaggtcatcatcgatcgatcgatcgatcagtgcttgcagggagggccgcacatgccgaggaaggtgtcggtgcacttgaacatcttcacagggtaggtcttgacgacggcgcatttcttgcagacagggtcgcatttcttgacgatgtcgtcgcaggtgtagagccccgagaaggagaagttgcagttgctgcagcacttgagctgccccgggttgatgtcgatcgccttgctctcacccacggctgcacacatgaaaattcgatcattcagatcaatcatagggactacattgtactgcatgacattatcatcagtaaacatctgagaagacagaaatggtcagtgtgagaacgcagttaagcagcctagctaagataggcgaatcatatatatccatcagcggcaagagattaatgtatacagtagtacagtaccattttcttttgcaacagcagcaaagattcccatgataagagcggcctggacagccaggatcaccaagagagtgctgctcttcatggtgatgttcttgcgttccaaagccttgagctatttcctctacttggtactagtagatggctttacgctttgtgtttgtggttatggccaaagcccaggagagcatctgtatatataggcgttcagatctgaacaacatattagcatgttgccaaatgccattctttcatgcttgatatcgaatatattttttggggatgcatgttaggcgtgcctttgactgacgcggctgctagagtgtgaggcgttgaacacattttgtattcttccatgtcacactcacgctcctatcgtcctcgtcagcggtccaaaatggacgaaattgacaccaccagcaccaacaaaaatcgttcagttgtacagtggtaagctttgcaaatctttaagggaattaataatgatttccccatctcatcacacaaacgaattacctgttttatattattatgtataaatagaactcatgggggttcaaaacactattttatcaactagtagtcctattttttttccttggactcgtctaggatgtaccctctccgtttttttaatagataacgccattgacttcttatcagactattcatcttattcaaaaattttatataaatacataagatttgaatcacgaataaaatactttaagtgataaaacaactcacaataaaatagattataattacgtaaattttttaaataagatgaatgattaaacgtgtgataaaatgtcaattgcgttatctattaaaaaacgaaggtaatatatagaaaagcagtatgctgcggcttaactagaaatggtaatactgattactagagtccctgcgtgtcagcatcccctgcttatcaggactaactgtactgtgtatcgaaatggacccagttttattacaggtatatcatgatcttctcatcacacttggatgacaaaatgattgtacgtgcaaacttggataaccgagcaagctgagctgtccgttgggagattaatcacgagctcattctcgaaaagcaattttttttcaaacgcgtaaaaaaattgtacgttaatatattagagaaaaatagtttttgttacacggtacaatcagttaaactggcgatagaggaaggaagaaaaagaaaaaaactgtagctatagaaaagaaaagctaccgcggcgactaaacacaactctgatcaacgggagagaaggtactctgtgcccttaaaaaacccaaaaacaataatgctagctgaagaccgcacatgatcctctgagataatagactccaaaaccaataatcggtattaggcaacacgacacctttcttgcatatcatgacattccgcccaagtctataagaaacgcagattaatttggctaatccgccatgcgcatgatcaattgatcagctctagcatctcaaagccaaacaagaggcgaggataagatcacaggtcgctatcgagcgttactctcactggcccagcgttaaaccaaaccctcttttgatgtttctggctccacgtaaatacgtcctggctgccaaacctcactaccaacctgtcattagcgaaatcagagcatctgatggtctgtttggtacaatttcaactcctaaatttagctctaggagttaggtctgaagtggagttgtggagctggcagcttcacaactctagtttattttgtgagagagctcttcccaacttcgcttccagttttagtggagctgaaactgtttggctgaactccagctccagaaggggtggaggtggaggtggagctgtgtcaaacaggaggttgtcagtatggcatcgtgtggattggatgttgaaggcggcaggcggctaattaagaagcattgaccattctgatgttgcgtggttcaacacaattctgcttctcaattagtaccatctggaaaacctgataaatgggcctccatggctttttaaggaataagtttacattgcgtccctcaactcatgtacctggttaaatcgtatccctcaaccgctctcgccgtcccaccgcttccaacgtcttgctgctctcaccgctctgccaagctcccgccgtctgccccgccgctctctccatctcgctcgccgtcgagtgaggagacgagtaactgacacgtgtgcccaaaatttctttttatttttatttaggtttgttttttactgccacgtaagcgccacgtcgatgtcacatgggatgaagaccagataaacccgccacgtaagtgccacgtgggaaaaaccgcctccgaaaccatcgagggagtcgatttgcaacggtttttgaagttaagggacaagttatatccggttttgcggttgaggggtgtgattcacccagacgcatgagtggagggaggtgaagtagacttattcctttccgctttttaatctctgtatctatctgggcctaattcttcaaatcttcatgatgatgggccaaaaatctatataggcccttcttttcggggccttttctccgtttcttttggacatccataattatcctgacgtacaaaatggtcctgtgttgactgacgattgggctagcaagagtcagtcacagtagcgtgtaacccgttacagaggtaactgttcaggactggtcatcggctcttttaaggtgatggtgccacctacagcaatgtatggtggttgatttattggtactcaaatctagtttctcttggacattgattccgcgaaccaaattcagtccacgttcgcacaatcgcactatagttaattactccctccattctaaaatataaccactctaac

SEQ ID NO: 64381 - DNA, 16565 bp, Oryza sativa
  unsure (1)..(16565): unsure at all n locations
aatatagaaaacgaaaagttatgcttaaagtactttggataataaaataagtcacagataaaataaataataatttaaaaaaatttaaataagacgagtggtcaaacgttgcaaacagaaactcaaaatcccttatattatgggacagagggagtagaatacatgcaccctacaattatagatcttgatggtcaaggatttgaataataatattttagtgaaaaatatgtgctaggtaatgacatgcatgcatgtccgtcttatattattaaataactttaaaaaatagttactccctccggtttcattttaattgacgttttgaacaatgacacggtctacaaaatatacctttgaccttattttttattataatatacacaataaataaatgcatgtttacttttattatagtgttttgaaagacaaatatatatatgttgttatagtttctttaaactaaatatttttgaagttattgatggtcaaagttattaaagtttgacctcaaatttgtccaaaacgtcaattattatagaaccggaggagtatacgttattaaataactttaaaaaatattatggaatggaggaagcaacattgattacgagatgctttctaatggaaaattatgtaagagctgagttacaatcgtgaaacccatctaacacgttacacctagtcttccgtcacaagagctatccttggtttttctgatccactgcatgcgctagttttgcagctgctctcctttatatattcgtgtcatttagataccataccacatcctgctactcataatccatcttgttaagtgcttgtgttcagatcaatggctttcatagtttgggcactactactcttccttttacatcttcccacaatagcgaccggatccagtgcccactttggcggtaacaacactgttaggtgccatccaaaccaggctgcagcgctcctccagctaaagcaatctttcttctgggttaattctccggtcatccttccgacatggcaagatggaaccgattgttgtacctgggagggagttggctgcgatgcttcttctcatcttgtcacggtacttgatctcagtgggcggggcatgtacagtgatagttttgaacctgcactcttcagtctcacatccctacaacgcctagaccttagcatgaattccttgggtaccagcagtaccaccaaagatgctgaattcgataggctcacttcgctcacccacctcaacctctccaattcgggcttggatggtcagatacctatgggcatcaacaaactcattaaccttgtgtccttggacctttccaagcgctatgttaacgataacagtgatatctcttttaatgagagtgatgatgagattatctttacaggtgacagttataatcatctgcaggaatccaggttaatgtccctagtagaaaacctaagcaatttgaaagagctctacctcgaccatgtggatatgtctacaaatgtagatgactggtgcaaaacccttgctcaatcagttcctcgtcttcaggtacttagtttagatggttgctctctcaacactcctattcatcactcccttttgaggctccattctctcacagtgataaatcttcagtccaaccctggtatagctgtcaatctatttccagatttcttcatgggtttcgccaatttaactgtgctccgactttctcataataatctcgaagggtggtttcctgacaaattcttccaactgaaaaatctaagaatcctcgatttgtcctttaatatgaatctgttagggcatttgccaaaagttccaacctctttggagacattgagactagaggggaccaacttttcctatgctaaacgaatttcttctagcaatttcaatatgctgaaggagttgggtcttgaagggaaattaatttctaaggattttctcacgtcgtttggtttgatctggtctttatgccatctagaactccttaattcggaattgttaggagattcaggatccaatttgttgtcatggataggggcccacaagaacttgacatgcttgatactatctgagtttgacttctctagcacaaagccttcatccattagtaacttcaagaatttgagaagcttgtggttgtttggctgtaacctcactaggccaataatgtctgcaattggtgatctcgtggacttgcaaagcttggatatgtcaaactgcaatacatacagttcaatgccatcttcaataggcaatctcacaaatttaaaaagcttgtatatcaacagccctgggtttttagggccaatgccggctgcaattggcaacctcaaaagcttgaagagcatggtattctcaaattgtgaatttactgggccaatgccatccacaattggcaatctcactaagttgcagaccttggaaattgcagcttgtcggttttctggaccaataccttattcaattggacaacttaaggaattgagggcgttatttattgaagggtgcaatatgtctggtagaataccaaattcaattgtcaacatgagcaaactgatatatttggggcttccagcaaattatctgagcggcaaaattccagcacggcttttcactcttccagcactactcttcttggatctttttggtaatcatttttctggtcctatacaagagtttgatgctgtgccttcatatctgatgagtttgcagttgaccagcaacgaattgacaggagagtttcccaagtcattctttgaactcactagtttaattgctctagaaatcgacttgaacaacttggcaggctctgtggatctttcatcttttaaaaggttaaaaaagctccgtgatttgaatctttcacacaataacttgtctgtcattatggatgacgaaggcgataactcttcatctacgtatctctctgaacttaaagagctaggacttgcatgttgcaatataactaaatttccaagtattttgactcgtctgagtgacatgtcttatttggacctttcttgcaataaaatcagtgggaacataccaaagtggatatgggagaaatggagcagtagcgtcgtgcatttaaatctctcccacaacatgctcaccagtatggaagttgcttcatatcttctcccttttaataggcactttgaaactttggatcttagttccaatatgcttcaaggacagattcctataccaaacttatcagctgaattcttggattattcacataatgcattctcttctattctgccaaacttcactttatatcttagtaaaacctggtatctcagcatgtccaagaataatataagtggaaatataccacattctatttgcaattcaagcctgctggtacttaacctggcgcataacaactttagtgggccatttccgtcctgcctaatggaacaaacgtacttcagaaacatattaaatttgaggggaaatcactttgaagggatgttacctaccaatgttacaagatgtgctttccagacaatagatttaaatgggaataagattgaaggtcggcttccaagggcactaggtaactgcacatatttggaagtccttgacttgggaaataataaaattgccgacacttttccatcttggctaggaagtctttccaatcttcgtgtccttgtcttgagatcaaaccggttgtacggttctataggttatacgtttgaggacaaatctggagatcacttcccaaacttgcaaatcattgatttggcctcaaacaacttcactggcagtttgcatccgcaatggtttgaaaagtttatatctatgaagaagtacaataatacaggagaaactatcagccatcgtcatagcatatcagatggattttaccaagatactgtcacaatctcatgcaaagggttctctatgacttttgaaaggatcttaactaccttgacagcaatcgacttatctgataatgcattggaaggaagcattcctgagtcggtcggaaaacttgtttcactacatgtgctaaacctgtcacataatgccttcagtggaagaattccaccccagattggcggcataactgctctggagtcactggacctgtcttcgaattggatttcaggggagattcctcaagagcttactaacctgacatttctaaccgtcttgaacctgagcaataaccaattggagggaaagataccagagtcacgtcaatttgcaacatttgaaaacagttcatatgaaggcaacgcaggactttgtggagacccattgcctaaatgtgccagttggagtcctccaagtgctgaaccacatgtagagagctcctctgagcatgtcgatattgtgatgtttctctttgttggcgtgggctttggagttggatttgcagtaggtattctgatgaaaacgagttggattaacaggtggtttcactcggcggtcagccgccaacgaacttgacctgaatatatatgaggtgtagcagacggtttcactctctggtcaaacaacgacgaacctgacctgcatatacataaggtgcaatgcataaatgtgtagcttgatatctgtattttcattagttactacttataacacatggattcagttcttagtactaattacaccacctttagtagttggtatgcgtagtatgtctactcaggatgatacactctgctgtaagcttggaatcatttactggttttctctctttttcctcagctgtccagtgaaagaacgcctggcgcctgccaaattttatcaagtgcttactgactttctggactactaatatttacacagctagccagctagaggttgggtagtgagaatttttagaatataacactcaatacgcactgcttctaggatttatcacctaattcgtactactttcaaaatacaccactagaggcgaatttttttcgttccgtaacactccgtccacccaaagacgcctgtctgtttgcccgcacgaatctggccgctggcgagctcatcctcccccacgccggcgagctcgacctccccacgctagcgagctcctcctcccgcacgcatctggcgagctagctcgtgtcgtccccgagctcagccgccgccgccgccgcaccaggctgccgccaccgcgcccagagccggcgccggtccaacctccgccgccggagctcgacgccctccgccctccaccgctgctcccctctcctccggccctccaccgcgtgcgccgatggtggcgacggacgggcgacggcggggctgacgcgggcggcgacggaccggcgacgacggggctgacgcgggcgcgagcggtggcggattgacgacggcggcgccgggaggacggaggacgacgggccaactgacgctaggggacggagtgttacggaacgaagaaaattcgcactccagtggtgtattctgaaagtagtacgaattagatgacaaatcctgaaagcagtacgtattgggtgttatgttctgaaaattctcgttgggtagttggtcatcagatcaactgtgcttcaaaccacaggttgccaattctttacaatgacggcaattaacccatttgcaattggtgaagcttgagacattcggatcaattatatgaccaactaggattttgggcttctattcgttaacatgatgaacagacaagtcagtgaactaaccgattcaaccactgccgaccgtcactcatcaaagaataaattgatggcacttgcggcagccgatggccatggcgcgtgccgccgagctccgcgcggcgccgcacgggtggctcgcgcaacgcctggcttcagtagtagctgcgcatggaggcgtgcggcgcggccaggcaaggccgtggagctcgatgccacaagctatcgacgcatcagccgtccggccatcgtcggcgcagccaagatgctggctgcgcatggaaatctgcagggaatcaagctgcgggctgcctggttcccgagcagcgagctccgccattcggatgtgcagccggcggcgggttccccacaccgagatagcggcggcgtgatctgagcacgaccgcggcggcgattccatcggagcccattaagctcacttgggccggttcttcgcagcgaggcctggtactgtgggccctcaccaccaagtgggcctagctggtggaaattggtacgagagaatcgggccacctggtacctgggccgtaaataacttaatatgggccgaaccttactagaagggctttttaggcccattctgcctaaaattcctgttgctgcttgtaggcccacccacgaagactaacggaaacaggagagctaccaataatagcgacccgatctggatcgtccaagtccgatcaaaaatcagggttcggaggcccaggcacgttagatcggtggcatgtgaatatgtgatctgtgtgggtctcagaaatgcctcgctttgatcgcttcctctccggcactccacgagatcatagttattgctacgcgttatgacattaccatttaccaattgttgttgttattagtagtacactgtagtacacttggccaaaattggttacagttgacctaaaaaatgtaaaatctgcaatcgaactatccgtgcttagctacggtgtgtttggcacagctcttccatcttttctagagctgaagcctagacaactgtgcttaattaaacatgttcgtttagtatggtctgtccaataggtagaggtagggcatccggtgcgacatacaggatgcaaacaacaggatgaagaagaagagacagggaacagggagaaacacaggtgcaaatcgatctacaccacagtatcaaactgtggcaaatggacgtactatatatgccgtgaagaatgcgaaagtttttttttttacaaattcaacgaactatgcggtaaattaatgaaagtatgcccgtcgatttcgtggcaattttgctgtaggagaagaatgctgcgaagccaagcaagcgcaggcggaaagacggggacccttactcccccatgcaccccatcaaccccgcaaaatgatccatccttccatggctcctccaacgcacgtcccccacacacaattacacatgcatgcacttcccccctttcctctcctcgtcgctcacccatgccttgccaaacacaaaaccaatcatcaatgcaccaatagctagctagctagctaaattaaagggatcttttcaagaaagatccttcattaaattgattgccatctgttcccctcacacaagctagatcgaggagcatcatcatcagcgtcaaactagcgaaaatttatcacaattcatagcccaattgactagtagtagtgaatttagaatcttagcaagcatgatgagtacatttgcttaatcgtttaattacttctatctaagctactaccacctaagctagcaattaagtccgaaacccctgttcttggtggtcttgttgccacagtcgcagagcaagtagctcagcatgttcaccatgctggtgccaatggatggcacgttgatcaccgggctaaccctaacgccatggtcggagctgccatttctgctgcccccataatgacaagctgcagatgtagcaccggctttcttgtgctgcagcggccggtggtgaccgccgcccgagacgacgccgtcgaggccgccgccctgcgccgcggccgccgagccagccgatcggctccgcatgagcgggaacgacgggcagctgaagctccccgaccccgaccgcggcgccgccgtcgtggcggaattcacgctgcagctgcgcgtgaacggcgacgtccaagaacccggccgcctctggtaactcgtcggcttcacgccgccgccgcttgttgcctgctgctgcttgcacgggcttggcttgggatgaaccggcggcaacggcggcacgggcagcagcttcccgccggcgaagagtcgatcggccggcgcgacgtcggcggcggccgcattggcgaagtcgaactccggctcggggagccgccgccacgacgacatgacgacgacgagcgacgtgtccgaccgcgccgccggtgtcgccgctccggcggtcgccacgacgccgtcgtgagagaaggagatcctcgggccgatcagctccggtgctaattcctccattggcgccactgccacagctagtagtagtgtgagaccacaagcgagcgagagatcgagatcgaggcgaagcgggtttggagagaagaaatggataaatagagcggaggcctggaagggcaggggacccatgcatgtgtgtgtgcaaatttcgcagcggaattgtgggtgcggacgggaaaccgttttgatcctctatgtcagtcagatggttaagaaaaaatttaaaaagattaattagtatatgatataacactccataaacatgtaagtacagattcaacttctacatctcgtaaaaaaacaaattaaactgcacctaattaacatatattcacattcacagtcaaatttatctttttcgttgcgatacgtagaagttgaatttgaacttgtatgtttgctgagtgatatattacatgttaatatattttcttaaatttttttataatcatctaagtgacatggaaagagatatctcccgagagataaaaatccacttctggtgcggaccgcgattgattcgatcggtgtaacgcgcgcgggacgggtcccctggtcggtcacctacctacgtgaatgacatatgcctttgccgttttctcgtttatttggatgtgaaattttggcaatccagcttggcatttttggtggcgtgcagccttcatcctgcttagcctacgtacataggccgctgctctgctttctacccaaaaccgtcatgttaatcatttcgtatgttgtactgctgctcgtactactcagtttgcagcattgtccattttctaaaatccatgctagtcccatgcattcaaccatcattgaatcatgaggcgcaatgtacagaggcgacatcgatatatactgggatttagttaaatttagcatcggtgagaatgagatattcacaattagttagtacaacttacaacgaaggctagaaaatgcatgatcactgtgtcactgttgatgctgtaatgtaatgcatggcgagacatcgacagcaagacattgttaagctctttgttggaacagaatatgatgggggtggcctaactagtccctatctctcaatcagtgaaaccagcgcaaacacggggggatgggcaacccatgttggctccatttcatgcatatttcgatcaaatatcccaaaatcatgctctctagacagtaagacagaaacaaatatcagaaaaggtagcctctcgccctcctctctttccttttttctttctccattcaggcgccgcactgaagaaagaaacaagaaaaagcgaaaagatctttgaattcttctccattttgaccacacaggtgaatctagtctgggtctctggtaaaaagtcatgaactctatctatgacaaggtaactgtctccattctccaaccgtgtacacgtctgcatgatcgatcaggaaacagcgtgttggacaatacatcatatatagttgtataaaagtattaaagcaactgaacagtcaccttccttctgaacacacgcccaattattcttccgtgccttcgcttttgagagatgctggaccagagtagatcagaaatcattgtgcagtgccatgcatgcaaacgatttatttaacataattgccaaagagtttttttaattagcaaccatatgatcatatctcactgacacatctagttcaagtgacctgttaatcagtcacagctaacacaactctgacgcagtaatgcaacctctcttcacttctacttctaacaccagctccaaatgttgcttcaatatgagaaagaagtaaaaagtactactagtagggccatctttgtttgttagctggcattgctaattttggggttttattaggagagtagtgggctatgcccccttcccgctgtttggagtcgtagtatccgagtcttttttttttccttagtcttttgtttctctcctctattggcataagtcggtctggcttaatgtgttgtgtaacaaatattcttttcttctaatatattgacgtgcaatccttctgtgcgtgcgagaaaaaaaagtactactaataacaaaaacctgagctttagattaagctgatgttgaagaaactgaaacctaaggatggaggcggcaatggtcaaagtataggggagcatctgaaacagggtcgcccttgtattcagggaagccatatgaacgaatgtttggctgtgctgtgtatagtaacagttctttctgttcgtcctcagtgatcactgttcactcggctggcatcttctactggcttcaggctggtgttacagttgccctcgtgtttgcttgctctctgattagattagggggccaaccccctggatctatggtgtttcttgacgttttatagctcactacactgttgttacggcgagcttggcgctgtccagccgcctgtacctgttttttttagatgaagacggcactttattgattactgagcatcagacaggagcatctcacggatacagtccggagtctcattacggtaaacattacagacagagggctcagagcaacgagctaatgtgtggccgctacattagaacaacgactaacatggataaaggaaacactgataaactcaacaccaaacttcttgacgtcctcaaccaggcaaccgatcttggagcgatcctgcccagttgagtttagcttttggataacataaagacagtcggaagcaacaatcacgttatggaagccttcttctttggccagccacagccatgccggatagcacaagcctccgcctgtacctgttggtgtctcctctctactggaaaagaaaattggaaggaaaatggaagcagtgattctgggattctagtgcttgggccagctttgttggatactaacttcaatggatgcatccaatccggcctctacgggacactgcactttcacaaagttcagagtcttgggccgtctgcagtcgatggattcaggggttggattcaagagcagaacaaataaagaagaaatgttgtgaatgtttcaaattaacacattggtaaatgcaagagatgagtattatgatttaccagtgtaagttgttgctctggtcatgttgtactaatgcagtttagtaagaacaaagctaacataacaagtgccgttttgcgagctaacannnnnnnnnnnnnnnnnnnnnnnnnnnnnnnncgtttagtaagcgggaggtcttgagttcgactctcaacgaaagcatatttttattatgaaaagaatcgataattctattcattttattttctgtttcttccagtttttttccattacgcaaatgttgtaaccctacttattttctagagtactatatttaatgcactgcagagctcctgctttccttaagaaagaccaagaataaggaggttcagaacagtagtattccatttccttatttttcaggccaaagcaaagaatccacgattcagatgaacatacaaggtctgaaacagtgtacagatgtccaccgcaattaagaggggagaatacatctccgacataacattcacacttcacataacaagaattcattaatctgtaagctgatattttcatcctgtggaactgaaaaatggcagctccatatcgtttagattctttacgaaaaaaaaggaaactgcatattgcaaccattctgaacacagaaaggctgaagttcatgaaactaatgctatcttgcagtgattctttctttcacttatatacaggcaccagagcgaccgtgtaacaacacacgatcgaaactgtacaagacagacagtaatcagtaattctgctacatttacaaccatctaatagcaacgcgtcgaacagaactcagcaaatcttctcccttacaagcagtgaagcagataacaccagcgcgtcaccgaagaggaaaaagtaattacagataaggaattgtgtcagctatcctttcctgaatcttgaatcattcagatcgctccctgtcactgaagaacacagacaacaagaacagcacatttcacatcagaactcacaaaaaccaacagattaaaccatgcatcagaaattcagaatcagtactgtttgaagattacctcctggttcgggtcgctgggcggagatggagactcggatccaaagatgtagaacagcgcgagcacggccatactgacggccagtgaaacgccaagaacggccagaacgctgtagattcttcgcctgtcgtcaggtagcggctcttcaggtggccccgaatcagagatggctatcgagcaagaaggctgatcgctcgtggtgcattcctctccctggccgccgccgacgacgtcagccgccgtgacttccctctcccactccgtgctcggtcccgacgggttgttgagctgagaggtgatgaacctgtcgagagcaatgccactccggcaagccttggcgcgggcggccgcctcgccttcctccgggatgaagcgctcagggcggggctgcttcttgctccgagaaggctcgcggtgcgaggactccgccgccgccgccgccgccgccgccgcgtccggagctggcgatcgaagtcgattgatcagaggaatcgaatggaaaccaagccaagaacagaagccgtttggaaaattggaattgtcatcttaccaggcagaggcggatcggcttccctgaggatggagcgcgtcgggctggattgcttcctgcttcgagacggccggatgcggaaggtggaggggggcatcgcgttcgccgccgtgtggccggacactggcaatctcgtcgtcagacgaatcgatcaagaagaaaaccaagaacaagaactcgtcggggttagtgatcttaccgaagcgagcctcgctctgcttctcggccgcctcaagatcctgctcgtttcctctgcctggcgaggcgccatggtcagcatcgggcactgcagaggcattctccggtgagcttttcacgagctctgacgacgacgtgctcagagcaggagtctcgggatcagccgacgggggagctcccgcggagacgaagcgcgtcgggccggcattcttcctgcttcgtgacaacatgccgcgataggtggagaccggcgtcgcgtttgcatccgtggctcggaacgctgaaaaagaatcatcgtcagacgaatcaagaagatagccaagaacaggggaacattcatccgggaagaagatggccaagaacaggggaacattcattcgggaagaagatgaccaagaacaggggagcggttcgggaatactcaccgaagcgagtcgccatcgggttcttgggcacctcatggagttcgttctcgccgccgtccgacgcggtcccatctccgccgccgcttcccaccgccgtgactccctccggctcgagcaacggttcctgcaccgacgaaccgccaagaaacagagaagttagagtcggtcgagcacccagcacccaatgcggctcatccctcatccactcacctcgagatcgtcgttcttggcaacctccgccgcgaccccatggccggcatcgtcaaccgccgatgagccctccggctccgtcgactcggcccctcgccccaggcccacggcatcgccgacctcgtcggagctaccctcccccggagcccctcctcctctgcgctcctcctcctcggagagatcaacaaccgcgtgcttgccttcctccatgaggatcgagttcttggcgcgggcgatcgcatgaagccgcggcggaacccggaagcgaggagaggagaggagggagggaagaagagggggtttgaactttgcgagaaggggaaaaaaaaaacaagggtgaagtggcgtggcggtggtggattggtgnagatgggcgcgacgcgagcggttataaacttgatggagaccagtaaacagttggttacctcgttagtcggttggttccgtagattcagcgtagacccagtccacaggatcgaccgcttcgagaatcttagaggcccagaatggacggctactgatcgcgtcggtccatggactgcgtctacaacaaaaacctcgaaaccggcgtggtagtcgtgttgcccaaatcgttgcgcgttgcgccaaccgcacacgacgtccgggcccacctggcagtgagacgggagtacaatgtatcttcgtcgtcggcggtcgagcgagacaagcaggagaatcaaccgtcccatcgcgaaagctgttctctttcctttcttttgcatggagagagagagagagagagagagtcactacggttttcggtggtgggtcccacatggcagccgtactacccctaccgctgaaaaaagactcgtccgccggaaacacgtgacagccgtacgcccaagaacattcaaaccatagagaaaagacggagacaccccccaaaaaaactgacatgtggggcctccatcctgtggggcccacatgccagttgctggatacggagttttttgtgcacgccgcactttccgttgcgatccgtgctctcctccctggacgcgatacgtaaacggacactggagtgtggggctcaacggctgtggcccacatgtcggttggttagttggtgggtggctcggacgttatggcgtcagtaacgtacgtgtgggctgttcgcgaggtcgggctcggagatggagatggatgctctttggtctcgggctacgccgcgcagccagtttccagtgtggtttccccattttgcccctcgtcatctcgcgcttccttgcgtacatggtcggcagtggtactttgcaacaatcatcacgaaatccataccacttttcgtaatcatatcacaatcctatttgtgttgtatccagcatgtttcatcaagcatgtattgctcggattgggatcctctgcattagagtatgaaatggagaggtgctacagtaaattaaattaggagaaatctgcaccttctattcataattctagggctataaccaacctctacggtattaacgtgatagtacaagctaaaaaataaaatattgatgctacaatacttgctgatctgaaccgtttcgtttttaatctaagtgctcaagtgctaccgagaaagactgtagcattagcaattcaaactgcaggggattcggatcatgctcggagagatattgccattgcacgtgtcaacaattgttcagtttttcatctcataataccaatcgactgtagtgacaattcagttagaccatgttcagttaatccccgtaaaggagggattggaagcaatttatttacacttattattgtgttaaattattttccatcaattccctccaatcctttttaatcttctccaaaccaataaggtcttatgtgattttgtaattaatctattggattgttttttatgattatttgctttatgtttctaaaaataggatttgtcaaaaaaaatcttaaattgcttagacaactgtcctaagttgtttgtaaagtttgtttcttttaagatattaatgtatcactacactcaagtagatattttatatcccgtgaataaaatatgttcgctgttttgtgaagcacaaaacaaacatggaaatacaccaagcatatacaaaggtatgtttaatcaaattctaaggctttgttattttgaagaggttaggatatcatcctcgtcgtacgtaaaacgaaacgatgaattaacacatgattaatgaagtgttaacttaaaaattgaaaacatgaattaatatgattttttacagtaacttttgcatattaacttttaaaaaactcgcatagtctagtattttggaaagcgtgtgtatggataacatgagaggtgaggctaggaatcttgaggaaagaacatataaataggagtagaggttaagggcagtcccaactcataatgtccataagtagtgtctatgatgttatgccaataagacatcacaatagaaactacacttcacaacccatggtttcataaagtgggccattaataaatacatcatctatcttctctaccaatcatatttattcttcatctattatgaagacattattctctcccaatgcaaaacttgatagtgtctattgcataggttctcgtgttaaagctgtgtcttgcatgagacccaatttcttcctctcttcactctctcttaattaatatagtgccacataagataaaagttctacatagcaatgtaattaatgccataaacaccatcctaggtagagggttgggactgcctaaaggccatgttattttctcctctttcccaactcaatttcctcgatttttacgcacacgctttttacactattaatggtatatttttttaaaaaagttttctatatgaaaatttactttttttaaaaatatattaatatatttttcaagttttttactaatattcaattaatcttgctataactgccgtgtcgggagacaacgttgggaaaaac

SEQ ID NO: 64382 - DNA, 3547 bp, Oryza sativa
ctccttaaaaaaatcatccaacaacaaaaaagaaaagaaaaaaaaacttggcctcaacgcacacgcccccaatatttattcacaagcaacaccaactattccatctatttttcctttcccccacacttccattccatcgccccacccaagccccaaagccaaagccgccctcctctccacgtcccacgctcttcccctccccctcccccgctgtcgccgccaccggagtcggagtcggaggaggtctgggtgacggcggcctccacgcgcgcgttcgtcgtcgcggctttgcccgcggccgcggccatggtgatctccgccgagccgcacccgcctcctcccccggatcccgtcgcggatggcgccgcggcggtggaggcggcggcgtcgagcgctcgccaccaggccgcggtcctctcgtcgttcccgtcgctgaagacgtgggggagccaccgcgtcctgcggtgcgcccacgtcaaccgcgccggggacgccatcgcggccgccaggcgttccccggagcagctcgacggggtcaaggagcggctcctgctccacctccgcgaggtggatgggagcgacgtggtggccgacgcggaagttgcggcggcggtagccgccccggccccggcggcggctgcttcgcgcccgtggaagctgcgcagtcgacgtcgcccggcggtcgccccggcgtcgagcgcgtctccgccgccggagcggagggccgcgagggcccgcgcggaggccctcgacagggcgcggttctcggtgacgctgacgagcgaggagatcgaggaggacgtctacgctgtcaccggcgcgcgccctcgccgccggcctcggcggcgacctcgccccgtgcagaagcaactcgatgtgagttcatcctcctccatctcttcccttttccttacgcttcggcccccaccgttcatcctccagggacccatccgtaatttcgtaaaaattcacgtccccagctgctatttcccggtgcatggctgtccgagatcaccgtcgagtcctaccgggtgcccgacgatcggtgagctgagcagagcagatcagagcactgtgacatctactatcaggcaagaaatcccagaagctagtaattcatcgatcatcacaatcacaacaatctcctgttattaatcgatccttattaaccccatgttaaattcctcccttgttatggtgttgttgttacgagctagtagtagtaaatcgattggttgattgaacagagtgggagtagcggcaatattagcagtggtaattaattaaggagtagctgttcttgttagcagaaggacctcctaattatgaagtggtagcagtagtggtattgtcctccttgatggtacatttgttaacaacatctcaattgcaatgttaatgctaccttccttccatgcatccatcgttaaattcccttttgttttttttttcgattgcactgcttcatgctcaaggtggcaacgatattatgcaagttatttgactatgtagtactccaatcagtaagttttatagtatttaattaccaatgttatccttaatcatggtcgcataccggtaactgctgggtttgcggctgggccaacagcatcgcttgccgcaagcagagggagtgaggctgacgggtgggcccggcccgcactggagccgaacagttttgcaaaccctggcgcctgcttgccagtgagcacagggagagccttttcgtcgcctgtttttactttggctttttagtgcctcgtgggacccacctgtcagaggaactgaggatggttgacacgtatctaatcacgggtgggcccggtcgtggacgtggaccgggccaggtttgctcggccagtcggaccatggtgggcttggtccacgcacgttgctggaattagccggaagagggtttgctgctgctgcgccggttgttttcatgtgttaaacgagagctattgatacggaattacgggttgctagtgggagtggtattaaatttttggactgctaccttaccattttaggtcaattttggacggctcgatttgtggtgatgagtgagtaaataacagtgatgagactgtggacaagtagattattagatggatagatggcacggcacgccaatggtcctctcctctgcaggtcgagttgcagggcgatccttgtacagtagaggccatctgattggtagcggatggtccagatcgatcatacgtgcgaccttgacattgcacctaacattcatatgggattaacataatatcaacagggcgacatgcatggatgcaattgttgctcaaacatgtagcagcagtagttccttctttctgggatactttcaactctgacaaagtatggcaggtagtagtaatgatcgttcaactgacgatgaaatgatgagtcatcgagtccccatgtcgacagtcgacaaaaggaactgttttgctgaaagcatttttactgtaattgagagagtcctacaggtgtagtgctgttcttgttcaagaaatgggttgtgcttggcaaagcttcaggaactttcccaaacccagtgcattatgattcgggatagcagttgctgacttgcagtgcagctgttgcagttgcagccgtacttgggcagaagtctaccctgttccgtggttgctgagcaatgggggtgaggacaaaagcgagcttgtactactccagtactgaacagtgccaacgtagtccaaccgtaatgatctgcaaatgcacacctgcatctgagaccaaaacattcttaggttttgcgagtagaaaacggaggttatccacttcaattactattctgtaagaagttgtaattaaagtttttaatttaaacgtgcatgagaaagttgccgttatgtgtgctttgggtgagattctgaccaagacatcccgcgttgtaataaaattttgtaaagagaaacctagccttcagctggcacgtgctaaactccgtcgaattcgttcagtggcggtgcactgtcaacgcgttgacacaaaactaaattagtcttctcgtatttgattccagaaaggaaaaatacacaatgtcaacgagcatcatagctttctctcgccttggaactgtacgtatgtattcactccgtttctaaatattcaacgccgttgacttttttaaatatgtttgagtgttcgttttatttaaagaatttaagtaattattaatttttttctattatttgattcattgttaaatatacttatatgtatacatgtagttttatatattttacaaaagtttttgaataagacgaacggttaaacatgtgcttaaaaaatcaacaatgtcaaatatttagtaacggagggagagtatatgtgtatggcgcacaagaactcacgcaactgaatgtgcggatgtgtttgatgcttctgccttttctatggaatcatgcaacacacaacgtgctacacgaacgtacttattacatgctctttgtttcaaatgaaatcaacttttatgtgtctaactagcgcacgattatatgattaagtatgagttatt

SEQ ID NO: 64383 - DNA, 1386 bp, Oryza sativa
atgaagctagagatgaatgttatcgcgaggaaagttgagtgaccattttgtgctgggcaatgcatgcgtccacagatctcgagccaggggaggtcgagctggacgctctgcggtgtcggcagctctcgtgctcctcggattgtgcaccgaggccacgctcgtcctcttcaagatcgatctactacaattatcaacacctgcaagctcagatgttttttcttcatggccaagatagacttggcggtaccgggatatgcaaggactgaagtcaatactactccctctccgtccctaatcagagagcgtgaagaaaaatcaccgaggcctggtttagtttttaactttttctttaaacctttaacttttctattacattaaaattttcctacacaaaaacttccaatttttcgtcacatcattaaaattttaatcaaacttctaattttgccgtgaactatacacaggccaataccaaaaagatcacgtcctaattaaccttattcattgtcctcaattataatggttgtactccctccattttataatataaggtataactttttttttagtattgtactatctccatctatttttgatagacatatttccaaatctgaaaaaattatttttagtaggcatatttcaatccaacaacatatccttttaatgactttatcagatttaatgcgtgactcttcattcttccacacaagattgactacttcggcatcaagaaatataaatattaatgaatcgcttatttacgaggaataactagtagcatatttaaatggatgataagtagaattacttatccttgatctgtgtgccaagataaaatatgattatcaaaaatagatagagggagtataatataaggcatgcgttcatatgcaattgactatgattttttctgcattcatgtagtatgcaattgactagaacttcatctccattaaattattattttttaaaatcttctactcttaaaatatatttattggtgatccaaattaggatatgttaataattatttcttggtttttgattaagggtggttatatgttaaattttggaatgcagagagcggttctctaaacgttactacctagcaattctccaagcgtcgttccgcatgcatgcaaatagccgagggacagacaacatcaacaaaatttcacatcctcagccctctaattagggggtgtttagttctatgggtataaagttttagcgtgtcattgggtattatatatgatgtcgcatagggtgttcaggcactaataaaaaaactaattacagaatcagtcagtaaaccgcgagacgaatttattaagcctaattaatccgtcattatcaaatactctctctatctacttttgatag

SEQ ID NO: 64384 - DNA, 8127 bp, Oryza sativa
cagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcattttctaggtggaagttcaacttaacagtctccaccaaaaccctggtatatcaaacaggcacaacattgagaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacacgcgcgcgcgcgcgcgccgggccggggcgtgggcgagggcgaggcgtggctggctggctggcggcgtgcgtcacgtcacgtcgctatccttttgcagccactaacccacgttcccacgattccctccgcaacagcgcgtccacgttctttctcctgatagataaggaggccgcgagtccgatccgatttcttagcttctttcccggtgttagtttctccctctccgcgcctgagttgctctcgcttccccgcttctgatctcttgcgcgcacgagagattggaagaagcagtgcctccgaaaccacacctttgcttgagatctgcaccgggtaggcgggtgatcaggtttttggggagtgcctcctgcacgactgctcatcgccatgtctggagttgctgccgccgctaccggcggaggtggtgcgccgccgccgacaggagctggtgcgccgccgccgacaggagctggatccggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacaaagaggaccctcttccctcctcttaaatcttctttagaaaggatgaatgaatggtacatgggctcaataattggtaagcacgtgtgtaatacaaaagttggcagcatttgtatagatttagatgtaaggcccttcacagtgcaccgacctggcgcgtgatctcgttgctccagctcggattcaggtcgacgtggcgacgaggcccgcaccctactcagccgcttggcccctatctgggatgcacgttttctcgccgcaacgagggcacgcggcgaaggaaatctgcgctgttggagtcgttgcttgattcgcctgctcctcgccctcctcgacgaccccacctcgctcctcgcgatcctcgacaaccccaccgcctgctcgtacgacggaggcggaggcggcaggggcttgggtggagacggatggggccgctccaagctcgacggctggcctctagctacaaccttgctcagcgccgccgctcacgagcccccgtgttgctgagcttgccgctccatcgttggggaggctcaattcgccggcgagggagaaccacctccgcggcggcggcggcggcttcatctttggcgaccaccgtgggggattcgaatctctctctctctctctctctctctctctctctctctctctgagcacctatcgaatccagcgagagtttatctcgtgaatccggtggagggaggaggggaggaggccggtcgagggagtaggggaggacgccggtggagggaggaggagaggacgccggcggaggaaggaggggagagccgaggaggaggagagacggcgtcgggcgtgacgagggaggaggagaaaagcggcgggcggggatgagtctggatgaaggctgattttttggggcgtgaggataagacacggcgcactagtattgtggggtaccgagcactgtgaggtgcgtgacctagagataaaatttgggccaaaatcctcgctggaatgggatggaggcacgcatgccgtgccttggactactactgccctaaggtgtcaccttgacttatgcgttgaactcataggcatctgaaaggtggtgggccaccatgcttcgctttaagaacactgcatctactcccctgtgttttcatatattttcgactcatgcattagacttgaaactagcagcatactaccgctatgctgggcctgctattcaacttcttggatttacataaaaatgggggctaaaagatgccatttaccgcatgggtccagttctttttaactcctttttataatatggatgtgactagttgatacaatgcagcaggagctcctccaactgtttacatatcaccaaaaagaaaaagaaaaacgatcaacacccaccacagctttctaaaaaaaagcgaatattagggaatgacctaatataaaataattagaatgggtgaggcttcgaagctaagccagctagcccaccacagctttctaaaacgagggtaattcgaggtttcactattagatcaaaatcatggaagtaagcatcatacaaatttgaagaaaacgagtcactattagatcaaaatcatgggaagtaagcatcacacaaatttaaagagaatgaaactggaaaatcaaaacacacaggggtagcagaaagcaatggtaacaatgaggaaatttcagcaattacctgtgaatgagtttgaatgtatccgtcaagagcttcaccagctttgtgaacaatgcacactagtacaagtgctgtaagaagggcttcctttttgtctttcaatctctttagtgccctgccattctttccctcttgaaccatatttaagccctcaagatgtatggtgctaagagcatcaccaatgcggcttttaacaatatcaaacccgttcagagaggctttgccactgctcttgttaaggcgaccacggagctgcttttcagcagcgagcagcaaaattgctgcctggacatgcttctcttcatgctgaatgtaattccatacctcgtcgacaatgttgtccgtctgtttggcaattaatctagtcgtgtccaagaacattttctgcatgtcagtagtacgtatttgaaatgggctaaatgctctggcagtggcagtaatataatagagggatatatataggaattgaataaagaagaaaaaccatctcaggaagacaaaggaggaagatgaggttgatgatatggtccccatgagcccaatgatcctcaatgtacttgtgcatgctggcattctccacagcaacatggagagggaggaggccctcaatgacgttgtcgcccttggtgcggatgttggcggacgcgccgcagcggaagaggagcttgaccatgtcgacgctgaagttctcggcggccatgtgcaggggggcgaagccgtagcggtggcgggtgttggggtcagcgcggcggcggcaacgcaagagaggagaggtgccctggagtgcgaccctggcacaacgcagagcgttctgggaggccatgttggtgaggatatcagggtaaagaaactctcccagtcccatgaaacctgaccaacaattatagacttgatagaattgcttcacgctatccttctgaattgctggacgaagtttcggcaatacaacacgaacgtacgtacttaacttctcctacaatggcaataatatttatgatagattgatccatcgatcgattgcatacaataaaataaatatatatatgctggtgaggtcaaaattaattaattaattagtttgcatccatggatgatggatcgaagaaaatacgtacctcgaacttttcctcgaaatatgctttatatttaggattttttggcatgataccatggataggatcacagttgatgagatcctcaagcttctgcttcagtgtccatgatccgtaatcttcggcttggctgccactgggggcgactgctggaggacagcttccatcttccatggtcatcgtacgttgaactagctagctaggtggctgcggcgggcggaaaccctagattgatacccgggccggcggccggcgctgccggagaagtactgcagagcaggctcaggcggcggcagcgtcgatctattctcgcgtttctttctcgaacgtggcctgggcctcgtgggctagcaatgccgcttgggccaaatgacttatttggctcaattgttttttttattattattattgaattctactgactgtttagcttgttctagccttctaggaccatcaaaacatattagtcgtattgaattaaaaaaaacatattagtcgtatttaaaacaaaatttaaccattttaagatttcttttcattcttgtacaaagtacatgttcgagacttcgagtttgtttttccctgataaaagtgtcactataaattatccaatttagaattttttttggtagaaagttgtatattctggtagaacttttaacaattgttggaagtttctaatatatatttttattttcgtataaagtttatggttagaatcttccgcatatgtgaagagaaattttacagtccttgagagatacaaataagtaataatatttttagtgcaaattctgtactggaggttctgagaagtatcaaattttacattagaaaatgtaataccttccaatacatttttaagcacgtaaaatcactcttgtgtgaaagtttttcgagagaacatgcagactctgccgttcactattatattagaagtaaatgtcaaacaaggtttagtcagtcacggtgttacataaaggaatacagctagagcagtcgccgcgttcatgtagaaaattcatggttagaatttttataagcacctttatcaattcttcctccaccgctgaaaactcaaccgggaaattgaaacctgaaagtattccttttctgatgacgagaatttaactttgtgaaacgcgaataacattcagcaattcagaacacttctcctaaaattaattttccagaacaagtatcacagatacacacaacgcattgttcgatcagcattcaacgtctccctcataagaagcaaacattcagcaattcagtatggaaatttgaaagtacccttaattttgcttccagaagtccatgttctttattgatagaatatgacagctggggaaactgtttataaaggagataaaaagcctacaaaaggataaaatactatgctctgtttggttgtttaattagtagcctgaatatctccagaagcacgcaaacagaaaaagaaagtgaagatgttcctctgaacaaagcaagaagctaaaggtacagcaatcaagctttctgaaatgtgcctgctgcccttattcacggcaggccaaaaaactctgagcctgtaccatttagtccaaactccaaacgcacatttcgtcagttcaattaaacaacttagtcaatacatatagtcatgcagatcaatcaatctgttgcatttttctctctgttgtttcctttgataaaatgtacaggccgcgaaaaatgtagagactaatctgctactgacctagtactttacagttgtatgctactacatcttgaacatatcaacatggtatcccttcttttacattgtgatgtggcaggtgggtatatgcacaccatattaatcactagtaccaaacaatttgacattctagcttaacacctgtgttaggtagctgcatatgtcaatactggaatcgtgtttgctcaagagaaaagatatgtttacataaaacaacctcacctgaatacccttcggttcagttggttacctgttccatagctgttgtactgacttggagtcgatcacttttacattagacaggaattttttcgaagaaagaatgttggatgttgacagactctacatattctccttgttagttaccgtcgttctcaccataaccctccttaacacccaccacctactactaatgctacaactattctagcatttattcttcatagctccatcttactcttcgctactcaagtaacttatctacaaggattcatttggaaatgcaaagtaatttcttgggaatgacaactgtgaagagctttgtagtgacaatgcagttattttgtagtgtcaatggtactgcatcacttctatggaagttttaggaaaatgattcctgttaacttcagcttaagggccatgatgtctagctatttgttaaaggacaatgatgacatttactaccatatacaactccatgaaccaatcctagcattccaattcaagtttggttgatgtatgtcatgaaaacttgacatctgaaattaattatcattgtacctaactttttgcaacagagatgacaatctgttatctgaatgttttttaatgcttcttttgctgtaacatcttccttcaaaaacgtttgttgcaccctttttatgaaaatataatcatctaaaagtttaataaggtttagaatattagtgacggtcagtactcatgcttgttggttgcataactgcacactcctttggctccccaccactgccttcgtgcccattccatcaaccattcataatcattaatcttttttgtctgagatttctctcatatgttgagcgcagccaattgttcagattcataatacacctggtcagtcaagtaacgtacagcagagtgcaatttagagaacattgtggggcattcagtgcatatgcaccaacatgtgaagcatcttttcaattttgaaaggacaagtagtggagcaccagggttgttaaatgcctccaaattggtatcaagctatatatcagcctcagcctaaaatattttgccaaccaaggaaaccatcctgatcctgctcatgccaatagcatgttccttcattttgaagattgttcctagtgttaacattttgactttagattaccttgaacagaagaaaccacataaagctaaaggggttggacgtttgcctactaacagtccttgcaattgaatatgtggtagttagcagcttagcacctgcatgcttcttccaatacttttgccaatcagagcttgtggaaatgaatcatttgatggggcaaggatttggcccattatgtagatccgaatttcaactaatagtagctccttttccctttttatgttgaagagaaaattcatttgcctgaaatatacattatttacttattactcacaagagtatctgcatcacgagaacttctttaacagggaaattaatatataggtacatgtagtccttcaaacaaaaattcacaattctaaaaacttttgatctctacctccataaccaagttacctttgttagtgtacatcacatcttagctaggttccttggactctagcaaatggaatggtgcgatcaaacagcagtaaacaccatgtttaatccattatctaaaaaaaatgcaaatgtctagagcacaagcccaacaactcctaccagagcaaagaccacgcagtgtaactgctaactacgagtagtaatcacagttttagttatgcatatgctagacaatgatggaaaggaagggagtgattcatggattgattctattgtcaaaaagaagttgttaatcaagcacttaacctttgttgacatgggggccatagagacttggaaaagtctcatcctgttaacaacattttgtttcttggacttgaaaaaaatgttgtcttttgttctaaacaaaatgaggcaaaaactaaagttacttttttggccagtggagacttgtgggactggtggctccactggaaatgatacgttaattcattcctcatgattccc

SEQ ID NO: 64385 - DNA, 2750 bp, Oryza sativa
ttttttcgaaacaaatcgcattcattaactaagagatgggcttaaactttccctattcatgtccatcatcaaagtcatggtaccagcataacaaattaacacctgttgtctgctgagatcaaaattatggtacaacattgcctcatttccatgtgaaaaaagaacacttcttttcgttggaattggctaggttgactcttgttcctaatgcgaagcaagattgtttggtctaatctttttagtaactcaagcaaagtaagtaatcatgtcaacatggatgttcaattttatactagaaaggagagattttcagtaggaagcgcatacccctttgttagcgaagatgccgagttcgccggcggcgcggccacgagcctcggcgacgtcaacaaggacgatgacggcagcgttaccggggatccctggcggcgcggcgtcgagggtgatggacacggtgtcgaaggcgccgaggcgacggatccgatcggcggcggcggctgcagcgcgcacgaggtctctgacggtggcggcacgcggcaggtccgagccgaccgccgcctccaccgcggcgcggcgcgtgcggcagcagccccggatctccacatcgtgcacccggatccggacctcctccgcggtgaggcggcgcaggacggactggaggcgagcctcgtcggacggggacggggagggttcttggtcatcatcgtcctcctcgtcttcgtcatcgaggtcgtcgtcgtcttggaagtcgtcgtcatcatcctcttgcaggtcggggtaatcttggacggaagcgggagaggatgcggtggccattggatgatcggaaggggatctcaactgaattgggagacgaagaagacgactctactcactcaaactcaaggatgccttcacaagcaacgaataacactatcaacttccttttttggggtaaaattaaatttatgcagagattgatgcaattcaggagtttcacaagtttctttttttaaagaacaacaaatgcatgatagaatatgtgaaaaattgctacgatttatatggtatagaggtaatgcctttgatacttttttttttgccaatatgcaaaagatttgagtatcattatattaaactgaagggaaatgtttaccacaaacatgagaagaaaagaaacacaattaagaaatatatatctagccgcatgagttggtgagcacaatagaacggcaacaacttttttttaaaagaaacacaacaggggaaggccccccgttgttagataaactttattaaagaaataaaaaaagattacaacatcctaatccagttaagaattactacatctttatcactttcattaagaaactagggaaggagacttattctaaaaaaatatagccattcctttgcttctaaatattccaagctcccaatagaaaaatttccatgaagcaacaattctgaaaagtgcacttagtctgcaatagcatatgatcagaggacaaagaagtgtcccaaattatgcccaaagagttccagtagctcaccgaaaaagagcaaagaaagaacatatgcaagagatcctctactgattgagaagaataaagaatacacagtaggtcgcagtttggaggagtatagtgcttatgatccagcatatacttcgtattcaatctattcattaaaagcagccatccaaaaacaacaacttactaagctcgtatttcggttgatcttcgtagcgttgccttaaatgctaggatacatcgtctaccactgaaataataattagttgtaaatgcaaatactcatgtcaaatctagaatttaaatccaggtggttggttccaacataaccagttgagttacgctcactttctcgttgccttgatatatgagagaacacaagcaataggtatcttattataaaaaccatgccttacattgtcgtatgcatgctctaaattataatccaaaattacgtttacattgtgtcattatctacttaaataacttcactaacatgcttattggtactaataagttactccctctagtttttttttacaagatattggctagttcaattttatactagccagtgtcatacatataatggaggtagtatatagtacttcaaatacacacaacacaaagacaagattacatatgggttaaatgctatttatttccttttttttctcacctttacaaacctgcaaactcatttctgcaaagaaaaaaaaatgaaaatatgttgcagagtattcctaattgcctactatgatacaagaaaaaagaaaacacacactgaatttcagtttcaggctttcacactgaatttaggccttaactgaatttcaggcggtttcggaggaggcgatctcaagctccgcccaccacaggggcttctccctcggcaattatcctttaattagtttatctgctgaaatagtttatttcttttagagaaatactgaagtggacttatcctttaattaatccagtaatttaataactgttttaaaatttcgagtcgttcttttttttctcattgtagtatgacgcaaaatctcgtagagttatccaatcaagaaactataaacgtttcatagccacaaaaataaagaaccctcactttgctaaacattttctgcaatgttcaaatcctccagtaccatcagctacagactccgaaattgtgccaagctctttcaactcggatggagtttcactggaaaacattttctctttgagtaatctgca

SEQ ID NO: 64386 - DNA, 1959 bp, Oryza sativa
gcacaactgggaaaagttaaactctggttcaaagaatggactcaagagtcaagagcgtcaatgtgtttgacaatttgagctgctcctataatcattgtttacaaatcttaaaattgaagaatcagttaataggaagcgcacgctaccacgcttcatatttctagtaacaagatgtagaacttgcggaactgagggcagtaacccagcatggagatcgtaaagcacgcattgagataaaatttgataataataactagcggaagatcaattgggcacaagtgatatcgattaactgtctacgggtctataatagataagatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtggaggtcctcatcgatctcgggcgctctgccggtggtcatggtgtggttgtcgtcggcgggttcgtcgtcggcgcgggtcttcttgtgcaagtcgtggacctcgccggcgagctcctcccgcttgcgggtaagcatatagtgtagggcgccgccgaggaggccgacagcgagggtcgccgcgaggacgaggctgaaggcagccggcgagagctgccgcgtcagatccaggtcgcaaccacggcgagacctacacacccgagcggctcggcgtgagacgggagggaacaccgcaccaagagatgagggagttgggcgacggaggaactcacctaccttggattcgtctcgttcgtggatcgagctgttcttccttcgcttcccttgtactatactctatatctagggttttgaggaggaaaaaagaagaagaagaagaagaagggctaatttgtaaattgtggccgcttctcttgtgcgtctgataataagaggagaaggggagaaggggagttgtttgagtttgagacgagacggaagatgtgggggtggggcccagctggcagtgaaagaaacgaaaggcaaagcaaagcatcagtgctttccttggcgttggcgccgtgagcatctgcagttctgcacatcaactccatggaaccatctcgaaggaataagttcatctaaggtccctcaactttacaccgaatccgattttcgtccctcgatcggaaaaccagacacaacggtccctcaactatcaaaatcggtgcagattaggtccctcggcggttttaaggacggttttgactgacgtggcacctacgtggctaatttgactcggtcttcgtccgacgtggcattgacgtggcgcttacgtggcaattcgacccggaaaaataataaaacccatgggacccacatgtcagtctcacatagaaaataataaaaaaaatagtgggacccacgtgggcctcacatgtcagtcaaactcacccttcctcttcttcctcctctctccccatctccctctcttcatctctctcccctctcctctcctcttccggcgagagcagcgagctggaggtggcggcgagaccggcgcccaccggcgagagcagcgagctggaggaggaagccggggcgataaaaggggatcggcgacggcggtgggcggaacagatcgacctgagcggcgacagcccccccccccggagcagcgccggcaatcgagatccggcggtggcggccgagagaagggcggtggccggcagggagaaggggcggcgtgcagcgatggccgccgaagcaggaggaggagatgtagccatgcggggaggcgtggcggtgacagccgaaggaggaggacgtccgccgtgcgctgctccccccggtagtggcagcggcgcgggggccctgggagtcgccgaggatgcc

SEQ ID NO: 64387 - DNA, 3988 bp, Oryza sativa
tgggtcccacgggtcgaattgccacgtaagcgtcacgtcaatgccacatcagacgaagaccgagtcaaattagccacgtatgcgccacgtcagccaaaaccgctctccaaaccgccgagggacctaatctgcaccggtttaaatagttgagggacccgttgtgtctggttttccgattgagggacgaaaatcggattcggtgtaaagttaacggacctcagatgaacttattccccatctcgaaagacacaagaggagtctcgggaaaaagtccacttcacgtctcttgtctcatcttatcgttaagtttaaaatacatccctcaacaataaacccaaatatagcatccttgatcttgcaaaaaccgcagtatgtatgggttggctccgctgatgtgacaaattgactcggtccactcacactgactagacacttacatggcaaaaacaaaatatagccccacatataattctctcctcccttctctccctctcctctccttcctcctcccctttttctccatctctcccccgcaccctggtgatactcaacaccgcgctcaaaggatgtcgccttctccacatctccttgttgtggttcgacagcggcggtagcagcgatgacaacgacaacctatgcgggcgccccaacatcacgtagaacgagcccatattgttccttatctgggaccacctcatgctcgacatcttcactgcagaggaaggtgccgatgaggatcaatgttgggtgctcaacatactgctatacttcttgcttgatttggatggccagcgtcgagcttttacatgtcacttattgcgtgccttcccgcattaggtcactcctttcttcgtcggtcaccacccttccagtccgtcgtgagacaagtgggcggcgtcgacgcccggcttgtaggtgacgaggtgtgccaccactatcgagcgcgccgcatgtcggtcacaatctcctcgctccgccgattgtccgtgcctccactacttttgccatcgccaagaccgaaggatggggagagagataaggaagaatatttgtttcgctgacacgtggatcccacgtgagttttatcattttttatttttttcttttagtgtcacgtcagccaaaaccaccctcaatactgtcatgggatctaatgtgacctgttttgcaagattagagatatgttaacgtgacctgattttgcaagttttagagactaaaaaaatgcacgtgcgttgcaactgcgtagtctattttaatcttattattgttatacgatttagctatggtgaaattcaccatgggaattcgcctggatattttattttacaaaatcatgaattgcaattagaagttcgatcgttagcatacgggttttttttaaaagagatttcttatgcgattcattctgcatttttaaaagcaaatgaacctaaaaccaactcaaacacggatctatatttccaaaaaaaaaaccgactcaaatatgaagacgtactaaaataaaagtaaaaatatttcagtttttataatagcagagatacatgtgttataatgtggagcctcgccacgccagcaaaggtgggctcaaactcaaacataagctgtcacttaaggcccaattattcttgatgggcccatcctcttctctttctttctcttttattttttctgttctttcagaggcagcaaagcaaagggacatatatgcataaaaacttgccaggcttcgagttactaacataaactactaggaacatgacataagcacgatgaaacaagcattaacaccacaatggtttatcatattgttccttattggctgccagcaaaatctctctagcaacaaacgtgtaaatgcccccaaaatacaccatcaccatgactccatgcatagccacaatatcacaagtatcgctacagccagcggcgccatgttccttttctgcgaggacgcgcgacatacacatgattctgaagctctactgacctagacacagggggaagttcatgaccaaattggttggttcattcactccattgctactgcgtgcttaatttgatgaatacacagactcgacttattttctttctttagctgcatgatcccatggatggaagaaacgaaacctactactgcccttcacacagtctcctccattcaagcttcttcctcaagcagcttctgatcaaagtgccacacccctgcaacacaaattacgtagcaaacaacaactgatgagtcaaaccacaggtctatagatagatggtagtacatcaaatgaagtattttctgacaaaacacactaaccatgcccctttcccactcttctcagctgggcgacatactcagagatcttcttgatggcttcaacctttcagagcaaggcagatattttcagcaaaacatacttcactaaagcacagcagttgaatatttaacatctcaagagctagttcagtacccaagtgggcagaaggtttttacctgctcctcaaggaattcgctctcaacgaagtcggtcagctgtggatcattgcaccttgatgccacctgttgattcacagcaacacattttcaagtttcaccatatatttcttttcaaaatagtgttgagaattatacaacacattctaaatccatgttcagcattactgcataacaggagaatatcttacactgtgcaggttgtgcaacttctcatttacaagcttttcgagagccaaggccaactccatagctgaaatcacaagcaagctagagggtaaaacataggggtacacaaagtttgtacaggtatgtacagcaacaaacagccagtgcatgctacttcctggagacactagcaaatgccataaggtgaaatggtggaaaatatacaatgacgttttctcctttaggagcttttagaatttagagaatctttactgtgcagtccaaaatgtttaaaagaaagcttctacaaaacaaagtagcctttattgaaagttactcccttcgttttttaatgtacgacgccgttgtctttttaatcaacgtttaaccttttttttgcaaatataaaaatatttaaatcacgcttaaagaacatttgatgataaattaagtcacaataaaataaataattacatatatacacacacacacacacacacatatatatatatatatatatatatatatatatttgaataagacaaatggttaaaagttaatcgcgtcatacattaaaaaacggagggagtaattgacatcaggattcaacatggaacttttgaagaggaaagtatccctgttgaatctggatggcgaatgagctcattcaccaaggaagttcccctgtttttgcaaaaaaaaaaaaaaaaaaaaaggctcctcccaaccttaaggattgagccacttaattttcacatagataattaacaggcagacactcagactagcacacagtaagcagaagcataagtacatataccatggaataaaaaacatatataggacaagctgaaagcaactcaccatacaaggcatcccctttctcaggatggtcgaactctgtcaaaggtgtgacgatggactggagccgcaccctgcctccacgcatgttctgacaaagaagaacattgcagtattagcatttgggtgcatgattatagtggtacagcgtacagttttcctggtgtgccaattggcagcagaggtaaagttacctggtacttgatgagtttctctgcgtgatccctctcctcatcgctggattctttgaagaatctgaaggaacagaatttgtcgatacatgagtgacaattttcctacttggtgatgactaaatgagggtggtgatggcttacttggcgaatcccttgagagcaacgttgtcacgatcaaagtaggcgaaaagggagtggtacgcgtacgatgcattgtactccacactgcaaagattgaactcttttttaggattgaattccaattcggaatataact

SEQ ID NO: 64388 - DNA, 1154 bp, Oryza sativa
atatatataggcgcgtggagctcacggatgggccacacgtggacggtcgagatgggacgaaggcgagggagcgcgtggcgggctcgtggctgggaggatattttgggctggtggtttgttgatgtggagcccggcccggccgcaccggagtcggtcaagcttaaccactattcctttccggattgcttctgcgttctacttgatggatcggttagtctcgttaatttcgtcatcagcattatactgtgagacttttttagtattattcatatttatatagatgttaataaatatatatatatacctaaatttattaacatgtggacaatgctataaagtcttatattataaaacggaggaaatagttgggtggagttactgtgtttattgctttccttgcaagctgatggcgatgagttgtacaaaattccacacaaatttagacgtctagatgcaatgcatgcatctggcaaatttctctccttctgatgattggtcagcagagaagacaggtgggatatcgaggaggagctagatgaggataagaatggcgcgcacagtgtggactgtggagatgcggtgtcgatatcgtacacaaaaaaaagtcatttggaggcgtgtggaggcctcacgcccgctctggaccagattgccctctttctctccaccacaattatcttcttctcttcttttttttttcaccttttacatatctgtcttcgtcagtattcatgtgttgcacagagccacatatacacggtaccctcttccttgcattgcaaccatatgtttacttggctcctatagtgacaaaaccatcttttctccttttaacagcgcatttgtctattgagaaaattgattcatcgagactcctgcttacttctactcttctagaacgagctaacgtttttcatttgaagaaaaaagaaaacggacaaaagttcttctgcgctcgttggaagcgagttcgttagtgggcctaggcccaaatacaaaatccaatccaatcccatccatccatcgccttcgccttcgtcgggcagagagggaggcaagccatggccaccgccgccgccgccggggatggggacgagcacctcctctccctcttcgcctccgccctctcccaccgcaggtaatcacacaccctt

SEQ ID NO: 64389 - DNA, 703 bp, Oryza sativa
acttctactattagggtaaatattgttatggccaatatttttttaaccattacaaactattttcatgccattgaaaatctataatatttatgccaattgaaatttacaggggggataagatcagattaacattgtgggggcaattggctcgattttttagcgaagatgtaattggcaaccaaacagttgtcattgttacatcaacaacagtgcaagaatatataggtaataacacaaactatggaaatcagattgttctttttatttatataatataaactaactaataaccatgattatataggtttatctctaaggtcaagcagtgccacgagaatatatacaaatctacacatacgtgagacatggacacttattgacaggtatatgttattttaatactgatttttagtaacataatacaaatccttctttgattcaaatatttatgcctcatagacaattctccgaagaaacaataccaaaaatgatggaagtagataagagcacacaaggaacaagggaggagcaaatgttctacaacagaaaaacactcaaggatataacagaaatgcggcatggcaacccaggaagtcaggtaattcctacataaattttatcttaatatacttggcaattatatatatccttaaaaaatttcataaattgcaggaatttgtgtttacatcaaaagttacgattg

SEQ ID NO: 64390 - DNA, 5818 bp, Oryza sativa
gtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaggacatttgtgcctgattatatgcttgagaagcaatacctcattaataaggctgaagaggtaaagcaggctactactgattttttacaacacaaaatcttgaaaattttatttctgaaatgtttccacattatgattttacaggagttaatggacgacgatgtggataacatactaaaacaagatagagagacagatcaacaggtatttgaacatataatacaaatattcatttatttataatatatagcacatatgacaaatactttattgcctttgaaggaacaaaccagcaggggccctcttattaaaaaacagatccatctcactgctacccgtgaagcaagagctagaggatagtgaccaggaaatcatgagtgaagatgaactcacttcgtcggacaaacctcccagttgcaaacaaataagacggaggacatacataatagaagacgattcagaagaggagagcaacgaaacaagtatgataaaatgtgtagatgcaaaagttcgaggcaaaatgcaaaaggcgctcatgcaaaacccacaaaggcagaaatcagaaatgacaactacagccatgaaataaacaaatcagttgttcaagaatccatcaaggcaggaaaaagacaggcgaaaaccatcaatggcataggcaaggaaagctctgttgagaaacgtaagaaaacatgtgttcaaccagacaatatagcatgcaacacaaggcctcagagaacaaggaaaatgaattctaagtatacagatagtgcttagagctcatgagaatagttcataattagcagtacctcggtagaatatcctgcagttaatgatactagctagaaagaatagctcatagtcaatacagatcattacatgtactatattataatagctgaatattgtatgtgaataaactgagatatattactatgcgatctgttattttatttatgattttttatcacctctatatatacagacctaattttgcaaccgattgcacatgaagcatccaaacatataattcatgcaaatgattagaaaagaaaaatagcgtcaaccaacctttgcctgcctgccaattcccccaggctcgccaccctggccgatccgtgacccaaccaccgcaccacctccaccttacattttgctggatgctgaaatgagacccaaaatagcagattttgttatggccaaattttttggtgaaaaccagctaaaggcgaatactaaaagagttgtggcaacatagtgagtattcgtttgaaaacctgaccttaattttcatataaaagtatttgattagcatttaacaattttcccatcatatacctcgagcagtcggcgcaaaagctctccaccgacgaagctcgccgcccgttggatctagcagcagcatgtggagttggggcaagtgggtgtcggagatctgagagctgcgcaagaactcgcgcatctggctctgcacgtttgccaccgccgtgccatcaagggccgcgccacccccgtcctcttcaactaaccggagatcgcgcacgtgcttccccgctcggcttcggcagcccccaacgacgtgagagccacacggcgctcgcgacggcgatggacgaccccgatccggcggcggtcgcggcagcgcctcgccaaaaagcgactggactcgatagagatagccggatccggcggctacgacatcgccgaccatgccgaagaaaggagcagcggtgaggaggggaatatggaccccatgctgagagagaagtttccctcaggttccacctctccctttcagttacttctcctcatcggatttgacctcacctgatcagatctggccattgaaggaggtgagaagggtgataagaggcagcacaggaagaaacgagagaagaggagaggagaagaaactagagactggctgtgaggattgggatgggcatgggcggctgaaacgagaaaaatcaacatatgtatctaccgtcccctccactttctctttctttttctttttctatttgttgagatgaaatttttgggttgtagcacaaaatttaaatcaataccttcaaagatacatatgttgattaatatataaagatttgtcttactaagtacgataaacaaaagtaagaaattatatattatttatttattatatatattataatttaaaaacatagtcaaatatatattttgaagatcgtgtcattatccaaaacatcaaagatgtgtactacatccaacatattattttcttcacacatgcaaaacaaagcaatttattagcatatagctaattaagtattagttagaaaaacttaaaaaatagatttatattattataaaaataattttacttttaagtaccctgacatgtgaaattagttgaaattaataatttaattctatacagcatttatatatagatggagttaagatatctgtaacactgattttaacggcgttgtcttatctcacacgcaaacatttaatacttttttttcatccacatttaatgctccatgcatgtgtccaaacatttgatgtgacggaagttttagaagtttgaagggaactcaacactgtctgaaatagaagtcataaaatgtaaaaaaaacgtgatacatcgaataatcaaataaaggggtgactaacgaataagagttagcgactgaaatcgcttttaaaacctataaaattgttcggccttttgaagtcccaaaataatgagacagctatttaacaaaatataagaaaactcatatgtaaaagaagataattttatatggacgctagccgcgcaattgcgcgggtcaccctgctagtttgtgtataagttttcgaagttctatatcttgaacattatatagagtggatttcgcaatattttacatatgtaagtttacatatattatttttactttgcattaattctaagcagaatgttgacatcatccataatgataaaaattagcaaatctgcctaacaagcagaatgttgggcataagaacaaagagcattaactagctgtgtcttcacctagaagcaatgtgacaaaaaccaatgcaacgttttcaatgaatagaactaaagggaagaactggtcgtgcactgaacaaattaaaccagacacttagttgaactgaaattaccggtccatagataggcggcgcataaaacctcagagagatgattaatttatgagttgcatgaagatcgaagtcagagatgtacagggaaaatacgaagataaaatagaagcaaactaaaatatattgcattgtcaaatagtcaatccaatatggcataatgaagtacattaggtcatactttataaatccgtaatttacggatgctagggttttggcggcgcccaggcgactggggcgcggcggccatcttctcctttgggagggttctttggatggagttcgtctttgttccaccggcaaagtttggtcctgtgacgtttgattctactgttcgcatctctggagatcatggaaatctctctggtggtcttcagcagtttgagaatcctctctcatctggtggggtgagacctgtcccactatggaagcggtccacgttcttaggtatttctctgttggctatcaagttctgggatgttcatgagacaatcggttccggcaggtttggtcatctacgtaacttcgtctcagttttgtcctttggaaagacgtatgtgtatgaatccaatctagactctggctcctcctataaaaacacacatgtggtttccacaacgatacgtcctttgcaaactctggagattctcctgtcaggttttgatctaggtcctgggcagtgttctctcaatatccatctcatggtgaaatctctcagtgggggcgacaaagggaccatcaatgcgatggttacccgcccgaagctgaaggatgacgccgtattggatctagggaacaaagaggtagaggattccagggctctggtgaaagctgggcaggatctggtggcggcacccccggcagatgatcaagcggtggatgtggtattgcaatctagttcaggcgtcaacttgggtcctgaagcacatatggagggtgcagttttggaggaagaagaagatgcaattgaagtggaacttgacaaggaggaagtcaagcgtgcaggacaatggactatcctagcgagattctagttgctcaaattccccaaccaggtggccttatttgaggacatgggtagagcttggcgactcagagcggagatgagttacaaatctctaaaggacaatcttttcatcgtcacctttaatgctgagggagaccataagtttgttctgcaaggcggcccatggattcacagaggagatgctctgattgtagctgatttcaatggccttttgagtccatcgatggtccccttggagtcagtgccaatttgggtaaggatatatgatctgcccttagtaatgatgaacaaagctagaggtgagctgtatgggagtaaactcggcaaggtcagggaagaggatgtgcagcaagatggcagcaacaagcatgatttcttccgcattcgtgttgatctcccggttaatcgtcccctgaaaagacagattgcaatcaaaatcaagatcaaaggtgttgaggaaatcagaaggttcaatcttcgttatgagagggtgccgcacttctgcttcttttgtggtttcattggtcactcagataaagagtgcgagaaaagattagccaatgaggctcaaccactcatgttctctgctgatctacgctgctctcttcttaaagctttcgaacggaaaatcagcaaggttaaggcaaatcagagtgccggggttcagaggaagcttgtgttcagaggcgcaggtaggctagctcttcttcagcggggaataaacagggagactacttctacactgacccaccaaccagaatcaatgcctacgatggttttgattcaagagaagaggaaggggatgagttagttgatgctcaacttgctgaaaaggtggctcgctgcatatgtctgacagtactttgtcccgtaagaaccaaacaaataagttttcagctggggatgagttagcatcacttccatcattcgagatgatcccggccattaggaacctgggcactcaacaggagtctactgaggacgtgtccaatgaggctactatcagcccaatcaagaggaaagggtctgataatgctcaactgaagataatgggcaaagtgcaacaggctctgttggagtttgatcagagtgaatctcagggaggatcggggcaggggaagacaggggcccctgctcgagcctcgaagcgtttcaaaaaggatgagaaggctgagaacacagcggtggatatggaagcaaccagtctcggggctactggtaaactggcgagacctatggctgggtctcgccaggagcaatgatttgtttagcctgaaactgtcgtggtatgggcaacactgcgacagttcgtgatatgtgctccttagttaaggaagccgatgcccgtttgctctcctgtgtgaaactaggcaaaaggtggaaaaagtgtgtcgtgtgcgtagaagattgggtcttaaaggttttgtgggtgtcagtagtgatgggatgagtggtggtttagcgttgttttggcatgaatctgtttccgtcgat

SEQ ID NO: 64391 - DNA, 810 bp, Oryza sativa
tttgaatgcacacatatgtatgttcaagatacagtgttcatatctgcagaaatgtgagggttacaagcgaatccttaacaggttgatattagagcatcttgattatatcataaccaagccaatcatgagcaagtccttggtaataagacttcaactcaatacaccctctgtttcatattacaagatatttttattttttatatcattttttaagtttgattaaatttatagaaaaatataacaatatcttttacaccaaacaaacatactattaaaatatattcagtgttagattaatagaactaatttgatccggtaagagtgactacatttttctatataagcttgatcaatcttatataagtttgacatataaaaaagtctaaaaaaagtcaaaatattttataatataaaccggggaaggatatcattacaaacaaaaccagcaaattaagcaccagctggaaattattcttttatgaagaaagagacaacctttggtttgtctgtgttggttccttgatgacatgaggcacccgactcttgttttatgatcgtccaactcatattctgtgatgcataggtattttaacaacattggacctggcaaattagtattagtgaagttcatgtaaggacatgccactgtccgatatacggtactccatatacctagctctgaaaggacacatgtcctgtgtagagaacttaggaatctaataggtgagatctgagacttccaatatcattagctctcctgcacacttaattgagtttggggtggttttttgaacgactagtttggggtgg

SEQ ID NO: 64392 - DNA, 1898 bp, Oryza sativa
ttggtcccttgatgacacgaggcactcaactcttgttttgtaggatcgatcaaccaactcatattctgatgcgtaggtattttacaacattggatttgacaaattagtactccaggtatgatattggatttggagaattagtgaagtccaggtatgatataaacctagctcagaaagggcacatgtcccgtgtagagaacttaggaatctagtaggtgagatcaggacttccaatatcattagctctcctctcctgctacttaattgagtttggggtggtttgaggtgcttagttcgtgtacatactatctggatcctactgtactagagaccttgtgaagccaaattaatgtgtcccacatcattgacccttaccaagcaaacagccatatctccgaaagcaaaaggcttgtctgaaacttgtgcatgcatgggagctgaactgatggttcatgaagccaacaggtgtttcagaaagccaatcagtttctgtcttgctaatacagtcatttgatcagaaatggagagatgaggtaggctaatgtgaccgaattgttcttcttcattttccctctttccggaaattacagaagagaagataacaagctagggcagatgccctgatgaaatacaacatcatatcatatcaatcgatcgaagcacaaagatttactagaaagcatctactacgtacaattatgtccacatggactctttcttgaggaatgcctcatgcagcatcagctggtgatgagcagcagcattctccaggatgcactgctggtggtggtggtcatcttgatcttggtgctgctgctgcagctggagttgcagggcggcggtctcggcgtgggcgagggcgagctgcatctggagctgggagacttggttctggaggaaggagatggcggcgacgcagccgtagacggggtccctcatacgggcgttggcctcgtagacgaggctgctgacggcgtcgggcctctgcggcggcggcacatcgagcagcatcttgctgacgttgctggcgccgaacacccggtgcaccatggcgaaccgctgcgcctcctccgccgggaagtagggcgcgaacacgcactccgacgtgcaccgccgccgcagcagcttgcacgacgcgcacggtgtcccgctcccgcttcccgccattgcttgcagttgcaacttgcaagtgcaggcctctactgtactgggcagcaaacagttgatgcagaggagcaggcttcaggggggagggtgcacgggagcagagcttctccctttatagctcaacaacagcaacaactaagctaagtcacgacaaacataattaacactactaaacaactaagcatatgaggagtattaagtatagtgatccctcataacatgctaatcatgatgtcctgctggaggcatggatcacatccacccatatcattgattactcatgtataaatatgtacagtaatgggttctctgacttgttttgtctctacttggcagcaaataggattaagccatcaaaagtctacatacgagctaagccttcatccttctctgcagtgtgaattgcagacatcgatcacttcaaagttcaaagcaagctcaaattaccaccaccgaaaaccactttttttttgtttcactaatcaaatcaaccaaccacatgcaccgttaacattcctcccccgcgatcgacaaaaatgagttggatcctaactagctacgactacgacgacagctggtgatcaagttactactcctatgcactagtatatcttatataaataaatgtggactctagtgcagtttgaatgacctttggtatactggactgttaatgttagttcctacgcacgttctcagagttgaccttgagatgtaacgcttgcatttta

SEQ ID NO: 64393 - DNA, 1006 bp, Oryza sativa
attagctgaaattcggaattaaaaataagcatattgaaagaagaatccatataagaacccaatacaagattaatcaaaattcgaaacaaaaataaaataaaatctaaaattagaaaaggaaatgagagtacaagtaggaatataatttaaaaatagctgaaattcggaattaaaaataaggaatattaaaagaagagtccatataagaactcaatacgagattaagtaaaattcggaataaaaataaataaatccgaaattagcaaaagaaaataaaagaagagttcaggtaggaatacaatttaaaattagctgaaattcggaattaaaaataagcatattgaaagaagaatccatataagaacccaatacgatattaattaaaatttagaataaaaaataaaataatatccaaagttagaaaaattaaaagagagttaaagtaggaatacaattttaaaacaactgaaattgaaaataaaaaataaaaacattaaaagaacacaatacggtattaaataaatttttaaaaaaaattctaaaattagaaaaaaagaaaaataagatttcacttaggaatacaatttataaataactaaaatttttgataaaaataaagattattaaaataaaagaccatctaaaacacatgacgagataaattaagtaacaggcctataaaggagtagagtggtggcggttgatacggcatataaaaattattaataaaacaccaaatagaatcctaatgacgattaaaaggagggacgtcaggcaggtcgtgaaacaaacgagtaaggcggttgccgggacatctagaaagtaaaaaaaaactgcattgataatcatattcgatttttaaaatctcaatggcaataaaaaggagaagtagcgtgcggggtgtataagagtatagttgcagagctaacatcgtttgatgggacttctaaaaattataaaaaacgaaactataagtccaatttttaaaggttcggaacttctaaaa

SEQ ID NO: 64394 - DNA, 1264 bp, Oryza sativa
aaaaaaaatcattttatgtatgtccagtaaaaaatggtttccacgatctgtataattgccacttttgaagctccagaaacagttgctgagttacctagtcatgattttgttctaaagtgtgttaactttacactttgcaatccatgcactttggtgatatgaccttcagttaagcattggtcggcactttctgctaatctgaaaagctaatgccagcacgcggctatgcattgtccaggatatacataacatattcagaaacacacacacacagagtagatcagcaaggaaggcattgtggtatttgtaattgatattctgatagagtgattcagttctgttgcaaataataatatttgcctatataataagcttcaaaaacaacatagacgaataatgtctaccacttactaatactactaccactaagctttcaaataaatcaaacaattcataaatgaaatataagagtatctctgtttctactctctggctgctctgtttctgaaatgtctagataggccgcttctcagtctccgcacaagttaaaattttacattactgcagacttccaactagcaacaacatatgtgcctgcctgacatagacaaaaaaaaaagattaattggatccatgccactgcaactttgcaaaatttttaaaaaatgctactactatttgtcatattggctatgtgccactggaaatttctaaaattgaaaccataccactgaaaatttctaaaattgaaaccatgccactcccatccctttttccgtctcctctctcacgccgtctccgttcccgtcctcatcccccttccgcgaggaggcggaggccgccctgcactcttgtccatcagtgccggtgataacgatggcgacgacggcgatgcaacggagcgccacccagtagcccgagtagtacggcgagctcggagaagaagatggtgggcagaggagggagaggagggagcgggtcgacggcgccgagtgaggctaacgtaccttacccgcgactaccaccggagggctcgggagccaccgccaccgtcctcaacgccagctgcagtgagaggtctatggagctgtcgctaccgccgtcctcgacaccatccacacgggagggctcgggagtcatccacattggagggctcgggagccgccgccgccgtactcgacgccatctacgacgggagggctcgagagccgccgtcgccgcctctgtcctcgatccatgatgggaggtctcaaggagctaccgc

SEQ ID NO: 64395 - DNA, 1210 bp, Oryza sativa
ccaccgcgccgccgtctccacgccaccacgccatcgcttaaagccgccgcgccgccgccacgaagccgccgcgccgcgccttgcgccaacaccgccaccgtcgctgtcgccgccgttgccgtcgccgtcgtcggtaagccgccgcccaacctttcccccccccctcgcgtccatcgtcgccgccgcccgggagagcaagagccgagagagagagatagagccgggagagggagaggaaaagagtgccgagagggagaggaagaaaagaaaaagagaggaagagaaaaaaaaagaaaggaaagaaaagaaaaggaaaagagagaaaaagagaaaaagaaaagaaagagaaaagagaaaaaggaaaaatttaagagatttagaatatttaacatattagaaattaattataggattaatgagaatatcgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaagcaattaacgatagaaaattcggattttattactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcgcagatagtaaaattaataaaaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacgtcctacttgtgattataccatgccttgattattgttcacctttaaatctttgtagccatagata

SEQ ID NO: 64396 - DNA, 2882 bp, Oryza sativa
aggctcatgtgttgggcagtcgcggagtgcgggtaaagtgtacatccactgcagtgtgagtaaaccaaatctattcgaatagtcgtgctcgcggttattgagcaccgggacatgtattacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgattacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattctgctgccttatctatttctgcttttggatgtattccggacctctcggtccgatgatttaagactatgcctgcgggcctatgatgtaataattcgtattagatactcgtgtatgtgcacttgatattccagctatgaatttgtgtgtaccaaactacttgatccagggaaatggtactgtttacacgattgattcctgttataaaaacgggggtccacagatgccctattatattgcacaaaatttccccttcttcctcttgccccctctggctatggcgcactcccgctacgctgctccagattaggagccagcctagggcgtcatagacagccggagcggaagagaattggcaaaattatctaaaccgttatattagcctgatgtacatcatcccggtgcttcttcttcttcttcttcttcttcttcttcttcttcttcttcttcttcttctttaaatccatgcgtagacaaccaaatttacagaaactcaataatggctagtgctatccatcacccaatctacttactgcttctacaaatttaactcgctgattataataataatttttatatagttattcagtgttcttacatgtcgctgtctgattgttgtatcagctccattgaagccgatgatgctgtctgatccgaccacggattgccggcccaactggtctggttgcatcgtccactcaggttcttccatgttgcagatcttctcactcaagctggtctccatcactgcccctgctattggtgatgaccccattcaggtgtatggcttcatggctgttcgagatcatatggattgcttgcgcaactatgtcttcaaccgcgggcgcgacaaaccttttgtcgtcagcctctccgatccctttatactcctgtctggccctaagagaggcattgggatggaaactcctgcactgcttgagtacgatataaggatcaagagaggagatggagaagatgatgatctccagctcatagatagagctgccactatcagtgagaccgagctacccctgcatatgcccaagcttacacccgatggattgccggcgactacggtgccatgaacattagcttagcacttctccacaacgccatagaggccacgatgcacatccaaataaccgaagtgcgtggcagcggtggcttcgacatgtctatggcttgtcgtgtcggtcaaatacccaatgaaatcaagctctttgaaagtgttgccattgccaagctgtgtcagctaaacaagaggtttgtgcttgccattgtcaagcgcggcatcttggtgttagacttgaaggttaagcggagtggcgccttagaggaggaggagccagtccgtatgctccgtggcttgaagggaaaagcacatggccaagtcatcctacctatgatatttgattgcgccaccattttggttagtgtgcattggtcaaatctgccggcccccatgttagactagccacaaggttcttttttttacttgttagcttctttatatatatagcttatgcaaattcttttttatttacttgtgtatgtttgctagtcatctatctgtaacttgcaagttagtatgcaaatgatttggtttaaaaatgccttatccaggagtgtattactgaatctggtaattttgatcagtaaccttaaaaaaaagaagtgattaagtgttggaatgttagtaatatgaatggttgtttcaggtaccctttattcatgccggtgtcagcaaataacaatatactaaaacactgtgcaaaattgaatggtggtgcgggaaaaaaaaatactacctccatttttttaatagatgatgctgttgacgttttgtcacacgtttaaacattcatcttattcaaaaaatttacgtaattataatttattttgttgtgaattgttttatcactcaaagtactttaaacatgatttatatcttatacatttacataaaattttcacattagtgaaatctttcttctgcaggtgttacagactgctgttcgccacagattagcaaaagtccaggggtatctaaaagcaaaggaacgcagcagtagaggaaatttgatggggaagcgtgttgatttctcagctcgtactgtcatcacaccggattcaaatattataatgaattggtagtgccatggagtattgctttgaaccttacatacccagaaactgttactccatataacttccaaggtaaaatgctttactgttattgaagcatgatcactgttttttaatgatcactta

SEQ ID NO: 64397 - DNA, 5110 bp, Oryza sativa
  unsure (1)..(5110): unsure at all n locations
taaatcaaagaattcataaatgaaatataggagtatctctgcttctactctctagcttgctctgtttctagtctctagctgactgacaagttcatttccttcgatttcatcttcaaattctgctcaagagcccagctgctgcatactactcattgcctgcagaagcagcagccacatgccctgcgccaccttcttcgctcggcccggcgccgccctccggccccggcctgatctgctcgagctgccggagcacctcccgggcatcaggtctcaccgacggcgactggtccacgcagtgcagcgccagcttcagcgtgtccacgagctcgtcgcccgcgggcccattgtcgccgtcgcgcatgagctcgaggtcgaacacctcgctggtccactcctccttgacaatggacgccacccactgcggcaggtccatgccattggtggtctcggcgggggatttgccggtgaggagctcgaggatgatgacgccgaggctgtagacgtcggtcttggcactggccttctttagcttggacagctcgggggcgcggtagccgagggcgccggcggcggcgaggacgttggagttggcggcagtggtcatgaggcgggagaggccgaagtcggcgatcttggggttggagtggtcgtcgaggaggacattgctggcggtgaggttgccgtggacgatggtcatgtcgtcgtggaggaaagccaggccacgggctgtgcccttggcgatcgtcatccgcgtctcccagctgatcggagtgttgggcgcgcgagctgcacattcacgttatgccatcaggacgaaatgttagtgtcaccgtgtcagagttatgcagattttcagttcatcaggatgaaatttcagagccagaaagctgaataatgttgataaaacagtgctactaaaacaaaagcatgtcatttagatcaacaattgttcacatattagcctcaaaactacataatatgtcaacttttttaattgaacatgacactctattactaaactttttgcactgaccatgaagacatatagccactgtccaaaattttcagaagacatgtaatgctcaatctctaaattggcatgggatgttcattcttatgctaaataaaaaaggtactcagcactgtaaaaaaaattcagatgtatcaaatctacttgattacagagctgaatcaatgttagcagttagcactgccagaatttgcaaatgttcagactacaacattttctcaaatgttcagagtagtttcagttgaaagcagaagtaaaagctgaagaatgcatacagtttatcaattgcattgtcttcctaattaataggatgaagatcaaatgcataagataagaagagtagcattgacagagtattgaccgtggaggaactgggagaggctgccgttgggcatgaagtcgaggacgaggagcttctcgcccttgggtccgaggtagtaggccctgagcggcagcaggttggggtggcggatcttgcccagcaccgccgcctcggactcgaaatccttgtgtcccttggtgatcttctccctcagccgcttcaccgccacaaggctgccgtcctccagcgtcgccttgtacaccgtcccgtacgtgctcttccccattatctccgccgtcgcacacagcaggtcgtccgccgtgaacgccatcggcccgtcgaagtgcaccagcttccctcccacctctcccccggactccacctccgccgcccccgaccccggcttctcccctcgcccgccccccgccgcggctccggcgccaccaccggctgccttgctgctcgtcgtctgcttcccgccgcttccggacctcttcttcgtcaagaaacagagcagcatgcagcagagcgccaggaagagcaggatgccgaccacgattccggcgatgattagcgcgagctccttggtcgtgaacttccggtggcgccccgtcgcctcccgtgactgcgcgggtgatgccggcgcagatggtgatggagacggcgacgtagggcagggcacggaagcagagtagccgcagagctggatgttgccggcgaaggcggaaggcccgaatttctgcgcgagcgaggctggcactgcgccggagaggttgttgttggagacgttgaatgcttggaggctagtagtgaggttggacaggctggccgggatctcgccggtgagggcgttgccggagaggtcgagcgtcttgaggtcggcgagcgagccgagcttgttggggatggtgccgttgagcctgttgccagcgaggtccaccacctgcagcttctggagcccggagagcgactccggtatcgggccatcgagcgagttgtgcgagagctcgaggacggcgaggttgtaggtcccggtaatggattccttgagcgaggaggaggagggcgccttggagccggcgaaggtgtctgggatgtggccggacagcttgttgtgcgagagggagaggaagacgagcgagggcgaggcggcgagctcgggtgggatgtcgccggagatggtgttgtggctgaggttgaggcgcatgagcttggtggagttggcgagtgaggacggaatggcgccggtgaggaggttggtgctggcgtcgaacgcctggagcgcgacgcagttgccaatggaggccgggacggcgccggagaagcggttgttgaagaggtagacgccgcggaggtcggggaggaagccgagggaggttgggatggggccggagatggcgttgtcgtggaggctgaggcggcggagctgggtgagctggccgatgcgctcggagagggtgccggcgaggccgcgccatgggagggtgatggcgacgaccttgccctggacgcacttgatgccgacccatgcgccggagcaggcgccgaggccggtgtcgttccaggagcggaggaaggcgtaggggtcggagaggtcgtgcttgatggcctgtaggccctggtagtcggcctggctgatgacgacgccgtcgcccgcggcgtggacgtggtggtggtgcnccncggcggcggcggcgagcgaggggaggagtgtgacagtgaggaggagaaaaagtgtgcagcgatggtgggcggggaatggtccgagcatgagcatggctggttgtttggcggcaggagcaggtggtgttcgcctccgtggtccttgatttggttgatggaggagtagagtagagtagatgagtagcggaaggaatttgtgagttggtgatcgaggaggaagaagatgaagctggagcgcgcgcgcgcgtctgtgggctgtggccagagcagagagaggaggagattagcagaggagaggcgcaacggctagtaggagtgcacgggagagtactgaccactacgaatgctgtcatgtggcgacggcgatggcccccactaccaactaacggctacttcttttttttttcttttgtcgtcgttttttaaggaggagattttgttgtgtttaataatgttggggagagaagccaaagcaacgggtgggatggactgtggacccgtcctttagttggaccaggtatttcttttgctttgggcctggcctactattccgatcttgtccagcttgttggatttacagaacataaatagtccaggggcttctgccccaccaaattactactacctccatccgtgcctaacgtttgaccgtccttcttatttgaaaaatttgtgaaaaatttgaaaatatttagttacacataaagtactattcatgttttatcatctaatagcaataaaaatactaagcataaaaaattttcaaataagacgaacggtcaaacgttgaacgtgaatagtgcaaaactacacttattttgggacggagggagtaactttcagatgttcacgacataaacccacctggacgatttgccatgtaacattaaggtattatggacataaaccaacctcgagtaataaacagcattggacactattcattatgtgttcgtgtcactataaactttttgagtgtcaccctattttttttaattagagtacaagaacacacgcaaacctacctctttgaattacacagtacaatgcagatacacacacgcaaaccctatctctatgagcatcttccaacctctatgagcatcttccaagactgggccaaatccttaagattgacgaagtccattaaatcctagaaaattcgcttacatggggagtcgaactcaggacctaaggtgctactgaggtcttgcaaccaataggttacaggtcctttcgcggtaattccaaaaatagcaatgccaaatttcgataaagttcatttaggcagtaataatgtaaacaggcctgaatataagctgaatagatttcgtctagtatgcaacgaggtagagggaggcagagctaagcgtggcatgaagcgagggaagacgtgggttcgcaatctgagccatccgaaaaatgaccaatggattacaagatttcaggcaatccccttgtgtaatgcatttgccaacagacttgggctaaagatgtatccaaaccaaggtctcattagttcccttgagcgctctctctcccccatcgtcaacaccaattcctgatcccaccaagttgaacatgacaaattcctaatcctaaataaacgtttactgccagcaagagccctcggccgtttaggttgacataacaaacactgacaagaagcagacaaacgaaatctctcatccttgtataatgttcaaatgaagatgtacaatatcagatccaacattatttgattaacctagattcatgtatatcatctttacagaatgagatggcttatgaatcatccatcaaaccaaaacaaatttgtgaattttataacagaaccggcacgattgatgagacggatcacatcaatatcaggatcaataacagaattcttctttttgctctcaagtttctcatacatcaaatgcaaaaggaaacaaaactagatcatcgacaaaatcatatatgcatcttatagcagtatcattctcccctaatttttttttgttctacatcgatcaccatacgaataaatgatagtgtttgtctcataggtataatataaaaagaatttatga

SEQ ID NO: 64398 - DNA, 1471 bp, Oryza sativa
catggcggtgctggatctgcgcgatggagagagaggtcagaggaggaaggagagatctgctaccaatgaaatggcgcgtggattattgatttctcaacgaaggttaggagagacgccaccgacgctaaatacctaatacgcgaacgttcgcgttaactctaattcgcgatcagctcggacaggttgatatgcaaagactgagaaggctaacgcgtacgtacagctggagcctcgaatgcatgcagtggctttccttgtatagctaaacgtaattagtttttatttttttaatcaccgatttttaggactaatcaagtatgtgatttttgttgttgtttgctgcacaatgcacgcataagactatgaagatttatgggaattcttaatgtgtacccagtctactactttatatttagcctagttttggctcaaattgaaatttaatagtttttattttttgaatttattttaatttcattttgaaattcatctgtgtataaattttgtatatcgaaagtttttatatatagagtttccatgtgaaaagtatatatataaagtttccatatcaaaagtttgtacgtataaagtttaaatttgtgtttagagtttgtgagtacatgctaattaatggcggtatgcatggttgcatgctactccagttctgatctctagccgcaagatgcgtgcatgcagttgcttgcaaattctgcagataattaagcacgtaagcatagagttagagacataaggtaatgatactaaacgataaagtgaatttgtgatctgatctgtgatcgcggcccgcgaaagttcgcgtattagccccaccccctctgatttctcacaaattttgacaatttgatcctttgtaaaaaactaattttacaaataaaccgcggccaaaacttatttcagaaatgaccttttgttcagcaccaaatcgtatggcgctgaatttagacaccttagcgccacatcaattgatgctgagggccgtgccaccatggatgagaggctgagtcggcgtgccaacatgcattcaacgccatgctatttagcgctgaggtgtttaattcagcaccatacgattttgcgctgaacaaaagagtcatttttaaataagttttggtcacagtttttttgtaaaattagtttttgcaaagagtcaaattgtcaaaatttgtggattcttgtgttgagattgtttattattcatagatataaaatgcaacggactgaatttccagagctcccaaagtatgtgcagtccacacaatcagggtgtgtgaattttgcatatgcctagttaggtgaaatggcaatgcatcaagagaaaatatggagcagagattggctactctacctgttgaggagcacaacaaaagagaggtcataataaattaggcagcaaggcaccctacttgggccaaacacaacaccaaaaactagacaccagcaaagtttcatg

SEQ ID NO: 64399 - DNA, 862 bp, Oryza sativa
gatcaggggcgccgttgcatgcacatcgacgccgggaccaaaaaagtatacattatcatcgctgactcagatgttctgaaagttgctaagaatgtacacatgtaaaataagtagtatgatcatttctttgcttagtggacaaagattaccttatatatatatctcgttaatgcatgtttgataaggaaaagatttctttgctgaatgctccccatcaacttttcgtggcctaagttgcatgtgaatctcatcatttttacaattgatacacggaataatctttttggtacatgtttggtgcgatacagtggtggacttatagatggagaggtgtcggtcaccagaaaccagcactctagctacctcagatcaccttttaattttccatgtttgcttttcgttagctaaacgaggcacagtatatatgaacatgataattaaacagcaagggaggctctactgtagataatttctcaaattcagggcacagtacatgctgcagagggaccaacattcacatgcagagccatttcagtttcagtacgagctaaaaaggctaacctgctctcatgctttgccatgaataatgatggagttgttgcatgtgctgagatgatgaatgtttcagatgaatatataagtttcaccaccacattccaaacaaacacacaaccattccaattctattaattctaacccatttatcatctcagatgaatatataagctcctccattggaggttagcccaagggtcagtgttgcttgagaggtactcactctgtgcaggtgccagtggactcagggcatttagctagccagccaaagccaattgccatgtggagtgctctcttctcccatctg

SEQ ID NO: 64400 - DNA, 770 bp, Oryza sativa
agaaccaattcagatagaagattataggagtgcaaccacagactacggcatgatggacaaggcgaaggagatctttggaacattggaaccaaagggcatacatgttcagatactgaacatcacccagctttctgagtaccgcaaggacgcccatccaacgatattcaggagacagtacgttcctctgacgaaagagcagattgcaaacccgagcatctacgcagactgcacgcattggtgcctccctggagttcctgatgtctggaacgagttcttgtatgcgtacctcatgcacaaatgatatatgtataataatgtaaccttaatttggccaaatttcttctttgttaacttgtgggtgtctaagtaggtataagtgcacagtacttggcccccatcaattttttctgtttttgacatttacatcattacatgtaaagagaaagggaagaacataatcgcagaaatgaaaaggaagaagataagttgatttgcctatactgagagttactgctacttatcgatggttgtgcagcataaaaagatttttttgtgaataagtaggagtacattctacataaagcaactgctgtaaagataagaaatcaattgccaaactgctcatgtcatgaagctcaccagggagcagataccaaattaagatataccacctccgtttcacaatgtaagtcgttctagcatatgtgagaaatgctagaacgacttacattgtgaaacggatgaagtataacttttcgtgcttctgtgga

SEQ ID NO: 64401 - DNA, 3279 bp, Oryza sativa
gtgaaacggatgaagtataacttttcgtgcttctgtggatcgtttggttcctccaaacggtcaccctttgccgataggaataagttcactttgtgactctcaaaagtgatcgaaatctaatccgtaaccctaaaccacaaaaccggatatctcgacccctcaactcttaaaaccggtacaatttgactccctcggtggttttgaagggcggtttcgctgatgtggcgtctacgtggcatcccaatcatcaaataaattaaaaataaagcggggcccacctgtcagtgagtcctctcctacattctctctttcttcattgccggcagcggcgggaggacagggtgagcagcggcggctggcggcatcggggcgcagcgcggtcggcggctaggacggcggcggctctgctgcggaggctcacgatagtgggaggacgaggggaacagcggcggcggtggctcgcggcagtgggaggacgaggggaacggcggcggcggcccaagatgctgctcgtcgtcctcgccctcgcggttaccggcgcggtctccgacggctcgcgagtcgctggaccacatctccatcaactgcatcggcgtcgggggacatgtccggctgccgctccgtccactcgcgccgttcagcaccgacgagggcggcgaggctcctcgtccccgctcagccgcggctcttcttggatagtcccgactggaggcattcggcggctgggagggagtgggaatgggagcgggacgatgacgacgacataagaggaagctggctcgcgtcgggatcttggtggttcgtcggcgatgatgccgcgtgcgctgatggatattttgtaatcttgagctttttaatttctgttttgcatgcacgtagtggctggctcaagtgtaacgaactgctgatggaaatgaataaatagagaagaaaacagaaaagctgcggtgactggtgagacttaagcagcacaaaaaccactctgttcagaactctgttcttcggtttttcagtttactgttcacaatcttacaatcttcagagtttcagagattcagtgaggttgagcgtgtgagctgtgagcgaattgcaagtttcctgacatgcgctgactccctctccgccggcaaccacgtggaggaagtcgaccggcggggtggtttcggggaggagtggttcttggtcgccgtagaacttcgtctctgctacgttgcagagctcggagaaggcgtccgccgtgtggtccgcctccgcgtcgtggcctttgctcggggagcggccgtgggtgaaggcgacggcgacgacgtagacgacgtagagggaggtgaaggcgagggcgccccagattgtcacctcgccggcggcgaggacgacggccacagcgacgagggagacgaggaggaaagacgcgtcgcggtagaagttcaccctgtcaatggcgaccccgcgcgcgccgaggtggacgccgatgatgccgagcacggcggaggacacgagcatcgcgctccccagcacgccgttgagccacacggcggtggcctccccctctcccccgccggaggcgaacgacgcgatggtggagagcgcgtccggcggcctttcccgagcgacaggagcgtcacgccggcgatcgccggggagaggcggagcagccacgagaggccctcgaggctggagcagaagtacactgccgccgtgtcgccgagcaggtagaacagcacgacgagccacgccgccatcacgccgtagcaaagaacccgccgctcctcaccgaacacgcagtcgaacaggtacaggtagtcgacgtagccacgcgggaatcgccggcgatcaaggccatcctcctcggcgacgtgctcgcacctctcctcatagctctcaacctggaatacgccgccgccatcgcgacgcccccggatcccgccctccttggacgacgataccacctccggcagcgtgccgccgcgcggcgagatgatgaagaagaaggcgagcaggagcaagaaggccacgttgacgctggcaccgatcagcaccctcgtcgccggctagtacggagaacagacgccgaccccatctctccgagcgctggcctcgccatcatcgactcctccactccgggaccgcttcagctcccgccgggtggcgccacaccgcggcccatgccccgccgccggcccaaggggaagaaggggagagaaagagagaagggagagaaggaggactgacatgtgggtcccacattttttctttgtgtgagtgacaaacgggtcccacgtaaatttttaattttaatgccacgtaagtgccacgtcaacgccacgtggatcaaaggctcggtcaatatcgctacgtggcgtcacgtcagcgaaactgccctccaaaaccgccaagagagtcaaattgcaccggttttaagagtttggggggttgagatattcggttttgtggtttagggtcacggattagatttcgatcactcttgagggtcgtgaagtgaacttattccttgccgatatgggctgttttgtcagcccagcccagcccagcggagggcccaaaatcatagattgtaggaataggtctagttcaggaccctcatattttcgtcaagttcaatttgcatccttaaattcagaaatcttaaccccctacttacaaaaccgggttaaatcagatgagatgtaccgtgggcgacgacgaacttggggccgtgcccgtgcaaggggagcttactatctgcgcatgctccctccgcgtcggcgtcggcggcggcgggctcgacaatgtcacctcactgttcttcgcgtcgtgcttctcacctcgtcacctcctcactgcagccccgcccgtccacgtcgtcgtctccaaccagctcattttgcacaacggcaaaatgaaaaccccgtgttccctgctaaaactagctgccccagttaatgcataagcccttgttttcaggtatttaaattttgatgagtttcaagtgccaaatttgtactgtcattcatatataccttcgatctttcgctcgctcatactagtaggaatcttttcaacgatgatattaattaattaatacaatatgaacttaaaaaattaagttcttagatttagtaaagatactacacatacacgttttacacattttctgtgatccaaccaactaacccttagggtgtgtttggatagtgggaaatgggaggtagaattggaattgagaaatgaatgaagggttaggattaaatggaagagggataacaaatggttagaatttaa

SEQ ID NO: 64402 - DNA, 1808 bp, Oryza sativa
attccgaattttacttaatctcgtattgagttcttatatggactcttcttttaatattccttatttttaattccgaatttcagctatttttaaattatattcctacttatactctcatttccttttctaattttagattttattttatttttgtttcgaattttgattaatctcgtattgggttcttatatggaaacttatttcaatatagcttatttttaattccgaatttcagctatttttagattgtatttctacttggactctccttttattttttttatttttctccgattaatgtgggaatttctagccccacagcgaacgtagcgcctcctttcaaagctgttttaataatataatagatagatagatagatagattagaaaaaaaatcaaattatatatacgactagaattagaaatgatatcacttatatatatatatagtaacgatgcccggccaatcagaaaattccgtggcaataatatatataccagcaatatacatgtgcgcatatatagagcatacattaggaaattaatttcggaaaaggagaatgaagtttgagagtgacatacatagtcttaatctggctgcgcgtatatagttagctagccaggtggtaaatggattaaggagatgagggagacatgcatgtttgtgtcgtttatattgagaaagagagaaataaatataggggggctacgacagcggggcggcgctggatggatgctgtatatatatatgtggccgggcaagagcgagcacagccggccggaggaggaattaagcaacaagctaagctaagctagccagaggaaacaacaaggaaaaggagagatcgatcgagcgatggagcggtcgacgacgacgacgacggagcagcagcagcagcagcagcaggggcggaggagaggcgcaggatggcggcgttgggcggtgctggtggcgacggtgtggatacaggcggtgacggggacaaacttcgacttctcggcctactcgtcggcgctcaaggcgtccctgggtgtctcgcaggaggcgctcaactacctggccaccgcctccgacctggcaaggcgctgggctggttgtcgggcctcgccctcatccacctccccctccccgccgtcctcctcctctccgccgcctccggcctcgccgcatacgccctccagtacgccctcatcctcgactacctccacctcccctacccgctcgtacgtacacacttcgtcttctctctctctcttttttttttcttttctttattatcgatcgcctattcgctttgttttaattaagcttgattattcaattagctttctagttacgagtacctataaggtgtccttccatcatgattatatacaagaaatataatggagatcttagccaactatgctgattgatcgtagtagtacgtggatgtatagaggccaaggccggccagcagggtttggagattcgagatcgatagtactagtagtagtagtaatgaagctactgatctgagtggccacaaataagttgcaatcatatatcacatttacggacgcaattctaacgtcccattcaactgctactgaattatatgtatattaaatcgatatctgagagactcaatgcatccatatctctccgtcgccgcgcccacctctcgtttttccttggcttacaattttttggaatcgtctgctgcaatcgattaccatttaccaatatactcctactgtgtattataatattgcccatgttatacatagtcaatcttatatactgtgtatctgcagcaataagttagt

SEQ ID NO: 64403 - DNA, 1761 bp, Oryza sativa
taataattaagtacttacatgactttcatcgtcataccatccctctgcttcctccaccaaaggtaggagttgaagacgatgaaatcagcgtccttccagacattggcgtgtttctcaatcctgtctgcccttatgatccgatactccactctgtgaattatggggttgtcgctgtttgattccaatagcagtggtgaccagtagaaatctatcgtcgcattgtactcctggagcaaacaaaagaaaatgttcagatcagagaacacagagtagtgcttctgatttctgaattcagaagcatgttgggatgaagagattagtgagacatacaaatgctttgaaggagataagggagccgttgtaaacgcgcatcttgcggccatcagggatgaagtgctccaccatgcacaccatcgacacccattgatttctgtttactgaatcgcccacaaaaactagtctcttgttcctaagcttttcaagaaactttgtggcattgaatctgttttgacagggtaaagattgcgacaccatatatcagaaaaaaaaaacaattgatccatagtaagcattagtgaatagtgattggtttgtgtttcataacggatctttcactgttaatatttcagtcctgagaactaacaatttttttaagaataactcaaaactaatcaatagtttgtctgtacgttttctagttggccattggcttacagaagcaaccatgcatatattataaatttagcaatctggacacattataaacgacgtttttttttccactaggtaccttgtactgttttaattggatattaattaggggaggaacatattaactgactctttggatcaaaggaattgagaaacacaggaaaacacaagaataataaaagcacagaaattggagtgacgtgtcaatgtaatcataaggaatatgaacaatataggaattactcaattgtgttgtttggatgcttcacaaaacagtacaggaatttgaagagaggatgacacaaaggaaattatccaagagcttggagctcatgttatatttcctcaaaacttccaatggatttgaccattacttcatataggtatttgaaaggtccattcttatgagtgcgacaccatgtcagaagaaaaaaaaaagaacttctgaagttctttagctagtaagcattggcgattggttctctcataactgatctttcactaactgtatcttcggttatctaaaagaacaaccgatcttttgctgtccaataatttattcctcaaaactaaccgttgtttaaagaactcaaaaccaaccgatttttctctatatgttttccagttggcacctgggactctgggtcaggtttcgacatttcagattgaaattttccaaattttggacccctccaatacgatattattttggccgaaattatttttttaaaaaaaatcatgaattttggtaatatttgttcaaatttgactaaattttgtcccaaatttcagaaatttcgccatattggcaccgtccgatacaaacaccgaaaacgaaaagttgaaccctgctctgagttacaagatcaatctggaaaaaaaaagttgatttttttttttgcaggactaggagagaacattttcccctgctttcacaaaactaaaaacgtttttgttaccatgagtagctcaagttggaagtttggtaagaaacactgagacagctcgtacgaatggagtgtagtactaagtagtagtgcagtttcagat

SEQ ID NO: 64404 - DNA, 1338 bp, Oryza sativa
  unsure (1)..(1338): unsure at all n locations
gtggggtctaataggaatgcttggctgctgaaaacttgagaaaatatatatgcatgtacagtacgggtcatccatggtgctaatcggatagcatgtttccattttctttattaaaaaaaactgtttctgacaggtatatgatcggctgcatgctttgagtaaggctctgttttgttccatcctaaaattttacaccctatcatatcgaacgttgaatacccgtatgaagtattaaatatatataggctaaaaaataactaattacagattgcgactaatttacgagacgaattttttaaacctaattgctccatgatttgacaatgtggtgctacagtaaatatttgctaatgacggattaattatgcttaataaattcatctcgcggtttactaacggattctgtaattaattttttattaatactcgaacatcccatacgacaccctatataataacatacgtgacacgctaaaactttacacccctagatctaaacaccctctaaaaaaatgatgaacatatctgcaagtgtggagaatggtacaattattactgcttggtggtacatcagctggtgagctagtgagccttagaaggttagtaagattgagatcgatgtgcagagtagcagcagttgggatgaattgtacctaatgctccgcatgaattgaatcgaatgaaatatggattgcttcatgcacaagtccaattagagggcgtttcaacttgggatgcatgtctgcaggtccctgtgttcttgtcatgtgaggagtggtatatattcctttcgatctgtgctagctgcgaaggcacgcattagttgcaaacgactttgtattattaaatatatgatgctagctactaacaaataatagtaatgaagcttgattgattgattttgaaccattagctacctaaagtgagtaacctacagatcatatgaaattaataaagattattatagctagtttaattgccgacagagcactgtctattttctcggtctgtcccactcttttgacgcctctgcatcctactcgatcgatccatgtacatatatatgattccccagtccatgctatgcatgattatataaagcctgaatcaatgcatgaactagctagtcatgataatcaggggctgagctacagggcaaaatccatggttgataaattcctcagacaatggacgagatatcaaannattctgctgctaacccaaagtgnngtttnatcggcatgttattaggatttatctatcggctggacgatcgggcaacatcatcgatcgatcaatctgttgacagttaattagttaaaccaacaaattaaatta

SEQ ID NO: 64405 - DNA, 1666 bp, Oryza sativa
tgatgcccctgaaaatgagatgaggccacctctgtataagaatcgatcatttccccccaagtggaaagtgagaagcatactagagtggaagttatggagttacctgcgatgctctcaatacataatgaattggtcaattgttttgtttctcttttattatttctcttgacttgatcaatttttttgttccctgggaggctgggggagcggccattgcagttacacatatttgtatttcttgaaacatgtacagtgctggtgtgtgatacatgtacagtagtttgtgtgtgatagatagttgaaggatgcacatgagagcataaaagctattatttagaagctagtggctggtatggttgctggtgtgagaaagtgcatgaagaaaccaatgaaataactttttcatattttctgtatactctaagagtataaagaggcaaatgaaagaaaaattgactttcagtttgtgttgtgtgcgacaaatgaacgaactgaatctctcagtggtcgagttcagtgctgtatttatcagctcttcaggcaggagatagaccattctctgaggtgaatttggcaggtgtggatttctattgatacatgcaacctcagcaatctgtgttaatgagaatgccgtttcttgatcatgaacaaatatgaaaaatgatggtacatgcaattcaatgcctccaaataaatgattaatcagttgctaatagcataagagatgcaattcacaattcgcatgcaacagagtagtgttgtgtatgacataccgatgaagtgaatctgtcatttatcaagctcacttgtagttttgtccttagcagctcttttccaggagataattaacccattaataatctttcaggtgaatatctttctctctctccgaggtaaggacttttcttgatacatgcatgcaacaaacttcaatctgtattgttgttatacttatacatgcaattgggcgttgaagtgaatgctgttctcttcttaatgaatcaaatgtgaaaaatgatacatgtaattaattgagtaatgctgatctccaaatgattaatcagctgctaacaataacataagagattaagaggtgattaatttgatgtgttggtcgaggcactagcagagcggcaggtcgggtggaggcgcctccagcgactgcagctcgccgacgccgtcgtcgacgaggaaggccatggcgaggccccaggtgatgtgcacgtcgagatggcagtgcatcagccacacccccgggttgtccgccacgaaccgtatcaccgcccacccgttcaccggcacgcccaccgtgttcctcatcggcgggtcctccacgttgaacttgcccgtgtcggcgccggcgtcgaagttgcccaacccctcggcgaggatgtagaagtcgtagccgtggaggtggatggggtggttctcgccggcgaagatgttggtgccctggagcaccacctgcacggcggagccgtacttgagcttgtacaccttggtgcccgccaccggctgccacagcgcgcggctcacgttctgcgccgtgtagtcgaactgcaccggcgggttggccgggaagtcggcggtgaacacgccgccgggcgcgccgtggtggtgcgcctggaggatggaggtggaggaggggagcacgaaggagacgttg

SEQ ID NO: 64406 - DNA, 2393 bp, Oryza sativa
cggcgcgcaccacgtcgacggggttcatgtcccaccactcccctgtaaccaattttacacgtttcagggctcaactcctcagatttgataaaaaattttaaatttcaaacattaattttttttaaaaaaatgcttagattttcttaaaaaaatatacgtggatttgcattgaaaattataatatcgtaaactaattatattttataaacttattttagtataaatcagtttgactgtattttaaaacgttcagagttgcgtttagccgctgtagaagttttttccacttcagcttttgtttttctttttctctcttctcttgatataaactggtatggctaattgtgttatataacaaaaacttttttcttttaatatattgacgtgcaattattttacacgtttgcgaaaaaaataccgtatttttaaccggagagaatatgattttactgattttaatttattgagaatcaaacatgtaatgagcctgctggtatagtgacattccttctgttaattgtaccaaactgccagagtaaacatggatttgcaacatggaaatccatggccttaattagcagtacagtagcaccaaaccattttgcttatcagacttgtagtgtatcaactattaaccattcaaccttcaactaatctttgtctttttcttgtgctcaagtgacccctgtaactaccaacatgttcttttgcttaaaaatacgaattcctcttattcaaccactaaaaatacaaaagggaatagctaaccctatacattgagccatgtcggctacaagctcacaacgacattctgaataaatggctgaattgtgcaatttttgattatgtggtttccccgaaagttctacttttgaggactgaggacgaaccttttcaaacaatgggacatatgctcctaagaacattttcttcacttttgacatgttcagactagtgtatgcatctctctacaaattgataacttttaatgcaaccttcttttgttaacaaataaaaagtatgtattgcaaccttgcattgcacattcattgagaatattttcttaattattagggagcaaaactttgagacaaacctcaaatgtactttgtaggagaaagatgatatcttagttcttaaggttcaggtacatgtaggagtataaaaatgtttgtaaaagtagctggctagctctgaggaatattgagcattgagcatgctttcagcatcaattttgcataggcagcatgtgcatgtttaagttttgcgccagaattcagattgatgagtaaagaaggatctgagaaacatgcacaatgatgaagtttttgatacataaacatgattggttagctagctttttcttgagatagatcatgtatggctctttggaaagctatgatacactgatgcttacttgtttggtaaccctgccctgactcatgcatgtgttttgactttgagctaagcagcttgtagtaagctggtaccaaccaacctaagggctagaaagctgttttttttttttctgatgaaaggaagatgtggttgataacaatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagccgttaacatgcgtgaaaagcagctaaattatgacagcttgaccccacactatagcaatggtaccgaccgaccaatcgtggctctgagatcaatttaattccaataaattaatgtgctataactatcattagctcgcggcatgctattcctgatcatgaaaaaaaaatatagaggaagcataaaaatgcatcttctttttctttggctttataaatcttttgcatttcggccaggacataccttttgacctgtaagtgattggctgcgtgaaatttcagtgatgatggttgcacaattttttgtaggtttggtaatgtgtgtacactatccagctaggcaatagtggtgaaaaaaaaatgctctctccatttcataatactttgcaattttga

SEQ ID NO: 64407 - DNA, 1270 bp, Oryza sativa
cctttgttgccgagcagcaggcagtggatgcagctgaaagtaagcaattcgcaggtcttattttctttgttataaaacttaaagccatcttgcttgtttgcataacactgattagtttttagtcctcgcataggaaatgaaatttcaataccccaagagaaagcaagtaaacaaaggaggtttcttccagcggtctcaacatccttggctctagctgctggcataggattgatggaaatggtggcactgatacttgggtctgggacactaatggacatcgttggtatacctgtcgtacgtaagactaatttatttctattagtagatgtctgagatttatctcttctctgaaatatggtgctagtggtgggtttttctcttgttagggtgtgtcatggttgtggatatctagagtttaaatcctgtgtagagttgacagctaggtgagtcaggtgttacattttgtgttccatttgtctgtctgggtattcatcttgatgtatatacacatacttcaaaattgttttcagacctattctatgtgcttcattagtcaagttttcaacagataataaaggatcaaaacaacatagtgtttgatcaacacatgaagacgaaaccaaactagaactatattataccaatatttggacaatgttatattctaagcttgattgattcgtattatttatttattgagattggcatagtacagagcacaaaacaaattacctgatgggcccttaaaacttactaccctaaaaaaggagttatggtaggcattagccaattaacaaaatttgggggacaaaatttagtacacttaacacctgctctcattttgtttattattcatttcaaactttctgagcttaatgctatgtaaccttggaattacactaaataattctatattacaaatccaataagttcttaaatcaatggcttcaatataaattctccgaacaaccttatacaggattcagcgatgcgtgtacctgcagagcaatttcttactttaagggcatatggtgcacctccagtcatagtagcacttgcagcacaaggtgcttttcgtggattcatggatacaaagacaccgttgtttgccgtgggtaagataatttatgcaaactattagagcatgttttctgaaatcctgtctgatgcatacgatctgctatagtgattgcaagtgtagatatacatatttttgttgttaccatttgtcatctttttttaaagcaatagacatatttgacttcaaatg

SEQ ID NO: 64408 - DNA, 1374 bp, Oryza sativa
atcttattctatgttaatccagcttataataatctggctcaataatttagattacaataatcttatgctaaaataaacgggccctaatataattaggaagataacttgatctataactatcgggctgaggtcctcttatattgatggaggactctgtccaagtaagaaccgcgagtgacgttccccttaaggttcctgttcctcttagtcccatgacacataatcaaggtgacttataggtatggtgctgaatagaattaaaccaaaataaaatagcagatagttgggagagctatatgtagatctgtattactctttaaaatttgtactagatcaatcatacattaaaattgcatgccttagtaacaaacgacatcaactccttagggaaaggctgtatgcctacgggcagaggccggagatgtaacacatttccattatctaaaaaaactccttagggaaaacgtaacataaaccacaattactgaatcagtagatagattaatcgggatatcagctagattaattaatcaaaatatatgaaggataatgaacaaccgaaatgcataataaatatttatcttcctctagatacatgcataaaaggacaagtaccacaaaatatcaccacagtgtagtcatatggtgagatgaagagtacttgtccctgctgcatgagttttcttccctaatttgatttatcatccacaataacatatgatatctagctactatagctagctagtgatatatcaccaggccagtacagcaatatagtactggtaggactagtgatggtgcatctttaacaggggagacatgatcagaacaaagaaagagagagcccagtagcacaactctctgcttcttgatcagcaccaatagcaacagtagcatgatcatgatcttcctcttggtggctccagctgcattctctcttcctcttctcgccccgcggacagatatcgagtgagagatccagattaagagggccttcttgatggttactaccctcactgcagatcatctctttcagaactggtctttgatggttcatgatattatcatctggagatgaagaagagccttggacaaaatctggatggttgctggtattagctctagctacatacctagcacttgatctgcggaaaggagcttcagcttcagctgctggtgggtaatagggttttgatccaacaagcaggtgatggcctgcagggagccagtatgatccatgacatctccatggggaccatgaattgccaaacctatatatgtaaatatatatagtccattattagtgatcgacgtcaataattagtcagaacaagttataattaattatctactgtaggagttcagaagagaccg

SEQ ID NO: 64409 - DNA, 1507 bp, Oryza sativa
caggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgtttcaagttccttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatgagcagtcgtgcaggaggcactccccaaaaacctgatcacccgcctacccggtgcagatctcaagcaaaggtgtggtttcggaggcactgcttcttccaatctctcgtgcgcgcaagagatcagaagcggggaagcgagagcaactcaggcgcggagagggagaaactaacaccgggaaagttgcggagggaatcgtgggaacgtgggttagtggctgcaaaaggatagcgacgcgacgcgacgtgatgcacgcccggcgccgccagcctcgcccacgcccacgggccggcccggcccggcgcgcgcgcgcgtgtggcattccgacccccacttaactggtcaacagggagcctctaataa

SEQ ID NO: 64410 - DNA, 4882 bp, Oryza sativa
gtttgtagcaggtgcattgataccgaaaacaactctcacctgccaatattcttctgctttacacgtgtgccggcatagtgctgccataccactgttctactgtgtaagatctgttctaattttcttctggtgttatactatagtgtcgtcaagtaatgtgccatttgttccagacaaaaagtataagttgggcaatttggttgttttttcatctagccaagagatgttattgacaaggccctagtgggctctttggtgttgtcttgtttgcggtgagcaaggatggcaaataaatccaagcttgtaatagtagagttgtttgactatggcaggtcggcagcatgccaaatcaatgacttactgattcaactattgaccacttagtatttgtttaaatgtagtgcttaaaacaccattgttgactttcagttgtgctgtactatttgtcttgagagatgatgttattgaaggctgttatgtgtcttgcaaccaccaccacctgcaagtgtagatatctgaattctctttttggaataatgcccttgaacattttgtaatgatatgttttaacaattttcttggtgaaatgtaggtgcgccatgacgacattgttgaacatgtttcatcaattctaaaaagcaatggcattgctcattctgggaaaagcattgacactggaaaatttgaatggtttgacatctattggctttatatatatatatatatatatatatatatatatatatatatatatatatattcagttcatgtttttgtgcatataatttatgtcttgatttatttgtgttttgaagctaccaacatgatggggggatgccgattggcaagtcagattcacaaagaggtgtgtttcattttggttgatcctattaaaataaactagaaaggaaaatagctgtgaaactttattatgtgtccacccattacaaagtcatttgctgtggtgaatgcacaactttggaacattgcagaaagcttatggcttgcatccagtgcaaaagggggggcaatcagactctgtacaccaacctcggaactatgctttccatttcataagctgtctcatgaccaatttcattgctgattacagtgggctatggggaaactattgaagcggacaagtcatcttctgatacaggcgaagttagtaaaatggtaatgagatacgtaattaaatttatttgttgagtctaattcatgcgatgaatttagtatgaaaacaagattgttcctccaaatttgctcctactgacccaatcaattaacaagatatggaaatatttgataacataatgcataaccatcaactgttgccttgttaacaacagaatgaatactcactacttaaatctgagtgtttttataattttgtttatacgttcagatgctaattttctcatgtaaacagatcctgggaaagcaaccacctaaaggattagccataaaggaagtgagaaatatgttcttcccatactggaaatcggtgttgtctcgtcggttgcagctgaagatagttccatcctgtcaaccaagcaggaaggacttgctaagtgctgaagcgagcaggaaggggaccaagagtattgaccacccgtgtaacacaatcaaatcaatgggagatcgtggtttgatgtcaagtgaatccagaaggatgctttatactgttgcttcaatgtcccggaaggtgtttaagcgcacttgagtacagaaaatctttggtggtatgcttgttgaaacacatactccctccgtttctttttatttgacgctacagtgcaaatcagaatcgtttttttgtttgacgctaccagttcatccgtcctagtcacgtttgttaatttccatcgttgccctccatctcaacatcgccacggcgctgcctcgtcctcatcgcgaccggactcgctcgccactgtctcctcccacgcgccgctgccgttcatgcctcccgtgcgccgccgccgcaccccaatttggcggcaaccggccaccccgagctgtggcctgtggggcaagcaagagtcgggcagcatggcgcacagggagccggacgtcgggcttgctgctgccgccactgttgttcttgccactcggctgaaaccaagcagaacgtactgcatctgcagatgacatcgtcgttattgccgttcggctggagatcaaccagaaccagggcttctcctctccttctgcttaaattgtaaattgggcaaaaccaggcaattaggcaatgaaaattggaggaaatgagaaaaaagaaattaaacaagctggaagttggagaaggcgagatcgaggagctcacttacagagagggtgacgagtgaggagccgaggtccggggaggacatgctgcttggagacgagaaaggaggaggactgaatcgagaaggaccgcttgatctcaggctccaacgccgctttcaccgggaaggtcggagaagaaagggcgacgcggcgtccgggaagagcgttgtgcagcgggttcctcctcctgtggtcgcgagcagcggcgtttgggagacgacgagcgaaccggcgtcgaggcagcgcgggggagatggcaagggagccggcgtggagggagacggccgcgccgcgcgcactgtgctcctccctgtcgtccaaaagggatgaagggcaaaatagtaaaatcgctctatccttaattttgtccatgccgtcggaaacgtcatatatatcgaaacggagggagtatattttttctataataagcttctagaatgtcttttggtcatagtgccccctacattctcattgttgctttaatctttgtgcaggtctcagaaaaagcaatgaaactttgagcttacatcagacgtttctatcctgttgggctagaaactgtgtttcatggttatggtccatactttttaatttgaaaaccttgattgcagtgtaatattaagatttaacatatattccttctgtcccaaaaaaacgaatctagtactggatgtgacatatattagtactacgaatctggatatagagatatgtcactatgtcacatccagtactagattcgtttttttatgggacagagggagtacgatggaacgtcatttatttcttgtagtgtgccaggcaaaagctgacccggtaagtgatcaacgggctaaatattgtgctgcctctaaagtagaatatcgtggtatggaaaacatgtctagtggttgatttgttctccgaacatgcgtttatatttctcagagaaaacaacttctatatttcagtacatcaattttttttgctgaatttttattctaatcattagggcctgtttagtagagctctaactcctaatttaacttcaggtgttagatctggagtagagttgtggagctgtctatctagtatctgctagaccattcccatatttgtatttggtatgactggtgagtttgctagttgctaccatgttgatgctggcacattaccgtggattctgaatccccgtgtggccgtgtgtacagaaagacacccaagtttagctaacccaagtttggtactagtgattaatatggtgtgcatagatacctgccacatcacagtgtaaagaagggttatcatgttgatatgtgcaacatggactagcatatatacaaatgtaaagtaggtcaatctagcagattaatctgaacattttatcaaaggaaaactaccggcagagggtaaattcaacagattttttgatctgcatgtattgactaggctgtttgagttgattggaagagtatgtgaagcagtggtgcgttttgacgaaatggtacaggcgcagcagcaggcacattcggaaagattgatttcttcaccttttgcttcttgctttgtttcagaggaacatcttcactttcttttttctgtttgcgtgcttctggagatatgcaggctactaattaaacaaccaaacagggtttatcatcttattgttttatacattaaagatttttctctctataaacttttgagaactttttccgagatgtcatattctatcaataaagaactaggacttgtggaagcagaattaagggtaccttcaaatgtccatgaaatgctgaatgtttaattgcttcttgtgagggaaatgtttccttccatcaatgagaaatgggcccatttgtttcagctcgcaaacaactctggaccctagtcttcgtaggccggaacgggagttagcccatagcagagcattgtggcccaatcatgattatttgcatttggaaaaagtacaccgaaggtccctcaacttgtaatcttacaaaaccgttcattttaggtccctcggtggtttttaccccggttttgtccgacgtggcggctgagtcaacgtaggacccacgtgggccccacatgtcaaacagtccatgtcagccacttcttaccctccctctcaactcacttcctctctcctctcctctccacgtcgatggccggcggagagcagccagggtgcggcaggatggtgcgacggtcacggtcgccggtgcaacagaggagcacgccgcggtcgagcgccgcaatggcctcccttgtctctgacgtgccttcatcactgctatggcctcccttgtcttcactgcatagagcgaggagcacgcgggcaaagtgatgcgcgaggcggtcactaacctcgccccgagggccagcggcagagagcacggcatccacgacgcggcgtgccccatcgaagtctccctggtcgacgaggttagcgcacgcgagctctgcggaggctggccggctggtggggaggaggcctgcgaggcgaggtggaaccgtcggcgaaatcctcgaagctatcgcagcccaccaccgccacaccctcgcccccgca

SEQ ID NO: 64411 - DNA, 1437 bp, Oryza sativa
atatagccaatatgacgaataatattggcatttttttaatttcacaaagttgcagtggcatggatccaattaaaaaaaaagtctttctactacacttacaagtggtagtagtgggcaattttaacatgatagataacacattgatttcacaatctctcttgatgaacacgttggcagcattttcataatacaaatttatgtttttgaaaaacaaaaacaaaaaaaaaagataaaaagcacaaacgggcgtgttttcaatgagaatcaatgtttgaataaaaccgaaaccgtatttgattaggctagataagcgaaaaaaagaaataaaaggcaaccgaaccgatcccctttggagcggcaaacaaaccctagctgagtcgagtcgttcgaatcgaggagggatcgatggagggcggaagcggcggcgattcccagcagttcgggaagatggttgtcgaatccaaatccaggaggaagagacggcggggagggacgactatccttgcaggcacaatggacacggaaggaatgatggatcaagaagaagagaaggaggacgacgaacaacctgctgatgttcttgaggataggaagcatcgagatggatccatctacaggggtaccgattactggagtatctattatcgtatcgccgataccaacgaaagtaagagacctcctccattcccaccgaatccaatctcctttcttagttctattatcattcgaatccccttgattcctccctatgtttttttgtatgtatataagtatattgatcgattgtgtgtatttggctggctcagctcactgagccgatatactaatttggatgctgtaacaccctaaaaattcgaccgacaaaatcaaaactctaaaaatacggatcttcaaaaaaaaaaactttttaaataaattgcatcatgccaattttattggattttgatttcggaattcatcgatcacaaataggggaaaattaattagaaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacataaaaataaaatatgagtaatattaatctagggtgaattcattagttgagataatacacatattgagtaaacttcatttatgcaagatttagaaattatagaatcaaattcatataggaaataaactaaaattggaaaaataggaaaaagacactattcattagcctctaggtgttcgacgaggctccctagccccttcccctcccctgccatgcgcgcctcgcgccccgagccgtcgccgtcgccgcctgccgccgtgccgccgtcgcctgccgcgccg

SEQ ID NO: 64412 - DNA, 1115 bp, Oryza sativa
  unsure (1)..(1115): unsure at all n locations
tccaccttcgaagcgccgcagccacgcgcaccacctctctccgccgccgccaccggctccagccgccgcttctcgccgcttcagccaccgccgtgccgtgccgtcgccanccgtcggcatcgccgcgccgagctccaccccgtcctacacctcttttccccaatctcgcaccgaaattccacctccactgtccacccgagccgcctcaactataccgcctccagccgccacctctcgccgctctagccgtcgccgcgcagcgttgccgcgctccaccgcaccctagctgccgctccactccgtccagaaccccacgggagccgcttttccaaagtcaaggtcttgtcggccctcggccgtggcttcgttgtggtcgggcgtcgtcggaacgccgttcccgccgcctcccgcgccagccaccgccatcctttccgccgccggtcgcctccctatggttgtctcgccgccgcagccctcggtaagctctccctccgcctcctcctttttcccctcctccgccgctccgcgtgcccgctgccgcgacgcgctgccgtcgccgacggtcgtctggccgcgcgccgccgcgcgccgtcgttcgaccgggtcggctttgtgccgtgcccgtgtcctggctgtgccgcctcgtggccgcccgatcggctttgggccgatccgggctgtcggttcccgtggaccggcggtagaccgcctcggtggtcccggtccacggtggaccgacgcccttgtgtcgctgaccggtggcgcccgcatgtcggcgccggccgccccttactgacgtcagcgatgatcttttcctttgtaaaaataaataataattgcgcaataattcgttaataattctagaaattcatttaaatggctcaaaacttctaaaattcatatctaattcattagaactccgaattgagccattcaacttgcaaaattcatctaaaattgagctctacatgtttgtttactttttatgtactatttcattggttttcattagagtttttcctcgttttgcgtgccagcgtgtagttcccgtcgtttcggaagatcgcttttgacgaggatcagagttcggaaggttgttgtgaagaagcaaggca

SEQ ID NO: 64413 - DNA, 755 bp, Oryza sativa
gagatgacagggtagctcatgtggtgatttggttacaacttacaagtagatatacttgctgctgcctctagatagatagatatagatagatagatagatagatctctttggtgttgactggtataggaagttgattcgacttgtacagtgctgtgttatagtagaatggataccctgtcagtatacaagaaagctgaaagctcatagatacaaacacattcagagccatccgtccatgtaaataagtgaatcttttccttgggagaagcatatataagtgaattcttcctctctgtttatatttcttggaatgatgtttatgtactggggattttgccaaggatcggcagcatgaacatatatattgcgtaccttgccccaggcagaccacaaagatacacagcatgaacaggaaagctatgggcctatcgtatctggaggcccaataagctccaaggatagagccggagtgggaggcagggcagcagaggcgcagccgagcagaaagaacatcaggaaggagaggctgaggcctgagggagacgacgacgagggaatcaagggattcggaatcggaatcggagaaggaaagatgccttgcctcaacgtgtccaccaacgtgaacctcgacggagtggacacctccgccgtcctcgccgacgcatccaagaccgtcgccaccatcatcggcaagcccgaggccgtacgttcatcccttttcctcttcttctctacccatacccaccctaggttta

SEQ ID NO: 64414 - DNA, 1613 bp, Oryza sativa
gccttttcttttcaacatcaaatcctcaccttttggatttttcagcaagtaataaatatttgcaaaaatagtatgccaagtctgttcatttggctgaaaaaaatacaaagtttaacaacatttggaatagtaaatcttcgcttcatttcgagtatgcctaggctgccaaaatttataaacttgcttttctttccacatcaaatccttcctcttttggattttttagcaaaaaattttaaaaaagactgttgcgcatactttcaatgtaatacatcagactatctgatatctttttcctggactgttgcttgttatgatcgtcatattgaaagatgaaatggacgaacaattttcataacagaaattggatgaaacagaactaatatagcattcctacaataaaagtaatgttcagttagtctaaactaaaatgcttataagccatgactttttcaaccacttactgaaaattttactttttccaagagtagatcgatttcatgtttttcattctaaataagtgttcttctgaaagctgtctattactagcgaatagttcttagagtgatacttgatgctgtatcagaaatagctatattgttactagtgaccagatagaggtaagatctgttgttagtggaccaaatgcgactgcagaaatggctagttttgctgttaatggactttcttttacttgaaatcaacattggttctctgatataatctgtgaatcatgatactcaatccgtcccgattgaaatgctattcgttgcaccatattgctatatagatttcagaattctatgattgcacaatgttagacctgtgctagcgacaaactgaaagttgacttccatcaattttctggtcttagcgtatgctgaagctattttgcatcgcctttattgtttagatactaattagattgcttaatgcttattcctcccacagtatgtgatggttgttctcaagggttcagtgcctatggcatttggaggtacccaggagcctgccgcttatggcgagctggtttccattggtgggctgaaccctgatgtcaacaagaagttgagtgctggcattgcctctatcctggagtcaaagctatccattcccaagggccgcttctacctcaagttctacgattccaaggtaagcaggccacatttcttattgactgttcatccatgggtcttcataaccatatagtcatgttctcattgcatctttgctgtttgttaggcccatcgtgcacaagaacatgctcaatgtttgcatgctttgcatcaagaatagatcagtgtaaatgggtcgtctgttgcttgtttaatgtcatcgtattggtttttgcagtttagtttctctctgcagtttggcagtaaacccttgccacagcacgtatactcttccatgctaattatgagcaactgagcactaataaaccccttttgattttctttttatgtagcgctcggactttggatggaacggcaccaccttttaggttaaactgtatgcctgtggcttcaagatgcatgaaacctaagaattcctaatatcttgttcattgcctattggaggacaatgcagtcgatgtatcagtttaatgtcaa

SEQ ID NO: 64415 - DNA, 1258 bp, Oryza sativa
gtttgttatgaagctggttatccgaacaaaatcgacgcgtttgcatgtgatttgctagttggatttgttatgaagctggttatccgaacaaaatctacgcgtttgcatgtcgcttggtcaggaatcgatatgtagagagggttacgacggcagaggatggtgtttttcgtcgaagttgctcgattctgcaacattgactagactcttctatattgttaatctagaaagacccagtgcaatgcaaacaatgggctcgggctgccgtcgtctaaaacgttgaaatggggaagctgcagggcagggcttactcttccatctcttctcttgtgtctctatccatcaacattgaacaaagttgtcctagacctagctattcttcctcgtgcgtgctatggcatgcaaattgcaaagtaaaaaaacaataaaattgaatgaatctatcatcatatggacacatgaggaattaccaagctatcaatctgtcatctgcactaattaaataattgacaacaaaagaatgaatgaatgagaaatagtgcaacaaaataaaacgtaggtcaagccatgagcatcatgaccctgaactcgtcaaaggagagcacgccgtcgccgttgaggtcgaacctgcagatcatggccctgcactcctccatctccagccgctgatgctctgaccccagccgcctcagcatccgccgcaggctcgccggcgtgatcaccgccgtctcctcctcctccgcgtacatgtcgaacgcctccctcaggcaccttaggctctcctccgctggctcctgcaactgatgagcagcagagagcctcatgaactcgtggtggtccagcaagccgtcgccgtcggtgtcggccgttgcgaggatcgccgccgcctcctcctcggaaacctcctccccgagcgccgccgccatgcagccccgcagctcggacgcggacaccttgccgtcgccgtccttgtcgaaggccgcgaacaccgacgaagctgacgatgccatggcactgtcagtgattatatgatatctaatctaaggagaggattaatctcggttgctcctggatcgacaatataatcagagttcgcaagtatatacgtatatatgtagtgagtctaatttgcgacttgtctctgctgcaacttactatcgaaatcatcggtcgatctgatgatagctatatactcctatatataagatgatagagatgatccagcaggcaatacttactaaggaagaggacagaaggttca

SEQ ID NO: 64416 - DNA, 1639 bp, Oryza sativa
gagagagagaatagagagaggggaagaaagtatgacaggtgggtcccatattttttattaaatagaatgctgactggactgccatgcgtacgtcacgtagataaaatccaccgttgattgaaccgagggaggtaattcatctggtttgcatagttgggggtgaagaatatccggttttgtggttcaggaggtaattcgtactttttccggttggagatatgcatgatggttttgaataggaagtaatagtaaactaagggcattatgatgggctggatggaaattctgctgaaatgtttgacgaatacttgctgtctgacgtccgatacaatcacaaatattgaacgcctccactcaatgttagtagtacatgtgttacgcggtgattattttttcttgtgctcaggtgcacctacgggtgatgtatacgcttataacaactttattttaaaactttaaacaacttttttttttctattttacttatcttgtcaataatttgatcgtactattggatttgttacaattaaatctttacaacaagatctcactcaattatattctggttattttttaaaacttattctttaatgttgcgcatagttttactcagttgtttcaataagtatttcttagtgtttcactattccatttataaatgttacacatttttttcacacggtctaaaaaatgttttagcaaattaattattcttgtgaatatattatgtttcacatgactttttttaatgtttcactagttaggactaaacgtttcatgcagtgattgtcgatgttgcagtcagtattatcgaaatgttgcatctctttgaaacacatttaattacatgatgaaacaattttaatataaggggtgaaacaacgctcattttttttatcaaaatataaccatatgagatcttgttgcaaagatttaattataatgattacaatgatataattatatcgtagattggattgataaattattagataaaactatttataacttggtaaataagtatatataccaagaggtagtgagagagagagttgttagagaggcgtccgattttagtgctgtccgacgcgtaggcgtccccgaaatgtttgatcgtcgatgttagggagatatatggatggatcgataacagttgggcaggagaaagaaagcggcggtggtaagctacagtgggttggtactacgtgctcccgtatccgattcagccttattactgtgtttatatatacatacaccaacaaggaaggaagcctcaactgaacaaacatcaacaagaaaggaaggaaaagtgtcaggttgcgatgaagcggcggaaaatccccaaccgacagcgacggagcagcagcttgggcagatttacgtgttatcacggcggcggcgacgacgacaaccgatgcaaccacacgtggtacgacgaggcggcgcgccggcttcccctggacgacatcccggagctcgctgactgcctcggcgaggccggatgctgcttgggcctcgccgaccccgtcaccaacatcatcctcaccaccatcttaatcaccattactacatgtcagattctcgcaagaagtcctacgggtttagtatgtccacacctcattcagaggcctcctcgcct

SEQ ID NO: 64417 - DNA, 4466 bp, Oryza sativa
caacccaacatattcctactgatgactccccgccatgcgaccacatactctccctttacatgtgcctcctcgtcgccatcctcccctacgccgccgcagccgaggcttccaagcacccgcagcacaccgcgctcgggtcattcctcctctccctctccggcgacggcgagaagctcgaccggctgcgccacttgctaagatccattaccgatggctctggccgtgtcatctccgatgctgattgggagcagctaaacgcaatgatgatccaagagcggctaatgataaccaaaaagattggcaggaaaagagcactgcctcctccatctgcagctccacaagacttggcagaattgtccaagagaaggtcagcctatgtgaagcgacagaggtttgctcgcaccaacctggaggaattgcttctcaaatattgcaggcaacatccttgggtacgtaaattaaattcacactcttttggtttctctcgattaattaattaattaattgctgcaatttttttttgattatgctaaaatttatttgtaattgcaggaaccaagttacaaacttgatgtcatatgtggagtggaggaacccaaatcctatcactggagaagttaccatgctaacttctcaatgacccctccttcaaaaaagaagaggacaataatttaagtcggaggaggaagcagtagtaattaggtcccaaaacagagcatgttatgtttgctagctcagatcaggaacaggcatctcatcagaaattactactagaagaaagctgtacttgatgtttgaccttggagtgatgcacaccaggccggtgatcatgccctgcaccgcgcccaccaccgacggcctcccgcggacggcgacgtcgcagcaaacccaagcgacgatgctggtggtggcgcagatgtgcgtgttgagcaccgccaccgacgagtcggtgttggcggagaaggggtcgccgccgttgaagccggtccaccccatccacaggatgcccgcgccggccaccatcaccaccaggttgccaccactcgccgttgccatttcctcctcgtcctcctccttcctcctgggtcccacccagtacgcggccgtgtagccggagacgccggcggcgaggagcacgacgtagccgccggagtagtccatgacgccccagtggaagaggaagcctccgccccagatgctgtacgctcccaccgtgtaggacagcgtcgtccacagcggcacgaacgccatccacgccttgacgctcatgcgcccgagcacggcgccggcgaccagccccacggtgacgccggcgaaggcccactggaagaacaccatgctcgccgacgggtacagcggcgccaccgcggccgtctcaacctcgccgttggagcggaggtggagggtggaggggagcagcgcctggctgagcatgtagtcctgggcgagcgccggggcggggcggccgacgaaggggaggaggcggcggccgaaggccatgttgtgcgcccagagcgcccagcacggcatggtggcggccatggcgtagagcgccatgaatgcggaggtgagcgcccacttgcgggggacggcaccgacgtagaagagggcgaggcccgggaagccctgaagggcgacgagcgtggcggagagcatctgccaggcattgtcgcccttgttcagccactccggcaccgccgccgacgccattactcttcctagaatcctagtttgagcttacagctgcagctagagtgcacagccgagtttagagagatacacaaactgttaggtttgtagtgcagcttcgtctacttacaaagatgatggtgatgatgatagtaataacaatgtagtatattgattaataagccatgtatagtagtacagtcctaactaacaggacatatggaatagtatcttattagtagtaacaaacctatgtatagctcattaaccaaggaagagaccaacgatatatgcttgactggtggacaggagacaagagaaaatgtcaagttctagggcttagcaacatagtagttgaaggaatctcagtttgtaacccccaatgagtttccttgatgaagcctggcagcccgagtcttacaaattttcaatattcattcatgacataaaaaaggtttggtctatttatttatcatcaccgttgagatatgaactggaaataacatttcggaaattttctatacgaaagaattaaataaaagaaacaggaagaatgaaacataaataaaacaaacaaacctgcacacaacactcaccgactccgaggccccaggctaggcaccaaaaacaaccaaagagtacgttttctttcttcttttttggcgagaaatcaaattatagctaccaacgaattcattcagggagtaacaattgttcagaagagtttaaataccaacaaatgaagcatgttagctgcgtagatgtgccaccctgttaataagacacgaatagctttatagaaaatactaggacaacgaacaccctgttaacatattacatttttcagatttccaacgtaccaagagcacaaacgccatgcgcacgcacaataccaaaaactgcctcagcacaacaagacagcaagtgcgtcactgcaaactgggtgtgcaagccaaacaagcttaagaagaatcatcagcttcagctcgcagttgcgccaagccttccttgtaaacttcaaagtcatcagaggaccaccggcagacaaggtacagtcggaatgttgccatctgcatcccaagcaaccgctgcaatacagaaattcaagaggaccttactgcaatggaatagaaagacataggattggccaatgtgttttaacttgtgtatttcttaaagcacataataattacgacaccacaaagatgttaccattggcttggtcacaatattaacataatcaaaaatgccaatctgattttgcttttttttttaatcatgcacgatatgcagtatgtaccagagtttgtgctgcttctggtgaaatgggcttcccttcttcacatactatgtgatctgcaactaattccaccgcccctgcatcaaccagaccaaacttaacagccatttcacatggtaatttccagcacatgcacaaaaaatgtacagaaactgctaacctttgttcagacgaactggcagtccttgcttgcgtagaaagggttccatttcatgtgtaaactgttccaaggggccttccttaagctccacctgacatatcatcatgttctaaatttagtaaaccatgttttatgaagaagagaaagtgaatagttattccagacatattgtgcattgcagacaccacagctaaaacaaaatcaccaaagagcttaacactgtcaaagtgcttttgacttaattttccacaagttactgtaaatcctactactttcattcctaaaatcaccaaagagcttaacattgtcattggtaacgtcagcataaatctcgataagcatggtcattctagattgtttactgagaaaacaagccatgaacagaggtacataaatagaaaggataacttgaataccgtttctgtcacaatacttcctgtcctggcgaaatcatgctcttcgaattctcgaaataatctgcagtggaatatatggcaaaaaaatgctcatatcaagcataggcagtcatcatgtataagtataaagtgcaagccattggatgaggagactacctctctacatcatctcttggaagattagtaaagaacagtccagtatcaccttgtaggaactaaatacagaaaacatacgtcaagaaagagctcataattcataggaatggtgtggattgtattatatgccaagtgttaagaaaggaaaatgtcaccttggaaagtttatgaaggcctgttttagcttcatcagcagatgaacgccccagcgctatctgcatgaccttctttccagcaaggaatatcctgacataaagggagtatgtaagaatttcatcaaacagccaatctagaatagcttttgcaaatacatgcaaatatgttgtagttgcaaggttaaagcgaaaagccaaaattcaatctatgcagcatatcgtttgatgctttgagcagagaggcaccgtactggctagactaataataataagaggcagctacctgctggaggacttgagctgctctctgaggtccttgagcttctgattcctcatgttatcgtaggtgaagacataggcattagcgtagtgctcgacggcatctttgatatcggtaaccactttgcccttgcgctctaatccaggcttcttcttggtcttggataaggttactgcgctcgaatcaggggcacaaattaaaaatttggtgctgattactaactaattacaaaacaagagcgatctgtgcagaatatgcacgatataaaaaaaaagacaaggtttttggatctcccttggccttggggaac

SEQ ID NO: 64418 - DNA, 5235 bp, Oryza sativa
tctgtttggacacaaaggaaggatcattgggctggcctccttcatgggctcctcaatatatgggcttgaacatttttctcattttatataggaaaaagtacaccgaaggtctctcaacttgtaagggagataaaaaatgtccccaaaccgtaaaaccatgcggagtctcttaaatatataaaaccggtcacccctgaggttcttcacgccagatttgtccaacgtgacggctgagtcagcgtggaacccacattgatccatatattaggatgccacgtcatctctcccttcccctctctctctccctcactttgctcctcgtctggtggccgatgatgggtgatgcggcggcgacttggtgcggcgcagacgaggatggggtcggcgtcgagcccgggggcagaccagggcgaggcgacggccatgcggttggccctgaccgggaaggaccgagcgccacggcgtcgagatccaccccgcgcgcgacggcgccgagagagggaaagagagctccaaccgagcgtcacggcgtcgagctccccgacaaaggccggctgggagagacgagagaggaggaggtccggcggccaacgaccggcaaccggcaggggagaagagcagcgtgccgccgtcgcatttgttggtgacgaacgcggcggagcagccggcgcggaagtagcagttgaggaggagctttgctctggtccttgccgctgtaccagccgacggtgacgatctcagcgctgacgacgagaacgttgaagaacactagaatcctactgatgaatgcatttaagatactacattagggaattaaaccccgcttgtttcctactactgaagtatgaagagattacttgatccttgttccttttaatatgtcattctgaattctgaagccttgctcttgttagattggctgataccccaggcatcaaaagaggactagaatctccttcagcatggaagtccccttggttcgtagatatgcaatttcaggtacatttagcactttgtaaaatttatgtatttgaaatgcagagctcaagtgtttggaacaagcatataacttggtgaactatggctaaatctaagcggatggaaatatatttcttattattgagtcatgcctgagagtatttttttttcattaatcacttatattgtcacgcactgtgggcattgcttgctattgttttctctgctgaacttcttgtggccatatgttcctcccagggttcatacttcgtcagcccagctgatagaacctacgatgcgctaagattggtgaagcagatagtaataatgcgcagactgctgctgctttggcagaagcccgtgagagggaaaggctggcagttgtgtttctgtaatccaacaactgtaaatggttttgataaatttccatccatgttgagcataaattaacatcattacccatgccacgtgtagcgacggtcatgaactccacgctgccgtcgtcgaagcagccgatgagcttgatgtgctcgagcagcccggccaccggaatgcgcagcggcttcaggcacgcgaagtcgacaagcccgacgcgtcgccgcttcacggtgccgggagtggtagaggagcaacatcgcgaagtcgacgagattcgttttttattggatggaggagtatgcattaaaacataaaaggcctattagctcagctggttagagcgtcgtgctaataacgcgaaggtcgcaggttcgagacctgcatgggccatttcctcttttttactgtattaccttcctttctcattttcctttttccttttttaaacagggctgggcctgggcatatgacatatcagcatatggcattcccacttcagctctcaaggtttgttccgcctcttttcagtgttgagaatagcttcttcaggagtagcttctataagcagtctagctgattggtactactagttcttcttttgcttttaaaatgcgcttgctgcctttaaatacaaataaatacacacactaatctagtaatacatgtatttatcatctgtacacttatcattctttcctgccatatacatcttgatggagacagcaatattatattgggatttatacttctctttttctactacttttagctactcaattaatcttgcctttcaacaaagaaaccagtgaagaagtgtgaaatgcatcatggttagagctatacatcggaaatttgtggagcagatgtctgtgtagacatcttgcttcttagctcttcaaatgccttcatgctttcctcatcgaaccctccggcaaactgcagagcactcgagagtaagttgttaattacaaaatctccatttcacctttcagattaatcaacaccattattacataaatggttgcggaattatatacctgatgaactcggaaagcaaatctcacaccctgaagaagcaagaactctctgttgggctctttctcggtgccttgcaaggcatcaagctctgtggcaaccctcttcatatacttcttcgccagctgaacagatgccaatttgatctattcccaacataacaagatgaaatttggattttagatttgctacatggtccaaaaaggtggcaatagacataggctagagatgttaaccttgccaactaccccggaaccagacagccaatccaccggtagtccgtactccctgtagcgtgatatggccatgtctctagtacgaagtagcgcataaacactctgctccactctgacataagtataatacttgttagtccaattaaacatcaaatgcttatgcttgctaaacatatttggacttgacaagatatttattatctcactctgaagaacaatggaatttgggagagaatggttcagaggagatgcttacttttcaagcaaggaatacatcttcttgagagcttcttcacatgcaagctttggatcatcagtaaacgacgaaaccttatgttctaattttagcaggtcttgatactcaaaggctgcctctcttagtgcatcagttttgctctctggccaatcaaagtgctttagtactgcccgctcatcgacctaaaatgttatttgaccctttttcagtactaactattttgtcatgtgttgcatatagaaaaaaaatagataagcttaccaagaaggatagttcctcatcaagccaatttacaaatgcaacaacatcgtcgatatttacaaaacttgctgctcggacctcatttgctagagactcgacaaagtctccttgtgtctccacatccgctttgacctgaaacaaatccatttttttatataaaaagtcagtcctcataataatctacctgaattactaatggactaagggaattcggtagtatatatatttctgaaaggaagcatcatcttgaataacttacagctaagaggaatgttgatctattctcaatctctccaatcatgttgcttctcacatcaaaggcacttgatgttgttgatcccagagaagttgtgtccttcttggcttcacgcttcatgagactttgataaaactctacaacctctggagcacggtgtaccttgtcaccaccagcaagattcctaggtagggaaccagggggtggtggcggcggtggcgggccaccaggtttgccaggaggcggtggtggaggaggtgcacctggcgggcgtggcggcggtggagacaacgcacttgcagtgttggcagtggctgatggtgcaggaggtggcctaggaactcttggagctctcttctcaatatttgcaagtttcagttgtgtcacaactagagggttgttctggttatcactaggttggtcactggattcagcattagctgtaggagccttttcctttatttgagcaagttttggagggagtgcagatcttggagatggcacaatacctgaactgttgacaccgccatatctttgtaccctagctttctcggctttctcttttattaccttctcccgttctgtggcaagtttatgcctatctttgtaagcgggatacttgtcatcagcaaaaccttgtacagtctttgacatcaaatggaatgaagatgcaacatttgcctcatccatgatatcactgggatcctgttccctctttccaaaggttgtaatgcccacaccatctcctgcatttctgagcatgagagcctctaggggcccctttggtttctggctggcgctctttggggagtcactagtgaagaactgtgtcggtgaagctaatctgctttcatcatccttgccccttcccccttcttgagcttttgcatcagattgggccttttgccaaagaagctgtatctgctagaagaactgtcaactgaaacattgtccaagtcttcgcttctgggtgaagaaggtgcagaagaagcagtttcaaggtcagtgtcgccctgtcctcgttctgatcctgcatattccagcattagaagtttggccctctcacgcgattttgggctcagggtcttgttaaggtaacgagcagaaattttctcagatggtgcctggtagttgcggagctcatatctcagacaagcattaacccaacgcaggtaaaccaactcttctacttcactgaatctgttcatttgtaggccttctacttgcttggtaaggtcttcatttacatgcctcagcttgttgatctcctctcttgcatgggaaactacatcactctgcacaatgataagctacgttattaatatatctgtatacgctgaaaatgaacataatataaatatctattgctagttcattcttccttttctgagagaagcactgtgaaattatgatgtggttttgaaatataagtttagctctcaatatagctatgcattattgaataggcaagggatttttcagttaaaccaatgttagtgtgtgcaagcctagtccaatggataataattcagtgttgataatgtgagagataagtctaaattctgagtccttgtcatgaaattgattgatgaaatcccaaggggaaactacaaaaagaaaaaaaaatcctatcattttgtgcctatttttcttaatgtgaaaatgaggatagagggggtaaaaatgtaggacagcagccagctgtctgcatgccacataaatcatgaaaaaaaatatgtcaacattaaaaacaattgctgctgctgcaaatgatgccatgcaaatgtgaggctttagaagcatataattgctgagtgaaaatgatactaatatca

SEQ ID NO: 64419 - DNA, 1113 bp, Oryza sativa
cggactcatcgatcttcttgctcctatacatctgaaatcgaacacagggaaaacatatggattatattaattttaggaaattaagagaaatacagatactacttctactgagaataagaaagaaacaagtttgttaggtacctggagatggctcttgacatggcctatgctaagccctctaacattcatcagctgaagaacgagcttaggagttgcgcctgcatacatatattaattagttacatatagatagaaaagtgaataatgaaattatatatagcatcaggatcatatatatcgcgagctagatcaatgggtaaattaaatagatatgcttatatatagggaggatcatatatatcagactgaaccgaagatgatgaaattaagctttctatatatatggcaaggcaaaaatatgtaggaataggatggcttacgatcttggccaccgagcctgtcgacggcgcggacgaaggagaggtggagctccggcgtccaacggaggcgagggttcttggagcggacgtaggggcgcaccgacgacgacgacgacgtgcgccgcctgctctccccggatccctcctcctccgtagtactgctcgtcgtcgagctcccgtagttgttggccgccgccgccggtgcaccgccgccgccgtcctcctcctcctcctccttgcctgcacttcccatatatagcgatcgagacaaagctagatagggaaattaaggaaggatcaccggccggccaactctctatagctttagcaagcttagcttgatgatgaacacgagtcgtcttgttgctgctgatgcggctgcatctgcatgatatcgccggccactgatatgatgtcaaaagaggctataggagaagccaaaagctgaagctggagctgaggtcaccattcaattctatctatctacctagctacaccccatatatatgtccagatgcatatatattgctgcctttttggaagggattgagctaagcatgcatgctcatatacaagtaactactaacaagctactctagtactagtaattaaggtagctagctaggtaattaaaggcagcaggtggattcatgcatgaggaggagaagcaggt

SEQ ID NO: 64420 - DNA, 1065 bp, Oryza sativa
tatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcatcgagggggggagggatggaggtgagcaaggaggagttcttgaggcagttcggtggcgactatggctacccgggcgcgcccaagggcgtcgacgagatgcgcgccgccgagttcaagcggcttgaaggtgcgcctaatctcgaccttgtcgattccctttttgccaaattctgggaggaaaaatggaattctattagtgttttgtgagaacaaaaggatggataggaacttgtggcgttcggtcagatgaccgcgtttcttgctgtaact

SEQ ID NO: 64421 - DNA, 1309 bp, Oryza sativa
agaaattaaagccaatgcagtggcatacgagtaggagtattttagttaccatgcggcacaagaaattgttctgctcatgcacggtctgatgctgcatttcatacagaaaatccatatattaattcagctcaccactcatcagcaaaaaccacaactgcgactacaataagggagtagtgtaccatgcgacgcatatcctccagctgctggctcatgagctcatcctgcacacaagcacctcatgcagttaacacattctgtcatataaactctaattgtgaatttgtgagcaaagaaaaaaaaatcgtggaggacttgtatattccataaggatttgatgctgatctgcactaatcttctgccatatttaagcaagtgctagtaccttcctcgcatgaactttgctgagagatgattcaagctgcagctgcagctggctgagctcatccactgtggacacagatgacaggtcttctccagtttgcctccttaaactggcttcgagctggtcgatctcattccttagccttgtgatctccatgaccatttgctgcaaggcagcatcacacatgtagattagttgtagaaatgaagctttgagtgattaggaatttggtgtgggacatgcaattgcctttcaaatgtaaaaaagaaaaaaataacatgtgttagattcagttcgcttacctcatcatcacggtttgtctcctgaagccgagtgtttctggtggtgatctcataacggtgaaacagctccatcaagcttaacaaagcataatcaaatatgttacatccagaaacaatatggtattactagtacattggaccaatgaagtgaacttatacatgtaaaaggagtattagcttctagtagtactaatcgatgtggtcatgggcactgcttaattgaagaatgcactatgcagcaagcacaagtcctataggaatagatcctgaaatcaaaatttcaggatgccagaaaagattaaatcagaaagaaaagcaagctctagaacatgaaccatcgaaagatttctagtgataatgttgaatgcaaggaaagcgatcccaatttcccaaatccactaccaatcatgaagaacactacccatttgatcgggatgttaatcgacagtacccccaaacatttatctggaatgctgagtgaaatatcaactgcaacaaataaatgcaatgctaaatttctgaatcatcgcacacaccaccaatcaccacaaagaactgaaaactcagctaaggcatgcagatatatagaaatcaagattagaaatcagcacacgggctgcag

SEQ ID NO: 64422 - DNA, 1305 bp, Oryza sativa
ttcgtggcagccgcaggcagcattgcagcaggagagcaaaagcaacgaaacgaggctaatcggcaaaagcagctagcaacgtcatggggcacaagaaaaattcagagagagcacctcaacgcaaacgttggttggagttggatcagtttgtcaccatcgggctggtctctaacccaaaagcagcatatgggactatggtcgtgtttagttatttggccaaaaaattttaaagtatacggacacacatttaaacatagattaataacaaaacaaattactaatttcgcttgtaaacacacccttagattcaggggtgtaaagttttgcgtatcacatcgaatatacgtacacacatttgaagtattaaacgtagtctaataacaaaacaaattacagaatccgcctgtaaaccgcgagacgaatttattaagcctaattaatccgtcattagcaaatgtttactgcagcaccacattgtcaaatcatggcgcaattaggcttaaaagattcgtctcgcaattttcacgcaatttgtgtaattagttattttttcgtttatatttaatacttcatgtgtccaaacattcgatgtgacatggtataaaattttaccaggggatctaaacaggccctctgtatcatgatagtgcacacaaccaagtgaacaagacactgcacacttaggctaagttctttgcctcaactccaaacttcaacttttttccgttagcatgtttttcaaacagtcaatgatgtgtttttttttgcaaaattttctatatagaagttgtttaaaaaattcagataaaatctatttttaagtttataattattaatatttaattaatcatatggtaatgaggtttctcgttttacgtgcactaaaaatttatctccaaaaggatagatcaaacgaggccttaaaagaagagagaaaatcataaaaactctcgagatcaaggtcttacaactcgaaaactaggtcatcacccaaatgccaggtataaaactccttaaccacttgctccaaatataaataagctgaagtgataataccatataaaccgagcttctggagaaataatcaagaaaacaacctgcaaaggaaaataaaccgttttcccataaaaaacaacatcattatttgagagccaaaattgctcggcacgttgttatcgtctctagtaaaaaaactggtctaaactttttgttatgtcgcaaaatccattacccaaagatatggacgcgtttatggatgatcaaatacgactacgagtatactccctccgattctatattaattga

SEQ ID NO: 64423 - DNA, 1116 bp, Oryza sativa
gtgtgtttgttacattttgtagttttattagtccgatttactccctccgttccaaaatataacaaattttatctcttagaatttattctaaaatataacttctctccaatattttcttctaactaattacaaccctccgtcattcatttttctcacctatctccactacttatccgatcacaaccctacatcattcacttctaactattttcttaataactgtgtccaactttaaaatttttatattctgtaatggagggagtaattaattaattaattgggtccggtttgatcttgattccactaaatgaaggcatttcctctttcttcgcaatataatactggtaatctgtcgtaatctttgaagaaagggagcaacaaaacaaacacaccagtacactactgattgttattctgaagtagtattattggtgcttaagggcccctttgaatcacaggaatgaagaaaacggaggaataggaaaaacataggattctgacaggaatgtaagtgtgaaacagaggattgcaaaacacaggaaaaatataggaatgaccatttgattggaccacaggaaaaacacaggaatttaaggagagataaaaactcaaaggatttcttctatgaggttctacatcttattaaaattcctccaaaacttgtacgggaagaggcattccataggaatttcataggattccatagggttcattcctttgattcaaaggactttgtaggaaacatttctatagaaatgaaatcctctaaaattcctataaattttctttgaaggggcctaaagaatgattaagctatcttccggtgcataaaggacgcggcacctgatgccaatggccaaaagcggacgaagaatcttattttggtagggatgatcaaaagagtttgaattgacagctggttgtcgagaaaggacgtgcactaaaaacgcacgccctgaaaccacactacatctcaaccacacgaacacaagctacaaaaaaagggacccaagcatcgaaacgactaatgctatttgagaccggacactgctagacttacaacaacaccataggacggaaactctaaaaacaacgtcttcattaaggtgcgacgtg

SEQ ID NO: 64424 - DNA, 2046 bp, Oryza sativa
aaatttctaagtctattacgcgcggcagtttttggacttcagttcaaaattcactcgtgactgttgggcttcaaacgggatgctcgactacacatcaactccgcgattctcgcacccggaatgataacgttctagacgcccgaagtcgcgaatggtcgcatgagttcgtttttgagcaaaagtcggaggctactgtcagggttacgggtcaggcataccccctacccttcgatatacgatacgtatcgacatggcatacccacgcgcacgcggatatttcctttatgatctaaggaaacctttcacgaaatcaatagacgggaaaaagtccttctcggacaagaactgggttacctacgtatcgtgctaggtctggtatcttcgagtcctactcggagagtaccagacctgtcatataaaagggaccccccgagaagggcatagatcatcgaatctcagaatccacacagtctaagaagccggagcctgcgaggagccaagtcgccgagagctagtcgaatcaactcgactacaatctcgccggatctgacaagtttcatcttttcctttgtaacctgtgttttccaccatataatcccacatcaactggattagggctattacctgtcaaggggcctaaaccagtataattcttgtcttttgattgctcgatgtcgtactacgtagatctttgtaccagcgtaccccaataccctctatatccggtctacgggtatcacccgtcgacagtgctacacttttgaaatcggtagccaatagtctcttattccactataggtggcgtagttccattagaattgctagctaaagaacattatgtggtttaacgctagtccataataaagagaagttggagatttgtctcatcgccttatttctcattttaattttaattttatctttacccttttttattattaaacttatgactgtgtgtcttatgatagaagctggagatgtaatccattttcattatctcaaatccagtactccatacacgagtacatgtcggatgtaaataaaagcacagattgtgcactgcattagcacacccatcacaagttcacaactcgcgagtcacagatctaggttcgttgctcgtcgtgactcgtgacgaagtagcaaacaacgataagaaaagagttctcaacggttggcagcatgcagagcatgcgttacatgacagcacaatctgcactacaagcatcgtcaaatccaagcatattctcgcaaatctgcttgagcctctccagcccataccgacccgcggcttcattcaagctcatcaccatcgtcctcggcagcaggggatcagaaccatcctctctccagtcgagctccatcaacgtgtcggtgtagatgaaatggagcagcgccctgaagacgccggctctcatgtcgtccttgacctcaacgcgcaccgacccatccttcttcctcgtgccacctttcaggacggcggcggcgagggacggcgacctcgcggcgagcacgcacctgtgcgccgcgatggacacgccggaaacgatgaactcgacgtcggcgaatctcccgctccgcagcagctcaccgagctgcaggtgaaggtcgggggacggctcggccgagttgatggtgttcttgctgagcaccgtgatggtgcagcgcacggcgaaggagtcgccggtgatgaaacccgacgcctccagctccctccgcttcacgagcagaacccacggcgagctctcgttcgcggacccgaacgcgtgcgactgtcgctcttctcctcggaagcatgggagcgcgtggtcgacgggtgcaccaggcagcagctgagctacgccttgatggcgccagcgtcgttgtcgtcgtcgtcgccgccggcgcgctgcgcctgctcgccgatgccgaggaagacgagcttgaaggcgacccagtagtgccagtgcgcatcgtggcctggggtgtagtggatctcccacgcatacccggccacggtgagacgcttggaagagacatgctcgtgtttggccatggctttcgtgg

SEQ ID NO: 64425 - DNA, 1089 bp, Oryza sativa
ggattaccgactacatccaaactcgggaaggattctgatgcggccaagtcttgtcccaccgacataaatcacgggccgacaaagatgacttccgaagctatcaggtcttggtgtcctatccacaaaaccaagaaacatacccttcaagattgctgggtattcatcaacgtccgtgctgaaattcgcgcctgcaaagaacgtggaattcaatgtatttctccgactcgggatgtctattgtcctatccacaagacaaagaatcacgatctctcgagctgcaaagtctcctcggcgccatgaaaaccccgtctcctaagtcatacgtccccgctagggataacggcaaggaacagggagcgactccagcctcagatcgattcgttggggtaatcgatctcgatcctcacgaaccatcggtcttacatcccctcgaagactacgggtcatcgacaacaagtgcgccgcgggaggtattagttatcgatgacgttggcacgtcagcgcaagccaacgcagaagcggcgaatcaatcgactactctagtccagcacatcagggctattcaagctatactgagggaaactccttacgatcccgttctgaacgacgacctcgagcgttggacagaatgattacgggagtcggtgactaacctcagcaatgcgttcaaagaggctgctaccgcagcacaccaagatcagccaccaatcggcgacgccaatggtgaagatccggagcggagggaattgcctcgacaggctacccctccacctcgtggcactggcgatcttcgagatcaaattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcat

SEQ ID NO: 64426 - DNA, 1340 bp, Oryza sativa
ttcacataactattttatttcacttgcaatgaacactggttgatctgacaaattgacaggtactactgctgatgagaaatctgtccatgaacttaactagccccaactttgcggcacatgtaagtgttctgtttttgtatttgttctccactgatattatgcatcttgtagctatctaaacatgttatgagtaatttagagtttgaactgtactagcgttaaggtttgccattttggctagttattgtggttaggttcttgttagctgaatttgtgttcgaagtttggggtagctaataatgttttaaataacaaacaattgactggctactttcatgattactgtgatcagattgcattagttgcctaccacatgcttactctcatccacctgtgttcttctggatatctagtgtcaagttgaccgcatccatgtcctctcaaacttactttgcaggatttgatcctgattgggctggctacaacagccatagaaactttatacggaactttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggggacccaattaagtctgaaggcatggaaaatcttggatctccacagagttgccatctcccgttcatgtaatacttcagttactctcgttttctaggtgcttgtaatctgattttatcccatcttgctgaagcaacttttcgtactccagggtaacaagtgagtgagggagaactgcttgtatgcggacgaagcttcagttgtttccacaagacgttctttgttctctttgtactggagttgtggacggctgatccggcagtttaccaacgctagcacgtgttgtggccgtggcatctgtatagcttccaataatgctctaaccctaggctagttttgctcatcaatcatgttcatgtagatagccagttttgtgtgctcagcaattctttttccctcggggtggggcatggctcgaaatgtttttgtatgtgtacatctttgtatacatgtatgtaaatatgtgtgatcatgtaatgcttaaagatactgttgactgatttgaggtaataatacaataaaccagtggggcactcgggtgtagtctctagggcgccccactgttgtgaaatgtgagctctgaagttgtggactatcttcaaagctatgacctagt

SEQ ID NO: 64427 - DNA, 957 bp, Oryza sativa
  unsure (1)..(957): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacctcacggtatccaaaccaagagccatcttctcttttcaaattgaatgtgattgtagggcccattttcagaccttccacctaaaacataatacatagaaaagaatagataagtgcagagagctagcagaattcaagtgggcacttcagaatatcttattcataatggcttgttcttatatggatgacaaataatccaaaccaatggaagaaaagtaaataaagcagcagtaattcttaataagaagatagaaatataatgagatataacttagttatggaaccttggaatactgttgtccatatattgtgcaaacatttatctcattactgtgcttcaggtccagcattttgtttctcacataagtagcaagggatgtagtatgcctacaaaagaacatcagggtgtaaactatacatcatggatagggtgctaggacccaaactgtcttacgtaccgttcaattgcagaggtagtgagcatttcaatgatcttaaacccatgtcggagagaagctatgttcaagaacgagattgttccatcctctagaacctgttcgatattctttcttttttgaacaaagtcgatgtcagcaattgaagcagctacggttcctggaatttaataacaattccggaggtaagttaaaaaccaggatatagaaaatagattactcaaaaccaagtataacgagctgtgaccacaaacctcc

SEQ ID NO: 64428 - DNA, 1128 bp, Oryza sativa
cccgtctacggacgcaggctagaggtggccaaacgggcggcccggcccggcacggcacgggcacgggtccggcacggcccgtttcggcacggcccgttaggcacggctgatgaaacgggccgtgccgtgtcggcccacgtgccgagccgccggcccaagcacggcccgtggatggccgggccgtgcccgtgccggcacggcacgcccgcggcccacgggccgttcggggcacggcggcccgtgaaggcaggccgccagcccacagtgcatgcacagtgtttttttttttaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaact

SEQ ID NO: 64429 - DNA, 1140 bp, Oryza sativa
  unsure (1)..(1140): unsure at all n locations
ccatgttgaattgggctaaactgtgtaggttaccagtttgcctctgacagcttgaagagatattggaaaaagtacaccgaaggtccctcaacttgtcatcgagatacaaaatcgtnccccaaccacaaaaccaaatatgtgactatccctaanttacaaaaccgtgggactacctatacatttgttgacaagtttttctccaaaaatttgacagatgtaattatagtacaatcgtagtgtaattacactgggacttatatgtaatcacactgtgacttacatgtaatgcagggaacttatctgtaaataccacatatttctgaatgccttgaccaattacaagatttgttgtggcgaggaacaataccaatcatgacgcacatgtgtgaaaaaaaattgctaccacaacgtccattcaccagaaataacatgttacagacagatttttgaaagttagatataagttacaccatagttacagtgtaattacatgcaagttacagtataattacactacgattgtactgtaattacatctgtcaaatttggggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggccggcgcggttgggctccatgccacgggaagctcgaccaccaccatggccccggcacatcgccacacggcttgctgcgctctgcggtcgacaccggccgccatgttatggggcatctcgt

SEQ ID NO: 64430 - DNA, 1364 bp, Oryza sativa
ccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcatatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttgggtcatcataacaactcattcccactggctgcagga

SEQ ID NO: 64431 - DNA, 1301 bp, Oryza sativa
ttgagtctaattatgtcatgattttgacaatgtgatgctacagtaaacttttgataattatggattaattaggcttaaaaaaatcgtctcgcggattagctctcatttatgaaattagtttttttattagtctatgtttaatactctaaattagcgttcaaacatctgatgtgacttgggctaaaaagttttagccccatctaaacaccccctaagcaaatccggcgacttttgctatctcgctgttctgattgccagcaaatttgatgatttggagctgctaagcaaatccggcgacttctgctatctcgctgttctgattgccagcaaatttgatgattgccactggttgcatgttgtttgctattgacttgatttgttgttggctgtgggatgtgaatccgatcgtcaaagcagtcggtttcggtgacagtcatagcagtcggtttcggtgaataatagcagtagtttggaaaagttttggctataggaatctttgcatgtcaatccgtgtgctacactgtttcagtgaaaagtagtagtatttttatgtcgtgctatgagtagtactccctccctccgtataagcatattttcaaatctgaaaattctatgaaaattctatttttgataagcatatttcaatttaacaatctatcatcttaatgactttctcggatttaatgtatgactctccattcttctatacaagattggctacttgagcatcgtgaaatgtaaatattaatgaatcgcatgtttacgaagaatgactaggagcatgtttaaatggatggtaaatagaattaattatcattggtctgtgtgccaagatgaaataagagctcccaattccataaaggctatagaaaaccgtgtaatacaccttttctacctttggacttttaaatggttctgacttttaccttgtccgacttgtccgatttctgctatatactctgtaaaactctgattaaatctttaccgttaaaatctagatctattattatccaatcgttaaaatctttttctttttttttcgattaacttgggaatttattccccacatagaacgtggtgtctcctttcaagactgttttaataatataatagatagatagattaaactgcttggggaaatactagtgatgtgatggagacgtggtacgtaccttgctagttttcacaaatattccgtacatataagtaggttttaaatagggatttactttgatgagagatgtgttgctggtttctatctcttcgagagtgtgttagggtggaaggtgaattcacgggtg

SEQ ID NO: 64432 - DNA, 2071 bp, Oryza sativa
taaacttcttacaaacgttttcaaactgtcacgtgatgttctacaaacacttctagacgtcatgtggcgctctaattaaaaataatctaaacattgatttttcttcaaattggtggaccaaataattttaactattagatcttaaaaaaaatctggctcccccacctccacccccaccgtatgtgaccatgcatgtacatgctccaccctcctactctcctctaggatcccattgtcctctcctattttctagctaacacaaaaatatataaaaaataacaatagctaaatgatgatgattctcaagttacatgtacttttctcaatttatttgatttcttgtgttattgataattaaatacataatccaagagatatattgcccatattaactatataaaagttacggcctcatcttttcgcttatgcttattagctaaaatttaaatttttaaccttaaatttggagttaattttgtggttttctatctaagtttatttttcaatatttgttttttgatcgctaagaacatgtatataaaaatttttcataaattattttttgtttgcaaatatgttgtttaacatgggaccgttagataatttggttgttttgactacaaatatttgagcaaaatagcactttaaaaacaatgaatgaattcaaatatgtgagtctaaagtccaggttcaatcaccaccaaggagcttggaaccatgatatatactctaaacccgatggaagcggagctacaagacattattagccagatagacaccgacgacagcggtagcattgacttccacgagtttctaggcctaatggcatgcaaaaggacaagtattgagaggaggggcagagggagatgttccgagtcttcggcaaggagtagaaaatggcttcatctctaacgccaagctcagtcacgtcatgtccaatgtatcaggagaggctcactaatgaggaggtcgacgagatgatccacgagaccgatggtagcaagcgtatcaactacaaggagtttgtatgtaaattcatagcaaaaaaaacaagcaaattgattaaaatatacactaaaaaatcattaaaactataaaaatacaacaagatttcatgtagaatataaaatatcaagagtccatataaatagctaaaatttggaataataaaataagtattaaaagaaaactccaaacacaacacgatacacactttaaaatccctaaaaagacaatttagaataaaacaataatttgatttgaatacatatttgaaattagacttaatcactaaattcgaaatacagtaaatatttttttaagaacttttctatctctatgcataacgaattgcatatatatgaagcaattgaagatagggttagcagggtgggaaaatatatttattatagtttgttgatatttcttcaaaaaaaaaagatgcaaggaacactcaattaaaaatagaaaacaccttattttaatttcaatttattttgttagaactattttcaaaacaaactaatacacatgcccgcgcgaatgcgcgggctatcttcctaattactcactccttcccaaattgatcatcatataatgaaatccaaaatttctcaaattgataattatataaccgcatggatacggattttaatggaatacaataaatgtagtaagagaaaatgtgtacatgctaagcgtgtaattgacatgttgttttaatcgatgcatgtattgtgggagaatatgtacatggtgtcttgattgatatgatttaaattattcttggtcttggtgtataaatatatacgatgatcaatttaggatggagggagtatataaaaggagacaataagccaaagtgataaattaatgcagtagagagagattggtgttgaagagcggatagtttactctatttaatttattactctattatattattgtgtatgtagagaatagtaaatagttaccatgaaattggggaggaattgaagttgaaggactccatgtagagggagaagagatggaggagagaaacacgtgagaattattatatcaggagtatcca

SEQ ID NO: 64433 - DNA, 1558 bp, Oryza sativa
catcacatatatactgcagcatgtctttccgcagcaattatgctgattcttgactggtatgtcgggcttgtccatcttcagaaactctgcaggaaactcgtgcatattactgttggcttagtatacttccttatgtggcctttgttcaggtaaaccagatcgatcgagttccagaccaacaatatactagcagtatctttaattttgtcatgtcatagccataccaagtgtgtttctgccttcctgacaacgtactcttcctgatgcagtgcggatgatgtctatgctccatttcttgcttcccttgtcattgcattcaacatcataaaggttaccttgattggacttggtattgtcaaagatgatggcgtcattaactccatgaccaggaacggagaccgcaggtactcatctcatttcccccctttgacaagctagtgggcaaagaaagatttggcattcttacgcattactgcaataaaaataataataatcatagttgtgttgcttctaccacttgattcagtaatccctttttgtttccagagagcttcttaaaggtccactgtactacgcttgtgctataacactcgctactgtaattttctggaggacatctcccatttcaatcgcagtgatttgcaacttgtgtgccggagatggtacggccttagcttcatctaatctcctgcagttgaaaattttctgctgatactgacactgttctatcgattttggactgctcctttcattcaccgagtgaaaagtttcagacgtcaactgacttctctacactgcttctttcaggtgtagctgacatagctggaaggcgattcggacatgtaaagcttccttacaaccctgataagtcttatgctggatccattgcaatgttcttagctggtttccttgcatcaatcctgtaagtaacaagttggagtatctaataggctaccctacatttctattgaagtcttggtagctgttaatctgaaactgctggagtacttgctaggtacatgtgctacttccacctctttggatttgtcgaggagagctggagcatggtgatcgcctttggtgtgacatcgcttgctgctgcaattgtggagtcactccctatcagcacacgcctggacgacaatctgactgtgccactcgcctctgtcctcgttggtgtccttgttttctattatactggggccagaaacctgtgttgtatgagcgctgacagcagtgacatttctgcacttgtgcagaatcagatggtcttggacaggttctagtgactactgactagtaagtagctgccctgcagagctgaaaagaaactgatttactaatatcagatttgattaatgtaacaaggatcgatacaagctacaagcatcatagttgtatcttgtaatcaagaaaaacaaaagctatctgatatactagtaaggcaaaagttgagtagaggaaaaacataccagagagctgtctacactccaaactaaatgtctattctgtatatatggtggttgtgtgcaagctgccagcgctttttgttttccct

SEQ ID NO: 64434 - DNA, 729 bp, Oryza sativa
tctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgtttcggggcctgccgccgcactttctgccggaccggccttgcgcccggccgcacggcaagacggtgctcaatcacctccctggggaccccgggcatgtccgccggtctccaggcgaagacgtcggcgtttgcccgcaggaaggagacgagcgcgtcttcctatttgccgtccagaagaccaccgattcatgtggtcttggacgggccgtcgcccagggcaacctctttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgtgactttgaggtcgccatggccagagatggggccaccggggcccggcatcttcatctggaggtaggcgtagtggaccgcccccatgaacttcaccaacgcgggcctccctaggacacgcgttgtaggg

SEQ ID NO: 64435 - DNA, 1361 bp, Oryza sativa
cgtggatcgaggagttgccagcggtgctctgggcgaaccgaaccacgccaagccgagcaaccggggaaacgcctttcttcgtcgtctacggcgcggaggcggttctcccatccgagctcaccctgaggtcccctcgggccaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgcggatctccccaggcactagccccgacccgcgccatttgaggctaggacctgggcacgagccctcgttcaagccaagacacagaaggactgcggcatagaccatcctcgtctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcggagtcgagggcgaacgcgagccgaggggccgtaccctcgaagctgtggacgatgtggtcggcggcgtcccggacctgtgcgcgcgcgccatcctcggttccaggagggaactcgtccagcgttgcccacggggagaagtcagggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccagaggctcgcctgccgcccggcgcggtctagacgggagacggcgtcccgaagcatgccgggccctacctcacctgccaagcggagggcctcgacctccccggcggacgagtccagcgcgccctgcagctcggcgatggtgtgttcggcggctgcaaggcgggcggctaggtcgccgtcacccgcgggcgccccgccgctgcgcgctctcgtgtccagctccttcgcccgcgcctcgaattcagcggcccgctgatccagtgcggccctctcggcgcggg

SEQ ID NO: 64436 - DNA, 3845 bp, Oryza sativa
ggggggagatgaggtttccccggcatggttcggtcccccccatcttgcggagccgcttcttttttcgctccccctcgggctgcgacgtcggcacagcacccttcgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggatcgcaaaccagccaggcggtcaagaacggcgtcgtagccgtctcccagatctaccggcgcccgccagctggaggcctgcgctgggggctggctcggaagtcggaggcgcgcttcgtcggcgagaggggtgtagaaccagtcgctcttccagtgatcccacttcttgcgaaggacgcagggaatatagcggttcagcaccggcccccgcggctggaagtagcagccaccgactaccgacggtggcgacaccggctgtacggtgaagaaccaccggaacaaccagagagatgggcgcaccccgatgaacatctcgcacaggtgcgcgaagatggccaacgtcattactgcattgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcagcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgccaactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacgaaccggctcgtcccaattcgcgcgctactcgagtaatgtagcggtcttgaagaaagccgctcattattgtcggtcggtttttcccttgccgatgcgcgcgatttgcgaccactggattcctgtccgcttttagagaccggccccacctgtcaccaggcctgaggagtggcgtcacgcccgagcgttttcctcgaggagggtgatcgccctggcataaccccgggggctactgtcggtgacatgggaccggggatatcttgactagaggtttggggcagccgcggtcacccacgtggcctgaccccctcgggggggtcgggcccaagggtgatgagaccgcccctccctctatctccccgaggggtcgggccgctcccgttttgtccccgagggctggggcgccccgaccccctgagggtttggcgccacgtgtgtgggttaggtgagcacagcggcgctcacctaaccgcgtttattgcgggttggacgagcgccccacgccgcatttaatgcagcgcagcacactcgttcggtccgtgacagggcacagtgtgtgactggtcacagaccggtcagaccgcgggttatgtggcaacaggcggcctttcgcacgccttgccccgtcctgtcggaatgatgagagcctctaggcactcgtccctagatggaaccggcgtgggaactcctggagttagcacgtcggtcccggctagattcataccaggcttcatcgcaaccattacaaggaagtcattttatgaagaagggctgacgtgtggcatgctaaactgacacgtggtagacaagaatgaccggtttgtgactggtctgatgccggtcacgtcatcagcaaacaaccgtgcttccacgttgcacttgcttccggcggagtggaggttggtatgacccatcccatcggagggtcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagaggggggactggagaaaagaggagtgagagggtctctagagtttgaactctcttgctctccagctctttgtaactccttcatacacagatccaccagaacacaggagtagggtactacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgctccgtcaatgtcctatacggaaacaacctacggatataggagggagttccggataaggaaagacacccagagttctacatggaaacgacaaggactactaggattgtatccatattgatttccctagttcaaattggacaaggggacacctatgggtataaatacaagcctccctaggaggacagggggacacacacgcccaccacgagacaatcaactcccaacacaatcaacatagaagcctacatacaccaagacaagccgccggatatcgacatcagagatacgcctggatcgaccctatctggtaccttcagaggccggccgtagggatctagcactgtctctgattccgtcgggtgcgagctcgaggaggaaggctaccctgttgtcgactacgagtcagaccttcagaccgccatgtcgacaacagttagataggctaccctacatattgtactggtgtgattatggtgaataaaaagcaacatcggctccggccaacaagatgtagggctattacctgatagctcaggggcccgaacctgtataaaaatccatgtcttcatctcttttacctcagtctcgcgtatatcctagcaccgatgatccacatactgtccaaataccgtagtcgagacatcaaacgtcgacagtggcgcgacaggtagggggattttggtgcttcaggatttcgacgagatgcgtttaagatatggactctccgacaacaagctactcgatgacttcggctgtgcggagatctaacccaactgaagtacatcttccgaccagatcggaaccatcatcgtcatcgacaacttggtctatcgagatcatccaagcctcaagatacgcggcgggctgcaggaa

SEQ ID NO: 64437 - DNA, 920 bp, Oryza sativa
tccgacgttaaaccaactacggtctaacgctgggggctcgctctgttctcttctgtataaatcatgcttgtttacggtttacataatgcctgatatttaatctgctcgttatatcctgataatactagaagatccacgcagtttttgagtacatactcgatatcccctgctatatatcttgtcttctagaaaataattttcagaaacaattgagcactcgagtaggttgtagtcgagtacaccgcattatcgagaacgatctcgacaaatgcagagtcgtcgcgcccaacctaccaacgaagaccgacgacctatctcatagctccggccatcgctggactactcgagaaaagtttgttaacggataattcctcgctaacgccgtcggcttgatcacccgacatgattgcgaacggacatccggatatgctataagttgggtatgtgagtcatgctggccacataatatgcacatataataaaccaactttaacgcccctataggtaattaagagactcctactcctggttctcgaaccagtaaaatgtaatgatctctctcgcctcactttaagtggtcgagttacgactactgcctggtcctcgaccagcggcgtagcgtttctcccactacttctactttcagtggtcgagttacgactactgcctggtccccgaccagcgatgtagcgtttctccggctacttccactttaagtggtcgagttatgactactgcctggtcctcgactagcgatgtagcgtttctcccactatttccacttcaagtggtcgagttacgactactgcctagtcctcgaccagcgatgtagcgattctcccattacccctacttcaacaaagttgatgtcaggtacacaagatcgccaagggttttacccagagatcccttacccagat

SEQ ID NO: 64438 - DNA, 1444 bp, Oryza sativa
ttcaactgtggcgagcttggccacttcgccgacaaatgcccgaagcctaggcgtgccgggccaaggtttatccaggctcgtgtcaaccacgcatctgcggaggaggcacaagcagcaccagaggttgtactgggtacgtttcctgttaactcaatccctacaacagtactttttgattctggtgcaacgcattcgttcatttcaaagaagtttgtcgggatgcatgggttaataagagaggaacttagcacaccaatgcgggttcataccccagggaatagctccacttcggttcaattcagcccttctataacaatagaaattcaaagatcaccgtttctagccaacctcattcttctcgaatccaaaaacctagatgtcattcttgggatggattagctgaccaagtttaagggagtcatcgattgtgtgaatcgcacagtcaccctgaccaacgagaagggagaaacggtagtgtacaaatcaccaaactcaccaaagcaaggggtctccttgaatcagattgaagcggaaatcccagtggtcaccatggagaagaatttgaggaaattggaagatatccccatagtctacgagtatccagaagtgttccccgaagacctcactaccatgccacccaagagagagattgaattccggattaacttggcaccgggaaccgctccaatttacaagagaccgtacagaatggcggccaacgaactagcagaggtcaagaagcaggttgatgagcagctgcagaaagggtacattcgaccaagtacttcaccttggggtgctccagtcatttttgtggagaaaaaggataagacgaagaggatgtgcgttgattatcgcgcactcaacgaggtcacaatcaagaacaaatatcctttgccacgaatcgatgatttgtttgatcaactgaaaggagctaaagtgttttctaagatagacctgcgatcagcctaccaccagttgataatccgggaagaggatattccaaagacggccttcaccactcggtacgggctatatgagtgcacggttatgtctttcggacttactaacgcacctgcattcttcatgaatctgatgaacaaagtgttcatggaatttctggacaagcttgttgtggtattcatcgacgacatacttatctattcaaagtccgaagaagaacatgagcaacatctccgtctggtactcgagaagttgaaggagcactagctatacgccaagttcagcaagtgtgacttctggttaacggaagtcaaatttctgggccatgtcattacagctcaaggtgtggcagttgatccatcgaacgtggagtcagttaccaaatggaccccaccgaagaccgtgtcgcagactcaaagttttcttggacttgcgggatattaccgccgattcatcgaaaacttctccagaatcgcccggg

SEQ ID NO: 64439 - DNA, 775 bp, Oryza sativa
cttaggatatcgatataactttcgatgaatatatttaatcattactcgcatagcatagccacatatattaggcgtgttcggaaggccaggccacaatcgtggcagcagcagccacatgttagtctgatgcttgcagcactgttgccgttggctacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaa

SEQ ID NO: 64440 - DNA, 737 bp, Oryza sativa
cggcgagctcggccccacttcttccgacgagcacgacgacgtggtggtggtggtggtggtcgtcgtcgtggacgacgacgacgacgacgacgacgagtgctgcgcgtgcagcaccgacaccgggcttgagctcggcatgccgcgctctgtcgccgccgctctcctcctgccgtggccgggatgctgcgcctcgtcgtcgtcgtcgtcgccgccgtagtgcagcttgcggcgggggcagccaccgctctgtttcttggctccgacgtgtccgctcttgccgtcgggttcgccattgtcgtggcgagaagcggcatccgggctgaagctgaggacgatgaactcgtcgccctcctccttcaagtacggcgccggcggcggcggccacccctccgccgagctcaccgacctgctcctcctcctccgccgctgccgccgcagcggctggcactccgtctccggcggcggcggcggcattgcgtcgagccccatcagcctggccacgacgcaggggctcatcccctcctcctgctgtacctgcacctgcaccaccaccgcaccgtcgtcgtcgccgccgcccgcattgccggcggcggcgtgcgcgcagagtaggcggcggaggaagtcgagagccaaggtggaggacgccatggcaatggcacctatggcagcatcagcttcgcaatgctgctgctattatatcttcttcttgcctccgttcttgattcgggctgcaggaa

SEQ ID NO: 64441 - DNA, 2680 bp, Oryza sativa
ttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtccttaaggtttgaccatttggcttatcctacagtcgagatggctctgataccaacttgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaaccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccgtgcagtaatcgatcttcaattaaccttcttgatcacgtccgacgcactcacgaaccttcgcaacgacggaaacgacaagctaacacgcaaaacgaagaaaaagactaataaaaaccaaataaacagtacataaaaagtaaaaaaacatgtagatcataattttagatgaattatgagacttgaacggcctcattccgacttcaaatgaatttattatgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaaggggg

SEQ ID NO: 64442 - DNA, 713 bp, Oryza sativa
atgtttgctgtctcagcatttggcttatttgttaacatcataatggctgtcttgcttggtcatgaccatggacatggacacggacatggtcatgggcatggacattcccatgaccatgatcatggtggttctgaccatgaccatcaccaccatgaagatcaagagcatggccatgtacatcaccacgaagatggccatggtaattcaattaccgtcaatctccatcaccatccaggcactggacaccaccaccatgatgctgaggaaccattgctcaagagtgatgctggttgtgacagcacccaatctggtgccaaggatgccaagaaggctcgtcgtaatatcaatgtacacagtgcttatctgcatgtgcttggggattcaatccagagcatcggtgtgatgattggaggggctatcatctggtacaagcccgagtggaagattattgatctcatctgcaccctcatcttctccgtgatcgtactcttcaccacaatcaagatgctgcgcaacatccttgaggtcctgatggagagcacgccccgcgagatcgatgccaccagccttgagaatggcctccgcgacatggacggtgtggttgcagcacatgagctgcacatctgggccataacggtggggaaggttctcctggcgtgccatgtgacaatcactcaggacgcagacgctgatcaaatgctgaacaaggtggg

SEQ ID NO: 64443 - DNA, 1491 bp, Oryza sativa
cccatgttggtctgctgggcgaggatttgggtgagaatggcgttggtatctggtggtgggggtggaggcgggggaggaggtggaggtgggttgccctgatggttgtggttgctgccttcaggttggttgccatcaccggtgttagcatttctcctggtcatcaccatctgaaaaccccacacagaaccagcaaacagagagagctgacaattaaagctaaccacccacgactaccataattcttaaatttattactgctattaaatgggttcattaaagttcaagttgcttaggcgaataaataaagacaggctccgacacagttacaccacacaccggcataaccgtgccccacacaacccaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactaacgaacaagctcaggcctggaggtgctcttgcgggcggtgatcttctggctgcggcagacgcggcgacgcttggggcggcagatctctccctgggcgatcttgagctgatgcagctgcgcctccaccgcgtctaggtccttcttgagctgcaggttctcctgacgcagctccaggatcttcaagttgttctcgaccatcccacggcgcaccatctgatggaagtcgatacgagccgcgtcgtacgcctccaccatgcgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaggcggcggggaaagagtctccacccgcggtgactgtcagcgaagtccgctcgggagagccagcgaggatcactgcagtgacctcccaagcagcgtggggctctgcatcgtccccctcctgctccggaagcggcctggcctggtagtccactccatgtggataccccaggaccacgcacatgccccgcagctccaagacgaaaccagtcatgtccaaaccacgacgggtgacgctgccggccatctacaaacaaaaacaaaaagaaaagcaacattttaaaggttagatttttggcgataaatgaagcagcaagacagagagagactagaggattttcacaaataagaagggattttatttttgaaaatattgctaaggcttgggatctacggctcgtcctagggtcaaggggggctctgataccaacttgtcacgaccggaaataacccaacgggcattccttacgtgcgtgcattaatccttgtcccaggaggcaaggtacaccaaaagttg

SEQ ID NO: 64444 - DNA, 3649 bp, Oryza sativa
  unsure (1)..(3649): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaggcccagcacacacaaagacaaacgagaaacagcggaagactagggcgacgaccacaggcacttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggccccagctcgtcccaagccaacccaggccaaccattccatattttagttgttaagcaagttttaagaattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaaaccacctaatgttacctaattaaatagcgaagcatctacctaaaatcatactagtggtaccatgagtagagtgttcactagttggggttttgttggttctagggtgaacaaggtaataataacaataacaataataaggtcgtaacaaaggtaaataggcatggctaaataaaacagtgataacgcgggaatttaaataaataggcggccataggcacggcggagcggcggccgagagaggggagggaagggggaaacgaaatggcggtcctcggctcaccccgggttgacggcgacgacgggaacggcgaccgaagcggagagaggcggcggcgcggctcgggtcgacgaggacgatggtgctccggcggtcggcgggcgaaacggaggagtggacgaggtcgacgagaacgcggcgaagccgaaggaggcgacgccgaagcgggaggaggtccggggcgacgacggcggcgaaccggagctcggcggcgacggcggagagagaggacgacggcgcgagctcgaatccgatggggagagcgagcggcggacggcggaaacggaggagggaggcacggggagcgtttaaatagggttgggagtgagagagggcggccggaggggaaggaaatcggtgcggcgatctcgggctccattgatgcgccggcgaagatttcgggagagtaaatccgaacgaatccgagggagagagagagggaaaagaggggggaaagagagagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcggggaggaggctgatgggccgcgggggagaggagagagagggagggagttgggccgagccggcccaagagaggaagggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattcttcgcacaatttcgaggatgtattttagagtcgatttgggacgcgacaccagagtaggcatctagaaaacacaaaaggtcgcaccccgcagtggagtcgactatctgatctatgcgtggtaaagggaagggatctttagggcatgccttgttgaggtccgtgtagtcaatgcacatccggagcttaccgttggccttcgggacgaccaccgggttcgccaaccactccggatggataacctcgcggataaagtcagcctccaggagccgcgccacttcctctcggatgaaggcctgccgctccggggcttgacaccgcactttttgccggacgggtcgcgcatccagccgcatggcgaggcggtgctcgatcacctccctagggaccccgggcatgtccgacggcttccattcgaagacgtcggagtttgcccgcaggaaggagacgagcgcgctttcctatttggcgtgcagggtcccgccaattttggcggtcttggacggatcatcgccaagggggatctccttgacgggcacctcgtcagccgaggtgaggcgcttcttggaggcgtgggacgcggaggcctccggggcctgtggctccgtggccactgccaggttgtcggcgcgctgctccgcgcaggcgagggtgactttgacatcgccaaagacggtgatgggacca

SEQ ID NO: 64445 - DNA, 713 bp, Oryza sativa
  unsure (1)..(713): unsure at all n locations
agcgagcactgtcaaatggtcgctctggtcaaaggtgagcttcacctccgaccagtgcgccttccgagccgcttcgtgggttgggacggtggctagaagctctcgccttatggccttgaagcctcggcgggaggtgtgagcgcaagccccccctccccncaggtcgagcgtggcgacggttccctgaggtatctggaactccagatcctcgctgttatcaccatcatcggtgggggccttcttcttcgcttcccctcgtcggtcatcggctggggtcgcgggggctttgccctctcgtcgaccctaccgcttctcctcatcggcttcccggaaccgctcggccaaaattcttgactgagcggcagtcggcgagactgtgctgataagtgttgtgcaccaagcaccacttgtctgccgaccggccctcaccggatggagcagtggagcttggcttatcgccggtggcctttcccttgcacggggcccatgagggcccatcagctgcaaggacatggccctcatcatcggagcgggccggtttccttttgcccctcctatctcaccgcttagagcggggaacagactgggggggtagccgcagccgccgcaccggtgccgggggagttccaggcccacgcctccttccaagccaccttgtccgccagctcgaacagctcggcggtggtcttgggatcttggaggggcgcaggaat

SEQ ID NO: 64446 - DNA, 838 bp, Oryza sativa
cggaaaaggaagggaaaaagaaaaagaaaaaaggagaaaagaattttccctagaattaaaatattgcttgctcaattttaattggttaaaattatttttagggctctgaaaattccacttaaaatcctgttagtgaatttcgacctgtagaactcaagaaaaattccacatgccaattccgattattatttgcattgatttaaaaggggtttactcttactttgcaccggtattttcttaggatcatttataaattaaatttaggcttggaaggagaacttcagggtgtgacacccgcccccgggcggagggaggccacgacgcgtcggggcacgacgccgcctcacttacggtgacggcggctcgccccgaggcgcgcttcaggcggcgggtgtccttctgcggcatccccccgtgaactcggagccggagacccctgtccagcgctggttgaacgacgtggccaacttggtcaccactgcccagcggcagttagccgcgggcggccgagccgccgtcaccggtacgtcgcatacccccattgccctctcctcgtcagcgaggaggagggcccatcgatcggccacggccttgaggcggtccacggctccaacatcgtcgggggcctcgggaagccggaggcgtcccgacggtctctacggggagcaggacgctcgaatcaatatcgagcgacgccgggacgagcgccgagctgcccgcatggggaaggcgcctcctcatctggagtgccgcgttcctccccacgagacggccctccccccacgctcagccctggagggactggttgtagggcattcgtggcgagtcttcggaatgt

SEQ ID NO: 64447 - DNA, 738 bp, Oryza sativa
attcctgcagcccaggccgccttcgggcgcgccccgcggctgccaggtggggcccggccgtcagccgcccgcgccctcggtgcggctgacgcgtgggacccacggcgccggccagcgcaagccgcgtgcgcccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttatgaagtcaagaacccatttttgtgctttgtttctgcttgttatatggagtttagtagagtaaaagccttttcttttccgttggtcgtgtagacgctgcagcttcggaagatccgctcttcgtggaagttgaagccggtgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttacgaccttattattgttattggtattattaccttgttcaccctagaaccaacaaaaccccaactagtggacactctactcatggtaccactagtatg

SEQ ID NO: 64448 - DNA, 1061 bp, Oryza sativa
ccccggagcggagtgacacgaagatacacgtaatcccctgcctcaaaagtgagctcccttcgacggttatccgcgtagctcttctgcgagactgggcaatcctcaacctttccttgatgattctgactttctcttctgcttccgctaatacctctgtcccgaacagttgacgctcgcctgtctgatcccagaagaggggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaatatatcttccaagatttgattgactcgctcggtttgaccatcagtttgcgggtgataggccgtgctgaaatttaaacgggtccccaattcttcctgcagcttctgccagaattttgaggtgaactgactccctcggttagatacaatctttttgggtactctatgtagacacatgattctcgagaggtagagctccgccaaccttttgcccgtatacgtggtatgtactggtatgaagtgagcaaccttagtgagtcgatccatgactatccagattgaatcgtgacccgatgatgtccagggcagtcctattataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatggatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctactctgactttatccacgagcgtaggccgtgcc

SEQ ID NO: 64449 - DNA, 761 bp, Oryza sativa
gaaagaagaaccagaaacaaggtcaccaggttttgccgagttcagtggagtcatcattcagaagaggaagcaacctgggaaagggaggatgagttgaaagccgcccatccgcacctcttcgccagctcctccgaatctcggggccaagattccgtttaaggggggtaggtttgtcacaccctgaagttctcctcccaagcctaaatttaatttataaatgaccctaagaaaataccggtgcaaagcaagagtaaaccccttttaaatcaatgcaaataataatcggaattggcatgtggaatttttcttgagttctacaggtcgaaattcactaacaggatttttagtggaattttcagagccctaaaaataattttaaccaattaaaattgagcaagcaatattttaattccagggaaaattcttttctccttttttctttttctttttcccttccttttccgaatgggccgccggcccattctctcctttcctccccctcctccctgctgggccggccgcaggccgaggcccagccaggccgccccgccgccctcctctcccggggtcgccgacaggtggggcccacctgtcgggtccttccccaacctcccgccgcgccgccgcgcccgcaaccgccgccgcgcccacgtctccgcctccttcgggccacgtcgaccacgcccgcgcgtgcgccgcgttccccgcgcccactcccctctctcacccgctcgcgcccgcgctcgagatggccgggattc

SEQ ID NO: 64450 - DNA, 1505 bp, Oryza sativa
gtcaaactttatgcaagctatttaagatttgaaattttgcgccatgctgctatagatgcatgaattttatgaaaattttgtgagattatcaaaattttatgaattttattattatctctacacaatatttgaaaatatcgtaccactcggtatatatgcacctattaatgtgggtagaaaaatattgaaatgttgaaataaacggtgcatgtattttcccacagttgccaccagtatatattacatatataaatactgaaataaacagcttagcatccaggcatctttcatctttggctctttggtgatagactactgcttcattattcaatttcatttcatataatatatagtacttgcatgttgattagaagatcttcttcttgttgcttctgttgtttcttgtaaatatgcatgacttctttttttgtttgttttcatacttgggcatcaattatttttctattattatagtgctcacagattatgacgatttcatcacgtcaatctgatatcattcggttctcactagatcttcccagctggaagtagaaaatgcacactttgttatcttttactaagaaattactggttggcaatacatgtcaaagatttatcttgaccttgctactagggtaattcaatttgcaataatccgtagaataatttaactccctaatatataggtttgcattggatgggaagaaaatgactgccgaatctatgatggagtaagcaaaaattaacaagaatttatatgatcgatacaaggacaatcgatctcggctggcccacaaatttcaggtgtgaagtcatcagtcgcatgtttagccaaaatctggagagaccacttgacacacgcaattaatatattccccagtacagtctaaagaaccaatatatattatttgatacatatgttaatatatatactgatgtgactgacaaatagacaaacgagattaaattgtgggttttacaatacctgaatcatccttaagaagcaaaggattatacagcagtgactgatggtgattgattcaacggtgacttttggcgatatgttctgattaaggtcgtccatgcatcaatatcgtatcctgacaagtacgtgtatcacataattcttcactagcttgatttttttatgttgttacttagtaatatactacatctttttctaatatataataccgtttaccttttagcgttcgtttgatcattcatctttcttatcatgaatattcacaaacataaaaaatataagtcatatttaaagaaaccttaattgtaaatcaaatcacaacaaaataaatattaattacatatttttttatataagtaaggttaaaaaatcgattgtatttttaaaagttaacaatatcatatattaaaaattatagtcggagtaatataagctagccccatatatatatatatatatatatatatatatatatatatatagagagagagagagagagagagagagagagagagagaga

SEQ ID NO: 64451 - DNA, 3214 bp, Oryza sativa
ttaagcatgacataagtatttttgtatttgtataaaaaatttaaataagatgaatggtcaaacgttggttaaaaagtcaacggcgtcatacattaaaatacggagggagtataatggtatactatttcgtatttccggtaaaaatatgagctcatttagatgagaaatacaaataaaagtcacggacaaccctgcgatacaaattctgtactctatgtttgactttttcttttcatgtaggtgtcaaacatatagctggaaatatgtttgagagcgtacctaatggagatgcaattttcttgaaggtaagatgaataactagacgtaacatccatttccccttttattgagtatttaaatgttaactataagatagcatggtccccatattaattactatttatcttacgttcataaaaatctatgtgcactgacacaagatgtgtaaaacactattccattatcttaaaatttaaaaagaaattatcgatagcacaagccgatccataggtataatatatacttccttcgtccctaaataattgacgccgttaaattttttaaacatgtttggccgtttatattacccaaaaacttttatgaatatattcaaaaacttgagtagtattagtatatttaacaataaatcaaatgatagaaaagaattaataattacttaaaactttttaaataagatgaacggtcaaacatgttatactatttgttggtccattctttcataaaatgaactatgtttcattttggaagagcaaaggtgcgaaacttagttcattactttactttaaagtaggttgggtttaagacaaaggagtgagtccggctaacaccgtaccaaccctgaaaagtatatatgcattatattttaaagaaactaattatggtcagtttaacatataatacctcaagtcattctaatattttccacattcatattgatgttaatgaatctaaatataacttcaatatgaatgtgaaaaatgctagaataacttatattgtgaaacgagtcgataaataaccaactaacgtggcttgaatatatgtgcatgcagtcgatgctccacctacataacgatgaggactgcatcaagatcctcaagaagtgccaccaagcactcacacacaacgggaaggtgattgctgttgagatacttctcccagcgattccagagccggtcccaacagcacaaaacccattccggatggacatgatcatgctcaacaatcactggggaggaaaggagaggacggaaccagagtttgctaagctagccgtggaatgtggctacaccggtgtatttcaagcaacctatattttcgctaactattgggctcttgagttcagcaagtagttcttcaaaatcatgttaatttggttttatatttattatgtatttcaataagtatatatggcaaagagtaattccgatgccatgcaaatggtttgaaattgtttttacttgtgtaataaaaatataaattaccccctataaatcgaacatcgtactgcaaatggctcatatatatatatatatatatatatatatatatatatatatatatatatatatgtatgtatgtatgtatacatgtacatatattatgtatatgtatatgtacatatgtatacgtatatgtatatgtatatgtatatacgtatatgtatgtatatgtatgtatatacatatatatagatatatgtatgtatatatatacatacatatatgtatgtatatatatgtatgtacatatatacatacatacatacatacatacatacatcatatatatatatacatatatatatatacatatatatatatatatatatatatatatatatatatatatatatatacacacacacacacacacacacacacacacacacacacaccaacgagcggtgaagtttgacactcaactataataagtatgccctaatatgtatggtggcaatcagctgcaacatcataaatctctttatactcctattcctatatactggaataatattatactacagcagttcaagcaacaagctagaaaaaaagtaacaaactcagcgtaaaagtggaattgttacaaggatcagttaaatttgatcaagttaattacagtgtgaatgaattaatttaactggcgacgacagtttcagccttttatggcggtaggtgtgaaatctttttcctgtgtacacacgatccaacggctgttcgtctatatatagtttagcatgtacacatgcataagcataatgcatacgtacatgcgcgtgcacgtcatcaatgcatcgatttcatgctggatgatattccctccgttccacgttttgatctcttaatataaaaatccatttacatccgtatgaatttggacacgtggtatattgtaaatagacccatatataaatttattcaaaacctaaccaaaacacttataatttaaaatagagaaagtaatattaatatatagcaactgctatttaatgtttgttaacaaagatctggtcaaaattttaaagatgtgactgtcgatagtttatcaaatgattagtttaaaaagaaagtaaatggcacgtgtagatttatcttaaaaaatattattataaattatttcctccgtttcacaatgtaagtcattctaacatttttcacattcatattgatatcatgaatctagatagatatacattgtgaaacggagggagtattagattctataaacttatttaataaaaaatcagtcaaaattccaaaagttggtcttgtccttcatgtctgacttgtgactataggagtatatatagagtagtcattccattgtaaaaataaaccaatatggagtaataaatcaatagtactacacaaactcgattggtttatttttgagcggaggaggtatatataatatatatttgcattgatcagtgatctagtaactgacatttctattcaatatgagaagatggacagcccatttaatccgtttgtttgttgattaattaacggattccatgtcgtcgacaaaaagtaaggagaaaaatataataaaaccttaataaataaatgattgggcttgttaatgggcttcctcttcctgggcctgagcggtggcgcgcttgggccgccggcccatctcgtctcatctcccccgtcgccgtcgagctcgacggggaccgactcgttatcca

SEQ ID NO: 64452 - DNA, 2287 bp, Oryza sativa
taaccacacaggggatggtcctcaagccggcaaccttcccatgtgtgtaccacactccgtcttcgtaaaactgagagacgtagtctatggagagcggattgtgagtgtgctcctcatgcaagtcatctccaaagtccaagcgaatactgaggagccgccagaattgcctcctagagatagaacactgaagggtgtcggacatccacttcatctcactatagtctccagccacccacactgtagcatagaactgtcggattaaatcttcattgtagtcttgtttgagagtcacaatccgtcaatgccaacagtcttgaagagatcctgcaagccctcaaactctggagtctcattgatgtctctccaagaaatccacttatgctctgcaaaagctttccctgcataaacttgctcatacacactcttttggaaagcggtgtgaaaacggggattccgggtgtcccgaggcctcaaaaactgatcatggtgcctcaaaatggtatactgcgatggattcctcatgttcacaacaaactggatggagggatcaatgtgcatatcatcacttccttcatcctcatcctctccacttccactgacatcatctccactttcctcctcactagccccctcaacattggcctcaacctcttcatcactttgagcgtactcatctccgcttgactcctcactcacgggatcgggcgtgggctcacgacgactatgacgagtgcggggaggcatttgctgtcaaagagcaaaggatatgggatattagcaataacttttagaagacactatgtttaggcgaaaaggaaactgcacactgcatgtcaggggcggtcagaccgaagtccagcggccggtcagaccggtggataacggccggtcagaccgccgtccacatgtcggtcagaccgtcggccgagctcggtcagaccgtcgaccgctgaccgagctcgatcagaccacctctgacaagtgcacaagaaaatcccttttaccatcacatacaaatgactctaaaaatatttgctacatcaagattgcacaagattggaactagaacatcaaaggattggacctatttcatcaagattggaacaactacccatagccctagggtgaaatagatcgatttgagagaatgcacaagaggaagagtgatttaccggttggaggagttgaatcacaccaagaaactaccctctattggtgcaaatcgaagaacacctcgtgcttcacctagggttccatgccatggatcaaaaactcaacaaaaacacgaactgatacatggaatagagagaggaagcggaggagaatcacttacggtgtaaccggagagaaatccacggtcaaaccgaggggatttggtggaggaaagagttagggtttaaggggaggtgagagagagagagagagagtttttcgagttggggatgaatggggatgagataggagagggtaggtgcgggatggagaagaaaaaggggcaaaactgcctaggcccacctcagccggtcagaccggccctatgtggccggtcagaccaccgcacctggccagtcagaccgcgcatatagcgccggtcagaccgccaggccccctgccggctgtgcacagcccttgcacaagccggcaaccccacacaataaaattcaacaagaaatttgattttttaaagcaatctttgaaatgtgtgagtataaatattgctaaccacccataatatttaaaaattataatgatttgcaacaaaactcacttaagtgctaggaggtgaccttttatggtatataggggtttttgggctaaattgtttttcaaataacttttgaaatatttggtttttgaatatgatttgaataccaaaaacatttcaaatcctcctctttaccaactttgttttgaaacttttctcaaattctctctcaatctcattttggaggaaaatctcattttggccaaaaataagaatatagtttcttcaaaagagggccaaaagggcattttcatttaaaaatcattttccttgcaatgtgaggcttggaaaacatataggaaaccttttgaaacattttccaagagatagttttcaaattacattgattttacaaaagttttgacttatgttgacttgggcattttgaaaatactactagcaccactagttgatttgctcacatataaagggaagtagagcacatgcaagagtgcaaaactcccccttaatgtgacatgctccattttcgcaatgaagaatttagtggcaacaaatccaaag

SEQ ID NO: 64453 - DNA, 930 bp, Oryza sativa
cttaggagcggcttgaaaccgtgcacacatgcaaacactaaacatgatatccggcctagatgcagtaaggtaaagcaagctaccaatcatagaacgataaagctttaaatctaccggtttacctccctcatcaaggtcgagatgcccgttggttgccataggtgtcttgatgggcttcgcatcctccaagccaaacctcttgagtagatccttgatgtacttggtttggctcacgaacgtcccatccttgagttgcttgatttgaagtccaaggaagaagctcaattcttcaatcatggacatctcaaattccctagacatcatatcaccaaatcccttgcaaaataccttattagtagaaccgaaaatgaaatcatcaacataaatttgacacacaaagaaatcatcaccaatgatttttgtgaaaagggtggtgtcaacttttccaattttgaaatcctttgacaaaagaaaatctctcaatctttcataccaagccctaggagcttgttttaaaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaagcataatgcaaatgcaagaaggatgcgaatagcctcaagtcttgccacgggggcaaaagtttcaccgaagtccaaaccttcaacttgtgtgaaaccttgtgccaccaaccttgccttgtttctcaccaccaacccgttctcatcttgtttgttcctaaagacccactttgtccctatgacattgtggtctctaagtctttcaaccaaagtccacacattatttcttgcaaagttgttgagctcttcatgcatagcattcatccaatc

SEQ ID NO: 64454 - DNA, 3041 bp, Oryza sativa
gcggctgcgctgacgacgacgaccggcgcccatacactgctgcttcggtctcgcgcatggcggcgccgcacaacggaggaggaggacggcggcgggtttcggggcggcgaggtggtcggggcggcggctgcgggcgctgccgccgcaggtgagcgagttcctcagccccgagcagctggtccccggctcgccggccgacaccggcgacgtctcctccctcatcccaatcaggcaaagtactctatacatattgtacttcaccagcattatcctactcgctccgttctatattataaatcgtttaaattattttttatcaattttttttaggtttgatcaaatttacagaaaaaattagcaaacatttataacaccaaattagtttcattagatttagcattgaatatattttgataatatgtttgttttgtattgaaaatgttactatatttttctctaaacttagtcaaacttaaaaaagtttgataaaataaaaattcgaacgatttataatatgaaacggagggagtactaagtaaagtatatactggtacctgcaatacttgatagcaaaatcaagcaagtacaggatgaaatacgtgattaacttatgcttaagggttaagactctaattttaggattacagagctaatcaatacattgtgttaactaactttaagcttatatggcatcagataatattacaagacatgtatatatattaccaatgaaaataacaaattattccttggccttcgaagaagcagcaagataatgtcaggaaagacaatgttttgtatgaacaaaatataactgtatgattgtatcttatatgaaagtgggtgtaaatttattgtgttccaatgggctatgaaacatccaaattctcatctttaactgggccaaactaggccttgctgtgtcttgggctaggtagaacctgggttgggcttgggctaaccaggtcattgttggaagtgccttagtttcacatgattttttatttttgtgcttagcattttttatctccaacaattgacaaaaaccaggacttgatagtcactgtatggtcagtgagctcagactcaaaacatgacagtctagatggttactgtattttacaccagctgcaaaaacatgcgatcaatacgcatctaattaacagcataacctcacatctgacaaatgccacaaaattcaggactcattgatttttgcctctctgttttttctttaacttttgttgatggatgttcttgcgcctgtgtgcaaaatgcagtgctctgatgctgttcttctacttcgtgtccaactgggtggtgcctgagttaatcatgaaggatttgcaggagcccaaaaaggctgaagaatcagaagaagctgcctcttcaccggcagcaaccatgtcggtcgccggcgacggccaacctgaagctaaaatcagactcaaggtgaagaagacaaagaagaacaagaaggctgccatgaaggtgtagtgcacacaaacatgcatcaatataatgcatgctagtatgttattgcccccctcatgatgataatagatagcatcatcagtcaaagatcacactaaagtgctaattataatcaaagagaagattaattctccatcagaaggggggggcttacatatagtatgtactcatcatgttctgaatctgtgagccattcaattgaaagataattattccattgcatatttgcatctatgcttagctagccagtactaagtatcaacaacagctagcactagctaataaagttttgggagaagaatgaaaggtggagagggcattggtacaaacaggtggggcttgtattgtggtagcaggcaaaagtgggcaaatcagtcggttatcagtgtggtgggctgaactccacaaaatcctctcatcgcatcaactggttgttgttgttgttgttgttgccatcacacacaacagcatcaatgggaaagcttaggcatgctcagctcaaaagtaggaagggaccaagggcaggcaggatcatcaacttgcaaagcatgtgtaggtttcagtttcatggttcaattcaacaatcaacaccaaaaacacttcatggatcagagagattttttaatacgtgaaaatcgttcgttagcgcctttttaggaacaaattaggaatgacataggattatttgaggaattttttttcagggtatggaattctaagaatcttatggagaattttatccatgtggctctctcaaacaaaagaatgaacttttctgcatagccatgtgttcacatgtaataggcagccacacaggaaatctaacagaaggtcaaactttctttaatactctctccaaattcatatagaaatttatccaatagctcaattgagcaaatcatattctgcaattccttatgattcaacttggcgagccacttttgttttgtatttttttttatatggcagattccaccagagtgtaaatctgttgttccagaatttcgcaatttgtccggtaccatgcccttctagaatatctgacgagaccaaaatatggaggcataaccacttgcaatgaactgaactgaaaccatatgtaaagtatgctgcagagatcgatgaaggatgatagatagatatattccatttcttgctttgaagcaacagaacaaaaaaacccacacccacacatcactcctcccatttcgatcagaaataggtactgcaaaatcttcctgcttgcttcagaatccagaactctccattaatttctcgaaacaactgcctctagtacagtacagtgatagaaaaacataacaaaatgataaagaaaaagagagcaggattcagtcaattgacagccacagataaaagcaagaaacatttttctttcactcctgccgattttgtttctgaatttctgatgacagttaatttttgtggttaaggaggagtccagaacatcagatgccactagaaagaagatcattcaaggcgatgagtggtagaaaatcatccacacaactaaggccagggtaaagcca

SEQ ID NO: 64455 - DNA, 1228 bp, Oryza sativa
gatttcaatgaataaacacgatatggtgtactacaattaaataatgtatagaattgagaaaattactaccttacaaagatgatgttgtttttctctctcaaaatttttagagaatcgcaccacgtataagtttaaagcacaccaccattggcactaggggtaagagtttgtaggctagtgaatgtccgcgtattagttttggaaagtttatcatgtcatagggctaaaatataaatagttcatagcgcttagattaacactttatggtatggataccaaagtctttccatgcattattgctttctcgattggtttctaattatactatctaataagtaaattattcgagtttagagaataaaagatacatggtacaaggattaaatgttgtatagattagggtaaatcaccttacaaagattatattgttttttttactctcacaattttttcagagaattgtaccacatatgagcttgaggtgtgaatcgcaccacccttactctaggatttggagctttgtaggctaaagaatgtccatgtgttagttttgaaatgttgatcatttcataggactgaaatagggatagttcttaagagcttacactaacaccttatgatgatggataccaaagactttccactatgctagtgggtaacatgtttttggtccccttattcgatgtacaatgaattgaacaatgttgtttcttatccaaccatgtaagtgatgacctttttcttataaaggggcaatgactttaaagctagctatttattctaaactttatattcttagagagttttagtccgctacaacactagctctctatataaactgtaacatttatctgatttttcttcctgtagatcaatgtgattgggattatagttattatcgtgtgattaaatgcaagttgtacatctttatatataacaacataagttaactagagaaacaaaaggtataattgcaataatgtttgaaccttctaccctgcttcaacaccacagaccgaggactgtgatggtgaaccttcgttatctattaacgagttaggagttgcaacgccacgactccttatcacctgaatgcttataaaggtggctgagggttagtccaatgttagtcttagcttgagtggacttatagtccattatccattaaagttatattccataatgagcatagcaaagtttacctctcgattcagcttcattatggtgg

SEQ ID NO: 64456 - DNA, 1762 bp, Oryza sativa
gcgcgccaccgcggcggagaaggccatccggctgctgctcaagtcgccggccgtgtcgccgtcgtcgtcgccgaagaagtcggcctcgccgccgtcgccgccgccgccgcaggaggcgaagaaggagtacccgcctgacctgacgctgcccgacctcaagagcggactgttcagcaccgacgagttccgcatgtacagcttcaaggtgaagccgtgctcccgcgcctactcccatgactggaccgagtgccccttcgtccaccccggcgagaacgcgcgccgccgcgaccctcgccgctactcctacagctgcgtgccttgcccggagttccgcaagggcggctcgtgccgcaagggcgacgcgtgcgagtacgcccatggcgtgttcgagtgctggctccacccggcgcagtacaggacgcgcctctgcaaggacgaggtcggctgcgcgcgccgcatctgcttcttcgcccacaagcccgacgagctccgcgccgtcaacccctccgccgtgtccgtcggcatgcagcccaccgtatcgtcgccgcgctcctcgccgcccaacgggctcgacatggcggcggcggcggcggcgatgatgagccccgcctggccgtcgtccccagcgagccgcctcaagacggcgctcggcgcgcgggagctcgacttcgacctcgagatgctcgcgctggaccagtaccagcagaagctgttcgacaaggtgtccggcgcgccgtcgccgagggcgagctggggcgccgcggcgaacggcctcgccaccgcgtcgccggcgagggccgtgccggactacaccgacctgctcggctccgtcgacccggccatgctgtcccagctccacgcgctgtccctcaagcaggccggcgacatgcccgcgtacagctccatggcggacaccacgcagatgcacatgccgacctcgccgatggtgggcggcgcgaacaccgcgttcgggctggaccactccatggcgaaggcgatcatgagctcccgcgcctcggcgttcgccaagcgcagccagagcttcatcgaccgcggaggccgcgccccggcggcgcgttcgctcatgtcgccggcgacgaccggcgcgccgtccattctctcggactggggctcgccggacggcaagctggactggggcgtccagggcgacgagctgcacaagctccgcaagtcggcgtcgttcgcgttccgcggccaatccgccatgccggtggcgacgcacgccgcggcggcggagccggacgtgtcatgggtgaactctcttgtcaaggacggccacgccgccggcgacatattcgcgcagtggccggagcaggagcagatggtggcatgatcatcagaggctcatagcaacctagctaaccaaaaaaaaagaagttctttctttcaattaatttttccccttcgtttgcttaatttgattcaaatgagatggttttttagtacatatttaagctgttcgcaaataatattgttcatcaacaaagaagcatgtatacccaaagggagctctagattgatgaagaacagctgatatttactctattaatttttgcccctctctttgggttttataaaatagttgtatacaagaattccaacaagagtttttattttactcgatatatattcatatatatctttgggcatcagtaagattttgatccatgtgctgtctgtcttatgttattaaccatgcaagattcatgttgttcatcaggaacatatgcttattatcagc

SEQ ID NO: 64457 - DNA, 745 bp, Oryza sativa
atgctttgttttgcatatcgctgtccgttattatagaccttggtttctgctggcacattgctctcaagaacacctgaagaaaccaagtataagattcaacacactcgtcggacacaataccacaggcaaaaatagtggtttgacgatggtggttgagcccaacaaagggaataaatggcatgttatatttgttcatcctttgtgtgctatcaaacacaacaacatcaccgaacgattgatagtccatgcgagactgagcatcacaccaaaacagatttttcagacgaccttcatcatcaacttggtactcatagaaaaaaccaggatccttgtcccgccttttcttcataagttctaaagttgcacttgcatcaccttccaaaattctagacctcttataccttgatgaataattgtacaagtcctttttgacaaatcccaccttatcgtatcctccatacttgcacttcatgaccttcattatgacattttttcgaataccaatagattctagtgaatgtatttcagatttttggaagtccttaattttcctatgagaccgaagaaatggagtcccgtcgtggctcgtcaatgggtggttatgctcatcaataaaattgtctacaaaccagataccatgtttcttatcaagcttgatgctaagactagcagcgcattccatttgagtcaacgctctttcccttcttacacaatcctcaggttttaccaaactaggatctcgaat

SEQ ID NO: 64458 - DNA, 756 bp, Oryza sativa
ccctatttgttttctgtttgttgttcgtgctcagcactaatgattgacaaaacaaaatccagggaaggtgtgactgctgttgaggaacctgtggactgcccaaatgtctcagaaatttcctgcaaatatgctctgatgttccaagactttctgcagtcatcaagcttgcctgtgtggaacagagttgataattgtggattttggcgtcaattcacagtatgatctctcaaagcttttcaactctttcagtgggtgcttatatgttcatttcctgttggtatattatacactttatttgaactattttagttctgggataataatttctcagactatggctgctgtataggttcgggagggaagatgtcaagctcaagctgttgcacagaatgcagaaaaccaaatatcagaagtcatgcttattgttcaggtagtacctcattctcaaatagatggtgctttagaatgtgctctatcaaacctcataaacttttggtggagaatataaaaaattaatacattaagacttctcatgtcaaaatgacattagtagatctgtgacatctgtcatgaaaaatatatttttagtagttgtgaaaaacataatactataataagtactggttcaaaggtgcgtgacaagggaacagaaggattgtaacatcaagaatcaaaatgcattgtatactacgagtcctgtagatcacatcagtgcaatacatgttcctactggcaggattgtctgacttcctatgt

SEQ ID NO: 64459 - DNA, 1055 bp, Oryza sativa
tatcgatgtattaaaattgacggcacaaagcaaagagaaagaagacggtaaaactagtgctttaatttagaattgatcgatgtgtagggcgattaaatttgctagtttattttctagtttcgccgtactattaagaggggtaatgacctagcaaagagatgattaaattgctacattaggtcattgcattttcacttgtgctcactttttcatcacacacacaaaaactcacctttgctttcactgagctcggcctgaccaggggcggtcagaccggccacatagtggcggtctgaccggcatgccctggccggtctgaccggcctcacaacggcggtctgaccggcccgtaaggccggtctgaccggcggcacatgcccggacagaccggccccctggaggccgggatgctgctacttgggatggccgatacagagccgacggagccgtattcggtcagaccgagccgaggccgatctgaccgcccactcaacgccggtctgaccggccaggcagatggggccctctgacagcactacaacggctagttttctagccgttgcagagtagcacggtctgaccggccatatacctccggtcagaccggcagagcacaaagttgggggatttcgcccccaatagctagttttggtggatgggagtataaatactcccccaccaacagcaaggggactcttttggcacccaattcaattgcatacacccctttcatctctctgacacccacttgagttttgtgttcatccatctagtgtgttagaggtttgatctagccataaatcaagtgcatttgcttccattgtagagctagtgtggcacttgattgatcatctccatgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctctgtgggcgggc

SEQ ID NO: 64460 - DNA, 1241 bp, Oryza sativa
aatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaagatggcgacgatcgtgaacacgacggaggaggagccgatgctggccgtggtgcgcttcaccgccgagctggcctgggcggacgccggcgccgacgtcgccgagccggaggtcacccgtctctgcgtcgaggcgcagcagcacatcctcgccgcccgctggctcgacatggcctccctcatgctcgcctccgccgacctcctcctccaatccacgcgcctccccgacaaggacaaaggttcttcccttccctctctctctcccctattgaatttgagaggctcatgtggctgctgctcatcctttccaattctagatctcgagtgcatc

SEQ ID NO: 64461 - DNA, 1101 bp, Oryza sativa
agtggatcccccaccccctttcctctactggaagatccgtgattttgcgcatgcgtaccgctccgggatcacaaccccgtctgttgtcagtagccccattggattgaacaaatcattattttcttctctgcctcccctcctgcatgtgtgccacttgactttcttcttgttgcataggttgcggagcatatcattgccggtgtggaagagtggagcaacaagaagcctcccatgcctatgttggtttattttaacgcagatgatctaaggaaacaagctgaagcttccacaaagagatttcagcaaggttttcccttctctaaaatcatgatatttttgtattgttgacttttttatatatatatttgggttaaatactttcaaattgaaactccaccatattctatctcatcttcttgacatgtgatggtgctccttggctcaggaaacccaatttccatcttggacgggatctttatcgccattaaggatgacattgactgcttcccatatccatcaaagggttagttaacagactgaaggggcctggcaatttggttgctgtatctgagaagcgtattccaacttataccttttttttaaaaaaaatacaggtgctactacatttttcgacaaaattcgctctgtggagaaagacgcagtttgtgttgctcgtttgcggaaatgtggagtgttattcattgggaaagctaatatgcatgagctaggccttggagtaactggaaacaatccaaactatgggtatgcattatcatcatgtgactgcttattttgttcagatcccttagctagtatctagggagcacctgacggtttgtgtggtcacaaatgagaaatatcaacaacattttcaaggccaaacagactgtattattttattagctgtttcctagaatcaaattaaattgagcattagtaaatctagttgactaaccaaagtactgggatgaaaataaatattttgagctatatcagtcacatccaaatctaacacatttttttaaaagattaggaattcaaaattttgatccaatcttaagtgatagtccaatttactgttttctgatgcctagtgtagtg

SEQ ID NO: 64462 - DNA, 1339 bp, Oryza sativa
ttcgccgcccaccagctgcatggacccgcatctctatggtgggaccatttccaggctatgcagccggagggacagcctgttacttgggcccgcttcaccgccgctttccggagaacccatgtgcccgccggagtcgtggcccttaagaaaagagaattccgagagttgaagcaaggcaaccgctccgtgatggagtatttgcacgagttcaacaacctggcccgttacactccggaggatgtgcggaaagatgaggagaagcaagaaaagttcctggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcaacagaatcaacaagggactcgagcgccccgtcctcctacgccaactgtgcagcctggtcaaggccgcagggacgcttcaggtccgcagcgtctgtgcttcaactgcttcgagccggggcactttgcggataaatgcccgaagccaaggcgtcagcaaggccaagcgcctccccgccccaacaacggtggtaaggacgtcagtcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgatcctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagataggactgtcagaaatccccatcgtcagagagttcggagacgtgtttccggaagaactacctggtatgccgcctaaacgagagattgagttccggatagatcttgctccaggaaccactcctctgt

SEQ ID NO: 64463 - DNA, 1927 bp, Oryza sativa
tcactatcatcctggtaaggccaacgtggttgccgacgctctaagtcggaaaagccactgcaacactcttaacgtccgtggcattccactcgaacttaatcaacagatggaagccctgaacctaagcatagttggtcgcggattcttgactacgttggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgagctctacttcgctaggatcgtaagtctccatggcgttcccaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctagatttcgggaagacctgggataagagtctcccctatgccgagttctcctacaataacagctaccaagccagcatacaaatggcgccttatgaagcgttgtatgggcgcaaatgccggacaccgctcctgtgggaccaagttggggaaagccaagtgttcgggactgatatcctgagagaagctgaagcgaaagtcagaaccattagggataatctaaaggtggcacagtcccagcagaaaagttatgcagataaccgtcgccgtgacctggaattcgcagtggatgattttgtgtaccttcgggtcacgccattgcggggtgtacacaggtttcagacaaaggggaagctcgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatcccgacctcttcgccagttcttccgaatctcggggtcgagattccgtttaagggggataggtttgtcgcgtcccaaatcgactctaaaatacatcctcgaaattgtgcgaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccatccccccccttcctctcttgggccggc

SEQ ID NO: 64464 - DNA, 811 bp, Oryza sativa
tccgttggtcgtgtagacgctgcagcttcggaagatccgctcttcgtggaagttgaagccggtgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttacgaccttattattgttattgttattattaccttgttcaccctagaaccaacaaaaccccaactagtggacactctactcatggtaccactagtatgattttaggtagatgcttcgctatttaattaggtaacattaggtggttttacaactctagaccttgggaatattcatatcacctggacactgtggaattgttggagtattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggatacacgagctgcggcccggtagtcgagatgtcatggcacagggccggtgtcctgctgctaggggctcagtcctgcctgcctgtcccgggtgttccggccgtaggtgggattgggtcggtactcttgt

SEQ ID NO: 64465 - DNA, 2210 bp, Oryza sativa
cagtggatcccccatcttactagtctgatctgctgttgccattgtgaacactcaaggtcacacgcaccaaaagtgaacagtgagcaggacatgtcaagaaagctgaaacgtaccaactaggcaatttgtgcatatcttagatataatggctagactgatgatacgctgacggagcaaaattcataggattgagtacttaattaattaaattgatgatggcatgcatgacaagatagagtttaaagggactagaaagcaagtttttaccctcgagcacaatcaaggaatcaagtgcagatggactaagcatgcatgttagttttaaaataaatactaattatttgttgttgtctatatatatatatatatatatatatatatatcttaccaaatgttagttacagaccctgcatgcatgatcacaaaacgaccgtccttcccacaacaaaatgttgtcgttactgaccacgcacgattgagtatgctggaagctactatcacatgcactaaagtaattaacagctaggggtggcagagcagtctaacacgtaattgatgtggctttcacttgaagatttcacatacatatatagtagcagtatgagcttaactactgtgtatttttatgtatatatgatttctctatcttagatagtactactttttaggcaagaatatatattaatttttgataaatgataattacagaatctcatgcaagcactacaaattaagcggtacaaatatatccaaacagatagttagctaatatatatgctgactaaaaaaacttaaaactacttaatcaagcggctaaactgcacaaataatattggcttgcaatttcttgacaaaaaatgaatgtgtacatgtataaacttgcattcatactctacttttctacccgtacacactgtgcagcagctggtccatggtttcataccatgcatgacgcaccctttactaggggcatgccatgcatgaccatgatgcatactatgacgcgcatttgacatcattagcgagcctgtcttaaactaatcaggcaggcaattagcgtcaccaacatatgcatggcgcattactcagcattatattgttgttctagtggctgttaattatggcttctacacctcaatctatctctcctctcaccacacacatggaggtcctgcatacataggcatattttcatgcagggcatcaattcccttcctccatgataagcaaagcaaagcaaacccaacccaacccaaccccaaagactgcacactgcacccccatcatgcatgcatatatgcattatatgtctagacatatatatcatatatatatatatatatatatatatatatatatatatatatatatatatatatatatatatatcctatggcgtagcttagctccatccacacatcttttttcttctctcaccaagagagaaacttttcagacgcaaatctctttaccatgcaactgaaaagcaggagagatctagcgagaccatgtcgcccaaaagctacacctctgcctgcgcacagagagagatatcgatctcctctgaaaagcagacataattaaggggagcacgtacacactacacacaccaccaccatttttttccctgcagagattctaccgatcatcttcaaaagaagagctagtggtggtcatggtggactcatggtgagaagagaggaaagaaagatagttagatagatagatagatagatagatagatagatagcacatcgattgatcatgcaaaggcatgcataaatgcatctccatccatgcgttggaaaagctagcagctagcttcagcttcctcctgaagcttgataagaccagagcttgcagatggcatgggctggatagatagctagtagagaaactaaagaattactaggaagatgtttgatgcatctcagttgcaaaacccttataatttcttgaccaacctctcattgtcttctacagagaaaagggaaaccctaacaaaagatgagatgagagaaagaccatggactgattgatcgatcactagaaacgaaacgactgatctaacataaatagcaaatgtatcgggccgggcgtggcgcgcgcgcttcgcggcagtgcatcgtcctgagcaatgaagaataatccaagaattatgatcgattcgatctccatttggaagaacacaacaagatcatcatcagcag

SEQ ID NO: 64466 - DNA, 5301 bp, Oryza sativa
ctcctcaactcatcatggaacgggaacgacgacgacgaccccctcgccgccgcaccaccgccctgccccccctgcatctgatccgtccccgcggcggcgacggcggcggcgccctcggtgcccttgaaccgggtgacgagattcttccacttggacttgcactgatcgggggtcctggcgaagccgagggcgtggaggcgcgccgaggcggcctcccagagcgccttgttgcgcttggtggagaggaaggagtggtcgaggtcggcgcggatggcgaggaaggcggcggtctcggcgtgggaccactgcgggaggcgctcccgctcgagcgacggcgggtcggcggggagcagcggcggcggcggcggaggaggaggtggggggagtgggtcgggggcgaagtggtggggcggggaggcgaggagtgggtggtaggggttggagaaggaggagttgaggtggtggaagggatccatggctatggcctccgcctcactagtgggaaatgcgaggaggaagtggagaagacgatcgagagagagagagagagagagagagagagagagatggaatagaatgggaagtcaagggttgggcggagaggagagagaggaaagagaagaggagaggaggaaatctgtttcaacgcggaaacggcttgctttcccactgcttttcttcccagatctggatcttctgcggtctagtactacggtccttggattctgggtatgacctcatgcccgtctagcctctagagatggaatgcacacaacacaatagtcaaacttgtttatttgtagatttcgatacacgtaataagaaacttgtttacaaacatctttacagtgagtgatgtggtaaaccctttctatttctaattgttttactgtttctacttaggatctcttttacggttaatctgtttaagagctaacggctaacaaaatggtttcaacctcacctaaaagggtgatgattaattaaagagatgaagcaggattcaagtcactccactttagagtatgctactagaaagttaaatttagcaattttgagtcatgttaaataagaccgtaaaatctatcggttgaaatattagttagtaaatgtttattaaagattttcttttaagtacatactagcattagacattagaattttagttagtaaatgcttctaaaaatatggtttgagtgatttccattttgttctaccttttcttacctaggttttattttggaccatcctttatctaattttttttactttgggctagttttttttatcaattttacaaagaccacacaattatgccaactatcacccctatttacaggcaaagctcatatcttctccggggagagattggatctggctatacaaaacaaaagcgttagtcaaaagtacaacaaaagattaaaaaaacataacacaaagtgatattaactttgggtaataaaagttgacccaaaataattaaatcaaaaatggttttgataatgggcatgttcggcaaccgtggctgcgttgtagcgtagccaacggcaacagtgctgcaagcatcagactaacatgtggctgctgctgccacgattgtggcctggccttccgaacacgcctaatatatgtggctatgctatgcgagtaatgattaaatatattcatcgaaagttatatcgatatcctaagcgttactttaaagcatgtgactagcgatggtgcacattaatatttttattttaaaaatataatatgtattgtctattatatcgtcattcataaatatagtaaagaggatccaagttatgtaattagacaaatacacagactggatcaccaaatattgttatggcaagatattgtagagagtttatgatatgtttggattgatagcttactaaattttaaaaatacaaaagaaaatatgtatagttaaaaatggtagggaagtgatgaacacatcctaagatggccacagagttgatgggttcataggggatgcggtggtggggtccaaggaagggtggggtgggtggggccgtggggggcggacgccgttttgcgtggagggtgtcgtcacgcggacgacagcgcggcgtaaccagcaaggccaaggaggagggggacacgtccgatccgatccgacggctgcgatggatcgatcgatccggcgatctagaggcttcgtagttcttgctttgccgcgaaggcttccgtttacgcgttccatttggcggctgtgttgtgtgctgtgctatgcaagccacaatacaaaacaagcccagcaaacgtccgttgtccatttggattgaacacatacgtatactacacacgtcctacaaacgtactcctctcgttgtaaaattaagtttatgtgttagattttttttatattattaaaccaagaaaagtaagtagctacggataccctacagccacactggtgtaatgcgtcttgctgtacgtgtaaggggttgtttagatcaggggtgtaaaattttgacgtgtcatatcggagtattatatagagtgttgtatggggtgtttgggcactaataaaaaaactaattacagaattcatcaagtaaaccgcgaaacgaatttattaaacctaattaatccgttattaccaaatatttactgtagtaccacattgtcaaattatgcagaaattaagcttaaaagattcgtctcgcaaattagtcgtaatctgtgcaattagttgtttttatcctatatttaatacttcatgcaggtgttcaaacgttcgatgtgacagggcgtaaaattttagggtgtaatctaaatatggcctaaatgattaacttgtaaacttatttatagatcaaagtagtgggttcgtgatttattttagtctatataaatagattttgtgagtttgccacttactccctctgtttaaaaaataacttaaatcctatagataatttttagatacacgtgtgtctatgtgtgtatagatttgtccctaagattttacttttactttttctttttaagaaaaaaacatgagggagtacaccgttacctgccatgctgcgataccgtcgttgcgatgcgatggccggccgtgtgcgtgttccaacggcgatggcgatacttctgtataaacagttgatctatcgtactcctagaggttattaaggttattaagattgatgccattttaaatcatatctttttttaagcaaggctattaaagatatacatatatttagtatttttactgaactttgataaatctcgttaaaatttgataatattattaatttatattaaaattttgaaatcgctaaaattagataaggcccttgtttagtttcaaattttttcttcaaacttctaacttttttatcacatcaaaacttttctacacataaactttcaacttttctgtcacatcgtttcaatttcaaataaatttttaattttagcgtgaattaaacacaccaaggtttatttttactgcaatcgctaaaatagtctcctggtaatttggtggcgacagactgacatgcatgcgcgtgcatgttgtacgtcaagtcatggatgatgaacttgtcatgtttgtagctggagtactccagattggcagctgacagcacacgcatgcgcatgcacacacgtaatctccggccggatgtccatttcccctttgttcctagatctcggcagtggttacttcgtatgccaaattttattagtatacgggtatatatttaaaatattaaatatagataaataataaaataaattacagattctgcctgaaaactgcgagacgaatttattaagcctaattaatttatcattagcaaagtaaatatttactgtagcatcacattgtcaaatcatgatgtaattaggctcaaaagattcatctcgcaatttacatgtaaactgtgtaatttgtttttttcgtccatatttaatgctctatacatatgtccaaatatttaatgtgactgaattttttgaagtttaaagggaactaacactgccctcatcacgtaggaatactcctctataggctgtgattagttccttggccaaaatctttttaagtacacggaaagtattaaatatagtctaataacaaaataaattatagattccgcctacaaactgcaagacgaatttattaagcctaattactccgtcattagcaaatgtttaatgtagcatcacattatcaaatcatagcgtaattaggctcaaaagattcgtctcacaatttacatgcatattgtgtaattgatttttttttcatccatatttaatacttcgtacatgtctccaaacattcgatgtgacgtttttagaaaaaaaataaatctatacacggccatgatacttctatccacatttatagtcaactttctacagtacggtgtagttctctggaaggacaacatgttgtggaaattccggcaggtcgagagagaaagatcagcatggccgtaccgtggagcgtgcattgcaagaatcaacaacataacaggattactattgaccaactaagggtaatcgtatcccagaaaccatctactcctattaattctcatacttatcatgacatatatatacactatgtatagtaactattaatcttattaatcttattataggtggtttcttctagctgcagagctttttatatagagaccaaagttggtttgggtcccctagcttttgaaaaaaaaatacattgagatccatggatctttgtactatcatacaaaatagcataattgtcatagttatagataccacatacctaatagtagttgactaaatctcattaggacccaccacataccatgtctgtcggtgacatgggaccggggatatcttgactagaggtttggggcagccgcggtcacccacgtggcctgaccccctcgggggggtcgggcccaagggtgatgaggccgcccctccctctatctccccgaggggtcgggccgctcccgttttgtccccgagggctggggcgccccgaccccctgagggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagatggagccggcgtgggaa

SEQ ID NO: 64467 - DNA, 847 bp, Oryza sativa
atggccgaacgggcagtggcgcacaccctctctccgagcgctagcggtgacgacagtgagcagaacccgcgtcgtcgagctcgtactccaccgcccccctctcgccgaagtcttaggcgggaggaggcgctcgagggggtcgaaagatccgcaacttcgccgcccacgagcgatggagaaggacggcgagacggggagcgtcgcctcctcgtctacggcgatggcagcacgccccagggcgcgctccaagctgcgggcgcgctcttgcgtcacccgcccgttgtccccgatccagagactccagcccgatgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcagccgttacccgccgttcgtctgccattccctcgtcaactgtcacaccctgattttcgtgttaggatttataaattatttaataaattattaatagaatttatatgaaatgttcattaatttacaagtgaagttaaatgtgggaaataaaatttcctaaatataaagcatgggtggatttaatttttattaaattctccatggttaattatactctctggaattttctcggatttttcggagctcaattcctaaatgtaaatgatacagagaacagttcagtaattatttgatcaataatgatctaattataattgttaagtgcttttcttgtttaaaatccttaaattataaattgttgtttaaaaggaatattagaaatgattttaaaagcttaaa

SEQ ID NO: 64468 - DNA, 3757 bp, Oryza sativa
acacataacaacctttaacaggacatataatttcatttcttttgtgatttcttgaaaaaaccaaccaccaaacatttgtgtggagttccatatgccatttggataaataaacgcttaccagatttatttgtaatgatcaattgattttctgtgactagttgaatgatggtactcctagagtgagaagcaaacgagcatatgttatgctcacataagagttgtgaaaaaaaaaaacccactccagcaaacgcacacgaattatttagtacaagtagtaggtttgcaatgtaagaaacaaaaaagctcgaagcagatcattataaggccaaacgaaacttggttattatttcccatgccagtgcagatttacataaaaactagtacggctgggcgctagactacagacgcagaaggcaggttgacgtactcacaggtgcctgaaaacttgtctgaaaactgcacccatgtgaatacaaccgactacgaaactgattaacatcaactcacctaattgactaagatagtactaataacacgtacttatagtaataaacagcatcagaagctaacattcagatgaacctgcaggaattgttggactctgctgatctgatttgcactgcagagctaacagtaactgcataaaaccagtgaaacaggttcctgataagttggtcccatgagatgagatgaagatgatccgttctatcatcaacactacctacctgtctcaagcggtcaagcctactcgcgctcaatctgaatggtcacatggctgatgttgtactcagacttgatgtacccaatcaccttgtccagcatttgatcagcgtctgcgtcctgagtgattgtcacatggcacgccaggagaaccttccccaccgttatggcccagatgtgcagctcatgtactgcaaccacaccgtccatgtcgcggaggccattctcaaggctggtggcatcgatctcgcggggcgtgctctccatcaggacctcaaggatgttgcgcagcatcttgattgtggtgaagagtacgatcacggagaagatgagggtgcagatgagatcaataatcttccactcgggcttgtaccagatgatagcccctccaatcatcacaccgatgctctggattgaatccccaagcacatgcagataagcactgtgtacattgatattacgacgagccttcttggcatccttggcaccagattgggtgctgtcacaaccagcatcactcttgagcaatggttcctcagcatcatggtggtggtgtccagtgcctggatggtgatggagattgacggtaattgaattaccatggccatcttcgtggtgatgtacatggccatgctcttgatcttcatggtggtgatggtcatggtcagaaccaccatgatcatggtcatgggaatgtccatgcccatgaccatgtccgtgtccatgtccatggtcatgaccaagcaagacagccattatgatgttaacaaataagccaaatgctgagacagcaaacatgagggagccctggacctcaccactttcattaatgagccttacaatagcttcatagacaagaataccagcaaggagccatatgagctgaatagaaaccagggcaccaagaatttctatacggaaaaacccatatgactgctgtggtgtagcttcccatccagctgcccaaagagagaacaaagatatggcaaaggccgcaacatccgaaaggagatgggctgcatcagtcaagattgccaaactgtttgctttgatacctccaaccacttcgaccgccatgaatatgatgcaaaggatcacagcaataatgagcttcctcattgacgccattctctcccttgcatcttttgagctattactggaatcagaaaagtcacaagcagcacctctgcaaactttgttcccagctgctacagaagtagatgatgagatgtccattctcacttcagcaatctggggaggtgctgagttatggctgtccatctagggggaaaagaatcatgtcaatacacaagtacaaagatgatgctatatttacttctcatgctctgagaaaacatgttaacataaggttcctggtagaaatagtgcgaaaagctagtgataagaatcctttcttgtgtcactgggggaggaaaaaaactgaacagcacttcataaagtaaaaggtggcatgaacattcttaacatgaatgaataacgaagttaaaacatcaaacatatataacataggcaacactgtttacaagtaaaaaatctccgtgccatggcagagcgtacttttatggtacttatgccaggtaacaatgagtagccttttgttaagcggcacattaaaaaaatgtgcatcagtaccaccttcctaaccaggagacaacagtagcaggtacaaaaaggttggccaaaggatataatgaatagaagtaaatatgttcgttttagaaggtgccaatgtctctttgctcaacaaatatagcaggcatagttcttgctagtgcaaatataatataagcattgcaaataatgaaaccattttcttagtcaggctaaagctttcaagatgtattaaaaaagcacaacaaaacaggaaataaaaaaaccataaaactgaatgcagaaggagagcactagaattgtcgtgctggcagtacaagaacagttagctggcacctggcagtcttttccaactaaaagtgacagtatcacgaaagggaagattaattaagtcgcactaatccaacaacaagaaggtccccctaaacataactagacattcagcacatgattgcaaacaaacgtcacaagattgaagtaggtacttcgtaaatcaaaataccctcaaacagatcaagttctctctacctaaccgaaggcaaccggcaatcgctggttacagcgaaagcacaagaggggaacaccaccaagggagcaagctaatcggcattcattcatgtttacgataacctacattagagtgtatgtccacaaatccaaaaggacaatataatgaaactaatgaagcactccagagctatcgtaatgagattttccaaccaatccatccatccatcggaagcttttcattggacacgaggacggactggtcagggaccaacgctgattgattgattgatcgatttatttcgccaattcaatgacgccgtgctcgcggacaaacagtttgtggctgacgaaagttgaaacctactccagaccaatcgaatctgtagtgttaggaagaacccaaggaggaaacgaccaaaaatcgatccctatcatcaccccgtaacaccgcaattggagacagggactcgtgattcgaccgattttgaaaaatttttctctcccccgatcaaatggacggagaagcgaatcgaagcgagaccccacacctccactcgaacaacccaatcccgcagtagcaacccgtaacctcgagtcgaacaacccaatcccgtgacccgtaaccgccgctcccctgatttctcctcctcctccatgaaacaatattccatcctaaacaaaaaaaaaaaaactagcgctccaaaatccgaaacaataacagcaacagggaatgaccccagggaaacccgcggcgagcgaagagcagattcgtggaacgaacgagagaggagcagaggttgatctggtctctcggtggggacgacgaatccatcgtaggaagaggtggtgggaaaggggatggggatgcggcgatgaggcgctaaccttggggatg

SEQ ID NO: 64469 - DNA, 1129 bp, Oryza sativa
ctatgaaagtgtggtatgtcataaatatagcaatgaaccaaagacttgcttgatttagtcaaagggcttagccacaagttgtggcaagtgtttctctcctgctcttcttttcttttcttttctttttttgttcgagataaaaatctcagttagtatgtccctctacaccatgcaatacaaattaagttgaaacacattcaaatggatatacggataaaattctttattggatcttatttgagaaacgataatactccctccatttctaaaaggagggattctaggtttttaagagattaaggatgaagataaaagatcactatcatgcatgcctcatgttgcgtggtgagtgaaaaagtggttgtggataaggtgagaataaaattaaatatcaatgattgatcgggcactatatagtacatataaaatcccttattgttggataaaattctaaaatgtttcgatcgttgggcgttcgagagaataattttttttaagggaaaaaggggggggagatatttcattgcacacaaagaaaggctacagctattaattccaatatgatagtattatctctgtccattcctagtgtaaatgcggcacacacgttgaagaggcatatgtttacacgcaggtcaccctaaacgtgtccaaaaagtcaggtcttaaaaatcattatatgtagtaagatatggtggatttatactcggtaaacacgtcttgattaatctaatgaccactagttcttcttttagcaaggagacatggcaaggctagtgaaagatgagagccctgaactgaaaggcagaagcactatacgtacgtgtcatataattcctagtgtagtagtttttttatcattgctcaattttgtttgcttcccctgaataatggatcgagcttttgctcatcctgactttatacctcacgaggacaacagagagtattactttttgcaggatgattatatttttgtttttatcataccgacgattaggtgcccaattatatacctagtactccctccgtccctaaatataaaaaaatttgatagaatgtgacacatcatgtccatatatattgtactagaatgtgtcacatcccactaaaatcctttatatttagggat

SEQ ID NO: 64470 - DNA, 4404 bp, Oryza sativa
  unsure (1)..(4404): unsure at all n locations
nnnnnnnnnnnnnnnnnnnnnnnnnnnnnnnnnnnnnnnnnnntgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaggcccagcacacacaaagacaaacgagaaacagcggaagactagggcgacgaccacaggcacttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggccccagctcgtcccaagccaacccaggccaaccattccatattttagttgttaagcaagttttaagaattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaaaccacctaatgttacctaattaaatagcgaagcatctacctaaaatcatactagtggtaccatgagtagagtgttcactagttggggttttgttggttctagggtgaacaaggtaataataacaataacaataataaggtcgtaacaaaggtaaataggcatggctaaataaaacagtgataacgcgggaatttaaataaataggcggccataggcacggcggagcggcggccgagagaggggagggaagggggaaacgaaatggcggtcctcggctcaccccgggttgacggcgacgacgggaacggcgaccgaagcggagagaggcggcggcgcggctcgggtcgacgaggacgatggtgctccggcggtcggcgggcgaaacggaggagtggacgaggtcgacgagaacgcggcgaagccgaaggaggcgacgccgaagcgggaggaggtccggggcgacgacggcggcgaaccggagctcggcggcgacggcggagagagaggacgacggcgcgagctcgaatccgacggggagagcgagcggcggacggcggaaacggaggagggaggcacggggagcgtttaaatagggttgggagtgagagagggcggccggaggggaaggaaatcggcgcggcgatctcgggctccattgatgcgccggcgaagatttcgggagagtaaatctgaacgaatccgagggagagagagagggaaaagaggggggaaagagagagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcggggaggaggctgatgggccgcgggggagaggagagagagggagggagttgggccgagccggcccaagagaggaagggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattcttcgcacaatttcgaggatgtattttagagtcgatttgggacgcgacaccagagtaggcatctagaaaacacaaaaggtcgcaccccgcagtggagtcgactatctgatctatgcgtggtaaagggaagggatctttagggcatgccttgttgaggtccgtgtagtcaatgcacatccggagcttaccgttggccttcgggacgaccaccgggttcgccaaccactccggatggataacctcgcggataaagtcagcctccaggagccgcgccacttcctctcggatgaaggcctgccgctccggggcttgacaccgcactttttgccggacgggtcgcgcatccagccgcatggcgaggcggtgctcgatcacctccctagggaccccgggcatgtccgacggcttccattcgaagacgtcggagtttgcccgcaggaaggagacgagcgcgctttcctatttggcgtgcagggtcccgccaattttggcggtcttggacggatcatcgccaagggggatctccttgacgggcacctcgtcagccgaggtgaggcgcttcttggaggcgtgggacgcggaggcctccggggcctgtggctccgtggccactgccaggttgtcggcgcgctgctccgcgcaggcgagggtgactttgacatcgccaaagacggtgatgggaccactagggcccggtatcttcatctggaggtaggcgtagtgggtggcggccatgaacttcaccaacgcaggtctgcccaggaccgcgttgtagggcagattgaggtccgccacatcgaagtcgatccgctcggtacggaagttggtggagtcgccgaaggttatcgggagctcgacgtggccgaggggccacgtgtgtcccggagtcacgccgatgatcggcagcgacggctggagcttcatccccggggccttgagcgcattgaaggcggctggggagatgatgctcaagctggcccccccgtcaaccaggactcgcttcatcctaacgttgtgaatggtcggggagaccacgagggccaacttcccacctcgagcgagcactgtcaaatggtcgctctggtcaaaggtgagcttcacctccgaccagtgcgccttccgagccgcttcgtgggttgggacggtggctagaagctctcgccttatggcttgaagcctcggcgggaggtgtgagcgcaagccccccctccccccaggtcgagcgtggcgacggttccctgaggtatctggaactccagatcctcgctgttatcaccatcatcggtgggggccttcttcttcgcttcccctcgtcggtcatcggctggggtcgcgggggctttgccctctcgtcgaccctaccgcttctcctcatcggcttcccggaaccgctcggccaaaattcttgactgagcggcagtcggcgagactgtgctgataagtgttgtgcaccaagcaccacttgtctgccgaccggccctcaccgg

SEQ ID NO: 64471 - DNA, 745 bp, Oryza sativa
tggatcccccgttttttaaaaaaaacggaccagaaaaggatctaggccagtttaggtcatggttcttccattgcctgctttgaaccatgttatacctactcaggcatatatgctcaactttaaccagtaggaatcagtaaaagttaggtataaatctcacacaaaaaacacaaaaccactaattttattgcataattaaagaacatatacataaaatccatagttttggttaaatttattaggatatgtagattagaataatggacaataaaaataaaggatatcaattttgtgggcatgttttgaagtttgcatggaagcatttggaatataaaggggcaaacaattgtaacaagaatggactaagatattgaaatttactcacagtagggtgaagcccaacacgaggaggatccacaatagcaacaatgtcttcgaactgacatgcagtagctgcagtcacatcattgttagaaatggaagaaccatcatcagatgtctttctgtcctccaaacagtccgatactttcaggtcaacagactcattgatcaatgatgcttccccatgaatatcttctccagcaacctcattgtattcatcatggctgccttccaacccattgccaaccctatcattggaattcccctttatctcatctatggcagaagaggaagaatcagctggtgcatccccgagctgctggctttcgccattgtcatttttctgcattgagctgtccaaatt

SEQ ID NO: 64472 - DNA, 1117 bp, Oryza sativa
cgccgccgtagtgcagcttgcggcgggggcagccaccgctctgtttcttggctccgacgtgtccgctcttgccgtcgggttcgccattgtcgtggcgagaagcggcatccgggctgaagctgaggacgatgaactcgtcgccctcctccttcaagtacggcgccggcggcggcggccacccctccgccgagctcaccgacctgctcctcctcctccgccgctgccgccgcagcggctggcactccgtctccggcggcggcggcggcattgcgtcgagccccatcagcctggccacgacgcaggggctcatcccctcctcctgctgtacctgcacctgcaccaccaccgcaccgtcgtcgtcgccgccgcccgcattgccggcggcggcgtgcgcgcagagtaggcggcggaggaagtcgagagccaaggtggaggacgccatggcaatggcaactatggcagcatcagcttcgcaatgctgctgctattatatcttcttcttgcctccgttcttgattcgatttgaactgcagttggagggaaaaagaaagaaagaaagagagaaagaaaagcaaaaggaggaagaagaaaggtatggctatggaggtagcagcagcttgattagatgaagaaatggatggaattttgcaaagattttactgctagtggtagaaaggtgatcaactgttgcagtggttatcttcttcttctacttctacttctactgctgctgatgctgttgcacttttgtgttttgtctgtccccttggatctttggagtgagggtgtgtttagttcacgtcaaaattggaagtttggttgaaattggaacgatgtgacggaaaagttgaaagtttgtgtgtgtagaaaagttttgatgtgatagaaaaattgaaagtttgaagaaaaagtttggatctaaactcggcctgagtgaaatttttaccgtttgacatttgaaatactcctagagtatttgctcatactgttttattacagttagtagtaggactatcatatttgtgtgtattgtgataaggttgggactgacactgtttacctgcctgtgccatatatgaacactgtagttcatagcttcactattgcaatgatataa

SEQ ID NO: 64473 - DNA, 1132 bp, Oryza sativa
tttttgaaaaaatttctagaaaagttgcttaaaaaatgatattaatctatttttaaatttaaaatagttaatactcaattaatcatgcgctaatacctcaccttgttttgcgtatctttccaatcttctctatctcctcctcaaacacagcctaagtgtcggtttattaggaaaaccgtcatttatattattagtgttggttttttaataaaccggcacctatataatattataggtgtcatttttttacttttagacccattgaagggtcgggaggaccgaaaaagtctcatactatgtgccaagtttagggcgtttcttatcaggagtttcgtagtagtgtgtgaatttgagcccaacatggaaaaaaagaataaaatgcactagtggcccttaaacttgtcataaggtttcacttagatccacgaacttgtaaagcgtacatcgaggtctctaaacttggtttaatatatcaaccccgtccaaagcattgtttgaccgtggtcttgtctacgtggcacgccacatggacgatgacatggcgttttttttcatttccccttttctttttcctcctattcttttatcttcttcctccactagagccacctcgagctcccccgcgtcaaagaggtcgaagaagagagaaatgaaagaggaagaagagagaaacaaagaaataataataataataataataataataataataataataataataataataataatgatgatgccatgccgtcatctacatgtgatgatgatgatgtgccatgccgtcatctacatgtcatgccacgtaagtaagaccacggtcaaatgagactttcattgggatgatacaataaaccaagtttagggtcttcgatacacactttgcaagttcatggatctagataaaatttgcttacaagtctaaggaccgctagtgcaatttacttaaaaaaaatagtaaggaccttttataccaagctaagttagactcctcgatggtgtcacttggtttcaggaggagcgactcagaacacagcatctacacgtgtgccgagcttcgcggttgatcgtcggcgtgtacgttgacaatctcatcagcaccggctgcagcagcaaaaaaaaaaaaaatcga

SEQ ID NO: 64474 - DNA, 922 bp, Oryza sativa
agtagaagatagtgcaattaatgatgattttgccctttcttttgggattaatcgtgcacacgtcagtccacggtggatgagtttccggttcaacaggacgataccgggtgctgcatgtgcacgcctgacccttataattaaatccttataacaccgtgtacaggacacattcatccatctttaattagtttttttaattctaattgcatgcgtgtctggcgatctggaatacaacatgtagctcaaccggtttagctagatccaatcattcgacaataatattcattcagtgtcattcaatctctcactcatccataaataaaacacataaaaaacctagtggccatctaccgtttgatcggggtagctctagtttcatccgagtctatgctatgtggaaaaaaaacttgtatcacgacgagaaaaaatatatcatagcaaattatggcataacagaaaatttgatctaaattgtaaaataaaacaaaattttaagtaggagatagtggaattaatgcttatttttcccttttttctaggattaatcgtgcacgcgttagttcgcgttggatgggtttttgttcagcagcacgaatgcaccatacatacccttataaatccttgtaacaccgagtacagtacacggtgtgccctcacatgtttgtgtgtttccgtggaagcgtaggtaacttgatttgtttcagagaactcataactttgggggtgtttacattaagaagttttgacgtgtcacatcaaatattatatagggtgttgcatgggatattccgatactaataaaaaaaaactaattatagaatccgtcagtaaaccgtgacaagtttattaagcctaattaattcatcattagcaactgtttactgtagcaccacattgtcaaatcatggagcaattagcctta

SEQ ID NO: 64475 - DNA, 750 bp, Oryza sativa
agaacaaatatcctttgccacgaatcgatgatttgtttgatcaactgaaaggagctaaagtgttttctaagatagacctgcgatcagcctaccaccagttgataatccgggaagaggatattccaaagacggccttcaccactcggtacgggctatatgagtgcacggttatgtctttcggacttactaacgcacctgcattcttcatgaatctgatgaacaaagtgttcatggaatttctggacaagcttgttgtggtattcatcgacgacatacttatctattcaaagtccgaagaagaacatgagcaacatctccgtctggtactcgagaagttgaaggagcactagctatacgccaagttcagcaagtgtgacttctggttaacggaagtcaaatttctgggccatgtcattacagctcaaggtgtggcagttgatccatcgaacgtggagtcagttaccaaatggaccccaccgaagaccgtgtcgcagattcaaagttttcttggacttgcgggatattaccgccgattcatcgaaaacttctccaggatcgcccgacccatgactcagttgcttaagaaagatgagaagtttaaatggacagctgagtgcgataagagttttgaggagctcaaaaagaaattagtatccgcaccagttttgattctgcccgatcagatgaaagacttccaagtctattgcgatgcatcccgccacggacttggatgtgtcctaatgcaagagg

SEQ ID NO: 64476 - DNA, 1136 bp, Oryza sativa
  unsure (1)..(1136): unsure at all n locations
tacacattattcagagactcctacgatagtcaagacaaaaaagacatcttaaccattaatacacaaaaatagttttttattagctttctttcattttctccctctgcgagcagaggaatttcttttaataaacactaagagtcggctctaagccgatatcataagtagcaacaatgttttctcttcctcccctctatcttccacgtcaccaaatttacttatatgataacagagagagtccgctaataaacaccgttgtagatacctcataagttttccccctcacgctcgcgaaatgttttctactggagaaacacatgtgtgcctacacctgtggcaacattcatggtacccgctccaaccccccccccnncccnnngncaaaaaaaaacacaaaccaaaatctctctcatcttttttttttcctttacaagaaaaacaaaaaaacgatgtanaaaggaaggtcgaaaaggaaaggaaaagaaaggaggatgcagcgacgaagagaggaagaaagaggctctctgatttgtttgcgtttgtgcagcgcgtcttcccttccttttgaccacgcgacacatccagcagccaaaaaaataaaaaacccaaaaaataaaacgattattttatttttgtgtaaagagaagggaaaaaaaaaacgcgcgaaggagaaggagacgagctgcttcttcgtctccaacttcccttatctctatcaacccccattcctccattactctccctctctacatatacccttccccacccacctcccaccctcccctctccaaccacaccactctccaaatccatccatcgatcgagaattcctcttctccctcttcttgttcttcttctcctctctgaatttaacaagaaatcaagaactaggtgtttgttttgactaacaagaactcggtcgaacactctgcgtgcgtgtttgtttgtgtgtgtcatgtgctctgggccgcgcaagccgtccacaccgccgctgccgcagcagcagaaggaggcgacggtgatggcggcgtccttgcttcttgagctggcggcagcggacgacgtggcggcggtgaggagggtcgtggaggaggagaaggtgtctcttggcgtggctgggttgtggtatgggcctt

SEQ ID NO: 64477 - DNA, 2253 bp, Oryza sativa
tttttcccgtacccaaccaaccactcttgcccccacttcattttttctttttttcttcgaatctgaatcgatccaccatcctagcctacagatcggtaacacaccatggacgaggatgacgacaccgtggcggttgacggcggtgaccggcggcggttgaggcgaaggcacagcttaatcggcaaggaggtgttcacctgggtcaagagcaacaaccggcggctgctccacatcggcgacgttgatagaacaagcaagtatggaaatgacactccgatttgcatctgcatactctccttcaacttcacgtatgaagccccaatttctttttgcaaatcaaattaacgtgtaatctgcaatattacctgatctgaattgatggtctgcacagatcctacatttgcacatcgtgctccatgtggctggccgcaggacaaggtggagtccgccagtgatggaggttgtttgctatttttcatttgctcgtcgtctctatgacatgaacaataatgtttttgctttttttttgcgcttgctagatgatggatggctgctactgcgcaacgtcgagcccatctctataccatgctgctacatcctcccttgattccatcgtcgcgtaccgttcgccactcggttgctctctccactaccagtcacaagacacagaccagcctctccatccttatagcaagatccagcaaagccaccaggatgtagtttcacgatggatttttggatgaatctttttttttcttttctagtttgattcacctgtgagtaatcttatcacttgtgtgtgattgagcctgtaatttttttcattcgtacggccattttgtgatacagactaacaatactcttagtatcagtttttactttttatactgtatattgaacacaccagtaaacatattactacatagtggatacgagatcatgggctatatagagagagggtggtaattgttttactcgcagaccacgaagcctcagtttttacccttatactgtgtattaaacacattagtaaacatattactacatggtggctacgagatcatgggctatattgagaggacggtggtaattattttagtcgcagaccacgaaatctaaataatatttataacactggtattcttttacgatcatctaggaatgatgcacgtacaatgtgagggcattcgtgcaagtaaatttgttaggtattcttttacgaccatctaggaatgatgcacatacaatgtgagggcatttgtgcaagtaaatttgttacttttgaaaggggcattcatgcgagtaaattcgttacttttgaaaaactccacaaagtaaattcgttacttttaaaacgttgtgaaacattagaaaaatgaacttggaaagaaaaactaaacggatggttatatatttaccgggtcctttgatgaagcacagataagatgtaaaagaagaaaaaagaaacacagcagggggggtggtaaaaaaacgaaaaaacgaacgagggagcattgtgcggcgctcgaactaggattagcgataccggacatttagtataataactatttgatgatgagaatgtttgggtaataaagtgaagcaggaaggaaaggaatatgaaattgggaatgctatggaaggtgggatatagtatactaggcataccctgcggcgggtactcggggaggtacatggggcgctcggggatcaccgtgtcctgcagcatctgcggtgcgtgcagtgcatcaaacaccaaaaattcatcaccatcaattcattattagcatagtagcaaatttaattaggcaaagctaatacccaacgtacccttgtgatgttgttctgcgacttgaggacggaggtgaggaggcggccgaataggggcgactccatgagccagacgaaggccctgagagagaagccggtgaggtgcggcgcctgcagcgacggcgactggtacctcaccgccgacaggtccacctcctccaccggcgtcatggcgcgcggcggcttccccatcgatcttgattcttagctactacacccacagctctagtagtctagtggctagtgtgggtggaggtggaggaatggagtggaggtggaagaagaagaagagtaggcgaagaaggcggcggcggagttggcgagggaaggagggaggaccatgaaattattgtccgcccacccggccgttgattttcttgtcaccccaactacactatttactccctcttcttcctccggtct

SEQ ID NO: 64478 - DNA, 4127 bp, Oryza sativa
taaaaaaataaactaggagcacgtaaaataaaaaaatcactagcatattatcaattaagttttaattattacaatctttaaaatagatttattttatattttaagcaaattctatataaaaaaatttacacaaaatacaccgtttaacaatttttaaaacgcatgctaacgaaaatccatatacaatctacatcttaattagtaatgctaccgcttaggattttcctcataccacttatttatttttctaaaaataaatacaccctctcttaaaaaaagtcaaatcctgactatgaacaggacaagcatttgtaggatttgattttttttttacaaaaaagagtactactattcaagattaaaatctaagcaaggattttaacaacttgtagtttaattgacattggtcaaatatacagatttgacttttatagttcaaattggcctcacaaaactcacggataggttggaagttagcatgcaggaggacgacaagacaacatgaggaaggagacatcgatggagtataccagactcaacaccaacaatttattatatcctccccttgtttcgtgctaacattaatcttacgcaaaaataggtgtggcatcatcaaccgtttacatgaaatatgtcattttcagccttgagcaataaactgattaatatccttgatactccatccgttacaaaaataagttaacctagtaccagatatgatatatcctagtattatgaatctgactagatatctgtcatatcccacactaggttaatttatgtgatatattctagtattacgaatctaaatagtgttgatgcgaaaaacacacatcggcctgagagatctgcttaactccagtgcatgtcctaaatcttgctttcgggcttaaagtcgtgccagttgatttaattctgcaatcaacaagaaaggaaaacaagaaaacaaggttaaatccataaacgatagccgatcggctaaaggccgatgacatatcgttaatcattaagccgatgttattggcattagatcggcaatgaagaataaagcaagataaagctaaatctactcaatcggctgtagatatcaatgatatataatctacctctagaaacatatttaaaccaagtgattgggatagattgatagtgagtcgagacagtataaatcacttatgcataaaagtactttaagacaaagattatatatattcatatcatagccgatgaagtagatctaacatatatcggcttgtactccgataccactctatgttaagatattaaaacaagaaaaatataccaaacagtaagcctaatatatcttagtgcaataagatcttagtataaaggtcagatttagtacgtcaagtaaacgtgtacagaacaagacaactgaatcaggtaagatcggctgaaaccccgatactatctctattgatgatcataagacaagctagatattataattctagatattgcttaatagatcgaactcgaccgatgcagcattaagcataaagaaaaacacaagatctaaacaagttgatgaaaacctctatgagatggtggatatactatataatctagatcaatatcgatatctaactctattgtctgccttccaatgatagatgttggctgatttagggttagatggtaatactgatagagattatacagcacatatgataactcgacgatttacataatcaagattagagtgtcataaagatgtatgcactaatcccgagaatacaagccgccatgacaagttttacctcttgttgaagatcgaaaccgatgtagctcaacccaaaagcaagaactcgtcgaaataatgaaaataaaaaatgtggcgatacgccgaaagtgttattgaattgtcgttatcaatatacatggtcttgggccatatttatacccaaaatacataatgtgtccttcccgggcacgactctaaatctgctacaaccgttaagatacgaacaagtctttcaggcaaactcttgccgataaatatctctaaggaaactattcaaaatatcataattaatagatacaattgcctatccgtgaccttatctcaatcatggcaatacttgtgcagcacgttgatcaatcccaaagatgattgtagaaccaccttagcgagatcggctatatcagttgtcctctatccgatccatcgtcagccgatgcagtctttagccgatgcctcccgtagccgatgcatactttgtttccgagaaccaatcctccaccaaatccgcttcaattttaacttctaatttggtacatgatctaccaattttggtcgtcaacagatagatacatgtcatatcccatactagattaacttattttgggacggaggaggtccattatattcttttcgtgaatagaaatcagtccaccatatatacataaagatatgtatcgatctctctctcaacaaaaaaaaatattgtaccgatatccacttattactagggcgcaacataaattaagttggtgaataaataaataaagaatgggcgattgctcttttgaccttttttgaaacctaactatcaatttgaccctacttttaagtttgcttattcgacaccgtttttcaaaatcgaagttatcacttgatcctgttttctgcagtgttagggtttcatttagaaaaagaaaaaaaattcttcatgagccacaatcgaccaaaaatacccctaagtacatgtcggtacttttccagaattctaactactccttccttatcctctccctctcctctctcaccggagcctaaaggggagattcctcccacggtggcaacgggggagggctggcgactgctcggcgactaggagaataggtggcggcggctcgggggcgaggaggagcgacggtgaggtggatccgatgaaggcttggtgcctgcgacaaggaaaatgagcagtagtggtggctctgtgacgaggacgagcaacagtgaggcggatccagcggaggcttgttgcacgggagatgagaaggaggagtggcagggtggatgtcacgccctgaagttttcccctttttcttgttttaaaaatttgttaaataaatcgtccagagaaattgttctaattaacctagagttgaatccctaattaataaatgcaattaataatcagaaatagcgtggtggaacttttcttgagttccccatgccctaatgcattaacaagatttttagtggaatttttagagccctataaataattttaaccaattaaaaatgagcaagtgcaatatttttaatcccgggaaaatccttttcctctttttcttttcttttccttcctttttctcttgagtcttgatgggccgtcagcctatctctctctctctcgcgccacctccctcttgctgggccggcccaagccgcctccctcctcttcccgggtcactgacaggtggggcccacctgttggccccgtcttcctcctccagccggcggcaaccgccgctgccgccccacctcttccgctcctcccgcgcccacgccgcgccgctcccatgtcctccccacgtcgccgccctctccccgcgtctcccgccccgcgcgcgcgcacgaaatgggcgggatttgatttcgaatcccaccccactctctctatctctccaccccacgtcgccggcggcttcggccaccctcccggccacgtcctcccctccctcgcccataaaaaccctccctcgagctccctctcttgtttccccattcgccgttgtcagggttatggataccacatacctaatagtagttgactaaatctcggcaggatccaccacataccatatcttatacggaaactgacctcgagggagttccggttaaggaaagacaaaccatagttctacatggaaacgacaatgactactcagattgtatccatattggtttccctagttctacttagacaaggggacacctatgggtataaatacaagaccccctaggaggagacgggagatgaccacctcaatcaacatacacggaacaacagaagccacaacatacaagccaacatacgccaagacaagacgccggatatcaacttcagggataggcacggttagtcccctacggt

SEQ ID NO: 64479 - DNA, 1739 bp, Oryza sativa
gattgccgcaaaaacccaccggagtccacttctcctcgtgctccggtgagtttgtccctcccctccgcctccggccgtcaatggcgtctgccgtggtcattttccctactcctaacccctcttctcccctcctctaggtgtcgccgccgctcgtccgcccctcctctcaccgagtcgtcgccgccgcctttcatcctccgctccggtcgttgtgctcgccggtgaggactccttgcccctccttttctcccccttcctgtgagcgccgagccacgccgcctttccggccgtgcaccgccacctttgcgccggccgtcggtcgccgtcggaggccgcgcgccgccgccgccgtcctgcccctctccccttgtgccactgacaatcggggcccgcctgtcgacgccgccccccccccttcgctgacgtcagccctgggcaatattgcgcaataaattgattaaggactttttctttattagtaaaaacacagattatcttctaaaattcatatctaattcatccaagctccgtttaagtccattcaagtctcagtaaatttataaaaatccctagaatccattaaaaatggttttgtttcctgttttagtagtcttatagtgtgttttgcttgtgtgctttgtttgtcgcgtagatttcggccgtttcgtcgatccgcggtttctcgaagatgttgctgtggtctcatcagtgcgagagcaaggcaagtcatgcattacatttgatcatattgtacccaatttacaaatatcccgcatttctattaaatgtcgcattcttttacaatgtcatgtgggatgggtcctattactcagccatttattgtttaccctatgccattgataacttgggtatcaaaatgattagatgttggtttaggaaatgcttagccatgcctagttcaactagtacacaaatggggatcacattattacatagactttgactattagcatagctttggattggtgccaccgtaatggtgttagttaattaaaatacactgaatggtggactgtgggtgcatggttttgctggtcgcacccatggcaattaaggaccggttcacgggaaaccctgggagacttaccgtgcttaccacaagcgggagtgggtaactgctcggtctgaagtatagctcgactctttcctaggcaccggtggcgagggtgggcgtgatggagttgggtcggccggggtgtccggttgtccagctaccggattcaccgcggcgcaagaggggaccacccactacccgttgggggtgggggtgaaaccttagcatggtgtggatggttaggggagggttatgtggagggtcttgtcacaatttccccctttgtagtatcatggtgatattttggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagtttaatgaactggtgtagttcaggtggttggttgggcctgttgcaacgtggtgtagcgttagacagtgattggttaatattgattaattactacaattgttttaccgctttcaactactgtttttaaatgcctgctttattgcaaatgaaccctagcctcctttggttatatcctgcatcatacctcctcttccagtatgattggatgagtacagtgg

SEQ ID NO: 64480 - DNA, 2844 bp, Oryza sativa
tgctcactcaaaatcttgtcaagagtgtccttacccttgaagcacatctccaaactctgttgagcttaaccacttgctccttaagctcattgttctcaacaacaagtgaggcatcacaaatagaaacacaagtgctagagctagagctaggcatatccacaagatcatcacaagaggtagaaatgctagatgatacaacatgagcaatatggcaaatagcactatcatcaagcaaatcacaagatatgccaacatcaatgagaactccatgttgagtagtggaaaggaggttgtcatgagcttccttaagcttctcatgagaaatggtgagtctctcatgagaggtctttagctcctcatacaagacctccaaagaagcatgatccttctttcgggccttgaacttgacaatctccttctcactataagcatagagctccttaaacatactcacaagctcatcataggaaacatcatcacaatcatcatcactctcactatcactaagaaatgctaccttagaggagtcctttgccatgagacaaagtggagcgaagagtgatggagcctccttgatggcaacaacggccatcttcttcttcttggagcttgcatcatcaccaccttcttcttcggacccggatgaggcggagctctcctcatttgagtcccattccccgataaaggcctcaatattcttgccttccttcttgagcttcttcatgagcttgtagcctccactcttcttcttggatgacttgtctccatcatcatccttggaagggcacttggaagcaaagtgtcccttctcaccacactcaaagcacctcaagttgggaagagtcttgttgggtcttctatttcttctcctattggagttggagtcccttcctctctcctttctccttcacaagagatcattgaaccttctagcttgtaagggcaatctcttcctccaagtcctcattggcttcattcaccttgcccttgcccttgtctttaacttcggcttgtagaacaatgcacttcttggaatgtgagacttcctccatctccttcttcttcaacttgtacatgtcattggtgttgatcttccccaagaggcttgcgggtgtcatccttgacatgtcagagttgatgagcatggtgacaagggtctcatacttctctggtagagccctaagcatcttttgggcaacctcaagatcggtatagtttgccccaagtcccttgagatcatttacaatgacattgagcctcccatacatgtcattcacactctcatgaggcaacatggagaatgtctcatattggatcttgaggaaatgaagcttggcatccttgtactcgcttatgccctcatggatctccgccaacttgttccaaatctcatatgcagtctcaaggttgctcactctatcgaactcctcttggctcaaagagttgaacaaagcattcatagcttgggcattgagttggaggttgcggtgatcaatctccatcaagagcgtgccggtgatagcaaagcctacatccacaatactccaaatatggaagctcatagctttgaggtgagtagacattttaatttttcaagtggagtagtttgttccattaaacatgggagccttccctacatggttcacctcgttcgacatcttctctctaggcggtgaagcccaatcaagagagaccaagctctgataccacttgtaggatcgagatgtcgactagaggagggtgaataggtgatttaaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcgatgcttagcaatcctagggtgataagatttcaagtttgtctctagaaatgtaaattgcacaaatgtaaatgcaacaatcaaatggacaaggagacaagagatttttcaccgaggttcggaaactcgccggtttcctactcctcgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccagcgccgggcctcctccacaatcttctcggagaggtcaccgggcaactcctccacaagccgtctaggaggcggcaacctccaagagtaacaagtgatgacctggctcggagatgatcaagtgccacactagctctacaatgaagcaatgcacgtgactcctagctaatcaaccctcaatcacactaaatggatgaacacaaacattagagagtgtgagagtagtcaactactattaggtatgtggtatccataaccctgacagtagcccccgacttcaatgcaaatgaacgaattcatattctcaaccacgcgcagaccttggagtaactattatcgagctcatgtgaccgttctcggtgagttcagagataacgtttagacttccctatcagcctcgtgcgggcacctatagggtttgtctgatctccgatgtcaaccaagaaagaacagagcatacgactaagtctcccgtcttgctgtaatcgagaatttagattgaagtcaagaaattttatctcggtgggtacaccatctcttcattccgtattccttgtcgagatccaccaaccgttctcgagtaatcgagtaggcgtagagtctgcgaaggagccttgtcaatatttgt

SEQ ID NO: 64481 - DNA, 1367 bp, Oryza sativa
accagccaactgaaatactaccattagtaaagaattttttaaagaaccgtctatcaaaatcattatttttaaaaacagtttactaaaaggattgtacgtaaaaattctgtcttcacagatggtttgcttaaataactatgcttaaaaattggagcaatattaatattaacgatgaaatttggcaactgttattagttaagaccgagtcaagggaggatttaacgctatgattatagtagattcggttggaaaatgtattggaataagttgataagtgtcatggttatggataatgcataccctctatcctacgagtcatggaatgtagggatatcttcgtatgtacggtaaagctctgtatgcgataaggaaatcgacaaaagattatggaaataaattatggatgcttactgatgttagttttctgttgaatttctaatattgcagttatggagcatcttggaagctcaagcattgcgcgtgggagaggcaagaacaagaggatttggacgaactttgattgttcaagttcgctttagatccaagctggaaatcagaaggagatttcaaaaatggatactgcaagttctagagaatgtacttgctaagaagttgtcaagttctagccttactactgttccgcacattgagtcgagagtaagacactttaggactaagtttggcgtaattgaagtgatgctaactaaaaagtggcttttctcgggatgacaacagaaagatagatgatacaataatgtgagaaacaacaatatgatgatcattgcagggtaagtcatcaaacaaagtatataattatatggagtacaaaatttatttattgattcataagtcgctattggcggactgcggccgcctgccgctaccaattagccgctattgcagcagtggggcgaggtgatatcaatctatttacattggccaccgaacaagtccaaaggtccggtcacacgcgtggggagaccaaagtggctgtactaccaaatagcatgtggctgctatactaacttgcgcatgtttctgtgtttctccgctgtgcaacgaccatgcaaccagccaactgagatatacctctcactagtacaaaaatcatctatataggttctaggttttcctttcgatgagaacataatattacacgtggattcatgataaatcttatttgaaaatagcggtggttttttaaagaaccatctatcaaaatcattacttttaaagaggttactaaaagaattgtatgtaaaaattgatcttcacagatggtttgcttaaataactatgctaaaaaattggagtaatattaatattaacattgaaatttcgcaattgttgttagttaagatcgagtc

SEQ ID NO: 64482 - DNA, 956 bp, Oryza sativa
cctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacaagttggtatcagagccatctcgactgtaggataagccaaatggtcaaaccttaaggactatttttccgaaaacataatttgtgaaaattttcctttcttccttatctagaactctttgcaaattgtttcattgtctactctcttctctcgttcaacttgagtagttctgaaactagtggttgaaacttgaagacaccaatgaggtctacttaaggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattgg

SEQ ID NO: 64483 - DNA, 6706 bp, Oryza sativa
aattgaaaaagttcaaaaaccctttccctctaggcaccgacatgtggggcccacatgtcaggcccttcttcttcctctagcagccggccggccgagcccaagccgtcgcccgagccgccccttttctccctcaaatccgctccaatccggctctttttcttccgggtttttgaggggattttatcctctcgtcctcctctatctttcccctcaataatcggagcaaatggttgagtatcttgcccgaatcaaactcgttttcgagtttatctccaaaaccgagttttgattttctcggatcgatttcttgcgggaggagtccgatctcttcaatccaaggctataaataggaccccctagttcccctctttcgtttgccccatctcccgtggtctcccgtgctccgtagagtcgccgccgcgcgcacttagttcgccgccgccgccggccgtcttcagccacgccgcgccgtcgcttgcgtcgtcgccgccgcttgccgccgccgccgttaggtgcgccgtggtgaggagaacctcggccgcccgtcccccttcgccgccgaccaccggagctccgccgtcgccgtcaagccgagccgccgccgccgtcctcttcgtcgccggccatcatcgttcgtcgtttgtcgttgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttctttttttttccttttttctaatagatgaaatcttcggaaaatcataactaaataaccatagatccgtttcaggtggttcaagttgctaaatttttctaaaataaagatctacatattaaaattgtccataaattgaattaaatttatttaagtctttttaaatggactttaattagatttaatcttgtaaaattcataataaattcatttgaagtcggaatgaggccgttcaagtctcataattcatctaaaattatgatctacatgtttttttactttttatgtactgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataaggggttgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattgtcagtttgtgtacctcggctgattcctggacgaggatttcatgcacaaattagttcggaaattattagtgaatttccgggcgtgacatcaacgcctccgacccaagaagatgtgcgtagggggctggatgcccgcctcagtatcgagcgctggcgcaatggtcgtcacgcttcccacgcaacggaaggcgcttcctcgtccggagcgccacttcggttcgggcgcgggggccagccccccgtgcccccgattggtggtgtcggctgtcgagcctttgtggcgagccttcggaacgtccgttggcccccaaggttccggcccaccatcaccgaaaaatatgacggaagcgtcaaccccgccgagtttctccaggtctacatgaccgggatcgaggccgccgggggtgacgacagggtcatggcgaatttcttccccatggccctgaaaggacaggcgcggggttggctaatgaacttgccgcccgcgtcggtccactcttgggaggatttgtgctagcagttcaccatgaacttccaaggcacatatccgcgcccaggtgaagaagcggacttgcatgcggtacagcgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaagaggcctggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacctgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagtggacgaggaagtgggaggaggagaggaggcaggagcgccgtgagggcaaggccccggcggctccctccggcaaccggcaaagtgaggccaagcagaaggcccccgcagaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccaaccacccgccgtgcgttgcccggggaggacagatcgcgatggtggtttcccccaccgttagcaacgtgaagttggggcgtgtcctcatagatgggggtgcagccctcaacatcctttcccccgcagcctttgacgccatcaaggccccggggatggtgcttcggccgtcccagccgattgtaggtgtgacgcaggggcacacttggccgctaggtcatatcgacctcccggtcaccttcggtggatccgccaacttccgcacggagcgggtgaacttcgatgtggcggacctcagtctgccctacaacgcggtcctagggaggcccgcgttggtgaagttcatggtggcggtccactacgcctacctccagatgaagatgccgggccccggtggccccatctctgtccatggcgacctcaaagtcacgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaagaggttgccctgggcgacggcccgtccaagaccacatgaatcggtggtcttctggacggcaaataggaagacgcgctcgtctccttcctgcgggcaaacgccgacgtcttcgcctggagaccggcggacatgcccggggtccccagggaggtgattgagcaccgtcttgccgtgcggccgggcgcaaggccggtccggcagaaagtgcggcggcaggccccgaaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccattggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagcctccgctccgcccgcataaagctgaaccccgataagtgcgtgttcggcgtgcctgcgggcaagcttcttgggttcttggtctctgcccgaggcatcgaagccaaccccaagaagatacgagctatagagcggatgcgcccccccagcaagcttagggatgtgcagtgcttcaccggctgcatggccgccctaagtcggttcatatcgaggctgggagagaaggcactacccctatttaagctcctcaaacactccgggccgtttatctggacggaggaggctgagcgggccttcactcagttgaaggcgtacctcagttctcccccagtcctggtcgccccggagccagatgagccgctgctactttacctagcagcaaccccgcaggtggtcagcgcggcgttggttgtggagcgcgacgaggacaaccctcaccccgcgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctctcggacgaagagcgccctggagatgcggcccctagtgaagaagatcggccccgccgaaaggtgcagcggcctgtctacttcgttagcgaggccctccaggacgctaagacctgataccctcaggcccagaagatgctttacgctattctgatggcttcgaggaagttgcgccattattttcaggcgcatcgggtcacggtggttacgtcttaccccctcggccaaatcttgcataaccgagagggtactggacgggtggtgaaatgggcaatcgaactctctgagttcgatttgcactttgaaccacgccacgcaatcaagagccaggccctcgccgactttgtggcagagtggaccccggcccctgagcccatctccgtccccgaggccagctcgggcccctcgcagctgcctcacaccgcctactgggtgatgcagttcgacggctccctatctcttcagggcgccggtgcgggggtcacgttgacctcgccaaacggagacgtcctcagatacctggttcgcctcgactttcgggcgaccaataatatggcggagtacgagggactccttgcgggactcagggtggcagctggactggggatccgtcgcctcctggtgttaggcgactcccagctggtcgttaaccaggtctgtaaggagtaccagtgctctgacccgcagatggacgcttacgtgcgccaagtgcggcgtatggagcgccattttgacgggatagagcttcggcacgtgcccagacgggataacgcggtcgccgacgaactttcaaggctcgcttcctcgcgagccagaccccacgggcgccttttaagaaaggct

SEQ ID NO: 64484 - DNA, 5379 bp, Oryza sativa
tcacagataagactctacccgaggactgcgaagggagtgaacgcatccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcattactgctcggtttgggatgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttgccagcggtgctctgggcgaaccgaaccacgccaagccgagcaaccggggaaacgcctttcttcgtcgtctacggcgcggaggcggttctcccatccgagctcaccctgaggtcccctcgggccaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgcggatctccccaggcactagccccgacccgcgccatttgaggctaggacctgggcacgagccctcgttcaagccaagacacagaaggactgcggcatagaccatcctcgtctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcggagtcgagggcgaacgcgagccgaggggccgtaccctcgaagctgtggacgatgtggtcggcggcgtcccggacctgtgcgcgcgcgccatcctcggttccaggagggaactcgtccagcgttgcccacggggagaagtcagggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccagaggctcgcctgccgcccggcgcggtctagacgggagacggcgtcccgaagcatgccgggccctacctcacctgccaagcggagggcctcgacctccccggcggacgagtccagcgcgccctgcagctcggcgatggtgtgttcggcggctgcgaggcgggcggctaggtcgccgtcacccgcggccgccccgccgctgcgcgctctcgtgtccagctccttcgcccgcgcctcgaattcagcggcccgctgatccagtgcggccctctcggcgcgggcgccttccagattgaggcgcgcctgctcctcccgcagctgcgccgcggcctcggcctcctcgagagctcgctcccgctcagtgagctcgtcctcgtggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccccccggctcccgtattggaggcagaggtcgtcccgcgccgcgttaaacacggcggtggcaatgagggcagtctcccgctcctcctccacctccctggcgatctccgccaggtccctacgacgggcctcgagctctgaggcgtgccggcggtgtgccttgcggcccgcctccaccatggcctccaccgagcgtcgcccctcttcgacacgcgcccacgccgcgtcgagctccgcccgctctgcctgcaggacctccatctgggcacttaacccgtccaacaccgtggtgttcgcggtggccaaggcctgcagaaggggctcagcgctcagtggggcagcggaaggcatgggggagagccgcctcggtaaggatgccgcacggctcggcccgccgatcgacgtgccggactcggggacgtcccccgaagctggctcgtcctgagcgtcgcccgaggggtcgggcccgagcggtgcgcccgcgacctcgtcgtgggtggcctcggaagtcgtcgtcgcctcgggcggagtcgggtcgggggcttggcaggccgcccggcgtgcgcgcgccgcctccgtctcccggacggactcctcggcccggtggagtctggcctcctcccaagcggcttcctcagcctggcgagcccggacagcctcctgggcagcttcctcggcttcccggaggcggtttgcggcttctcgccggtcagcttcccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgtgagaatgaatacggccgcagtgggcgcagggacgaacctgcgaggaggtcggctaaacgaccaccttgggggggagatgaggtttccccggcatggttcggtcccccccatcttgcggagccgcttcttttttcgctccccctcgggctgcgacgtcggcacagcacccttcgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggatcgcaaaccagccaggcggtcaagaacggcgtcgtagccgtctcccagatctaccggcgcccgccagctggaggcctgcgctgggggctggctcggaagtcggaggcgcgcttcgtcggcgagaggggtgtagaaccagtcgctcttccagtgatcccacttcttgcgaaggacgcagggaatatagcggttcagcaccggcccccgcggctggaagtagcagccaccgactaccgacggtggcgacaccggctgtacggtgaagaaccaccggaacaaccagagagatgggcgcaccccgatgaacatctcgcacaggtgcgcgaagatggccaacgtcattactgcattgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcagcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgccaactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacgaaccggctcgtcccaattcgcgcgctactcgagtaatgtagcggtcttgaagaaagccgctcattattgtcggtcggtttttcccttgccgatgcgcgcgatttgcgaccactggattcctgtccgcttttagagaccggccccacctgtcaccaggcctgaggagtggcgtcacgcccgagcgttttcctcgaggagggtgatcgccctggcataaccccgggggctactgtcggtgacatgggaccggggatatcttgactagaggtttggggcagccgcggtcacccacgtggcctgaccccctcgggggggtcgggcccgagggtgatgagaccgcccctccctctatctccccgaggggtcgggccgctcccgtttcgtccccgagggctggggcgccccgaccccctgagggtttggcgccacgtgtgtgggttagatgagcacagcggcgctcacctaaccgcg

SEQ ID NO: 64485 - DNA, 1059 bp, Oryza sativa
cacgttgcacctgcttccggcggagtggaggttggtatgacccatcccatcggaggctcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagaggggggactggagaaaagaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgctccgtcaatgtcctatacggaaacaacctacggatataggagggagttccggataaggaaagacaaccagagttctacatggaaacgacaaggactactcggattgtatccatattgatttccctagttctacttggacaaggggacacctatgggtataaatacaagcctccctaggaggacagggggacacacacgcccaccacgagacaatcaactcccaacacaatcaacatagaagcctacatacaccaagacaagccgccggatatcgacatcagagatacgcctggatcgaccctatctggtaccttcagaggccggccgtagggatctagcactgtctctgattccgtcgggtgcgagctcgaggaggaaggctaccctgttgtcgactacgagtcagaccttcagaccgccatgtcgacaacagttagataggctaccctacatattgtactggtgtgattatggtgaataaaaagcaacatcggctccggccaacaggatgtagggctattacctgatagctcaggg

SEQ ID NO: 64486 - DNA, 2244 bp, Oryza sativa
tggactctccgacaacaagctactcgatgacttcggctgtgaggagatctaacccaactgaagtacatcttccgaccagatcggaaccatcatcgtcatcgacaacttggtctatcgagatcatccaagcctcaagatacgcggcgtaccaaaatatgtcagatcatattatgtccaacgagtacacaataaggtaattggtagattggtttttcaaattgatctactaatttcgtagatacagccggcatgtatctacaaaggtacgcaatattttatatgcaatttatcgtacctattcagatcatacaatattgtcagatctataatttattatgtttacctagagcatgttttttatacaatatctattgcgcggatgtttccgacgttaaaccaactacggtctaacgctgggggctcgctctgttctcttctgtataaatcatgcttgtttacggtttacataatgcctgatatttaatctgctcgttatatcctgataatactagaagatccacgcagtttttgagtacatactcgatatcccctgctatatatcttgtcttctagaaaataattttcagaaacaattgagcactcgagtaggttgtagtcgagtacaccgcattatcgagaacgatctcgacaaatgcagagtcgtcgcgcccaacctaccaacgaagaccgacgacctatctcatagctccggccatcgctggactactcgagaaaagtttgttaacggataattcctcgctaacgccgtcggcttgatcacccgacatgattgcgaacggacatccggatatgctataagttgggtatgtgagtcatgctggccacataatatgcacatataataaaccaactttaacgcccctataggtaattaagagactcctactcctggttctcgaaccagtaaaatgtaatgatctctctcgcctcactttaagtggtcgagttacgactactgcctggtcctcgaccagcggcgtagcgtttctcccactacttctactttcagtggtcgagttacgactactgcctggtccccgaccagcgatgtagcgtttctccggctacttccactttaagtggtcgagttatgactactgcctggtcctcgactagcgatgtagcgtttctcccactatttccacttcaagtggtcgagttacgactactgcctagtcctcgaccagcgatgtagcgattctcccattacccctacttcaacaaagttgatgtcaggtacacaagatcgccaagggttttacccagagatcccttacccagatgacacctagcgctgaaacctatcctactgtccctttacgccgtcttgacaaggcctccgaggaacctaagggatcttcggctggggacgcctagagccgataaggccttgtcggatcctgtagagacgaaagaccatgtaagatctggtcatgtaagagttctcgccgtgcgtattaaccaagccgtgtaatcggaaattaactttccaacttcacggctgggggctaggatcagtgcttattcaaccaacgcaggtcaagggtccaagagccttatccttcgagaacgattctccgacgacaaggctgggggctagggagagtgtatgactctacaaattgactgatcgaagtcggtaagagagaagacgctcatacacaaaacattggtctgtaaatttatttcatttttagtttccatatatattataacatgtcaccctttgagcgttcgctcgggggctatttctatctgatattcttttttgagtgttgatttcaggaaaattctattcgacattgacgaagactccatgtctctatggttctacaccaagatcgactaaggcgagtacgacaaatgttgacaaggctccgtcgtagattctgcgccttctcaatcactcgagaacggttggtgaatctcgataaggaatacggaatgaagagatggtgtacccgccgagataaaatttcttgacttcaatccaaattttctattacagcaagacaggagacttagtcgtacgctctatactttctcggtcgacatcagagattgacttagacaaaccctttcggtgcccgcacgaggctgacaaaggaagtctaacgttatctctgaactcaccgaaaacgttcacatgagctcgataatagttattccaaagtctgcgcgtgattgagaatatgaattcgttcatttgcattaaagtcaggg

SEQ ID NO: 64487 - DNA, 1263 bp, Oryza sativa
ttgtttgtactttaactaaatttttattccttctaatatatccggcaaatctccagccatcttaagtttcaaaaaaagaatgccaggcaacccaaaaaaccgatccgattaaaccaagcaaacccacccctacgtgatactatcatatacccctgataatttcacaaaactatttgtgcagttgtgctccttagcgtgggagatgctgtgattagcggtagcggccggcaaggcccaaacaacattgtctcccttgagtagcctggcagcaatcgaatatagtataagtatatgctctctccgtttcacaatgtaaatcattctaacattttccacatttatattgatgttaatgaatttagacatatgaatgtgggaaatactagaataacttatattgtgagacagagaaagtagtatacatgaacccactacagaatcatgaacattaaatccaattgcgatcaacatcttgacaaattgttcaccacacaaaagtaaatcaacacaatgatttcacacagtaatagacccgatatatggagaaaagtacctaactttgttttcctgtcatcagatggaatggatcactactagaaaaaaagatttttccaggcggcccaaaaccattttcacaggaggggaagaggatcgccgctaccatctcgactgtgaaattaaaccattttcgcaagcgcgcccgtggcccgccagcgaaaatcatcccaggaaaataaaaaaaaccacggggcaccgccggccagggctcccctccacccgtcgtcgtcggcgccgtcgtcgtcgtcatcgtcaccgtcatcgtcgttgtcggcgcggcggcggagggggcgaggagatgaagcggctggtagaggcggcgaggagggaagccggcggcgcacggatctggagccgtcgtcgtcgctcgtcgtggccggcagcggagggatgcggcggcgcgcggacgttgtcgtgaagggagccagtggcgcggacgtgggagaggagggagccggcaacgcgcggatctggagccgtcgtcgtcgctcgtcatggccagcgacggagggatgcggcagcgcgcggacgtcgtcgtggagggagccgacagcctggacgtgggagaggagtgagccggcggcgcgcggatctggagcggagggagccgtcggaggcgtcgcggttgtcgtcatcgtcgaggagggaggccgccggtggcgaggagggatgcggcggcgcacggacgtcgtgtggagggagccg

SEQ ID NO: 64488 - DNA, 1112 bp, Oryza sativa
tttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaatccataatatggtccactcgtattgtcaataggacagaggccagcatgaacacaagtgttcttctccacgacagtggaaatcttgtcatacaaagcacatctaatgcagtgctgtggcaaagctttgactacccaacagatgttgctcttcctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttcc

SEQ ID NO: 64489 - DNA, 701 bp, Oryza sativa
attattacaagtaacatataaattattagtcaggttctctctactataatctttccacgagattaaataaatacgataccattggaatactctcgggtgaaatgctacaatggtatatccgtgcgcttgcggatgaactctgtaaccataatataccaggagtatttctgcgccattgctgggaattgtatttctagtaatgtcgttaagaaataccaacagttgccttgctcgcatgccccaccaaaccacgttgctccccttttcgacatcttctccttcttgcaacctccgcatcaccatcctcaatcttttaagctctgatacacccacatcgtcgccctcttccatctttggcaagtttcacctggcaacatggctctcttctcctcgcaacctcatttccacaattctcctcctttgtactcggctccaatgctcccacaccgttggcctccaccatctcgtgttgctctagcttcaacacatgcccaccatcctcatcatctcccactgctgaggcgacacaaccatcgtcctagctatccctctaagccgacaaacacatctcactttctcatcctgaccttattctcccctaaccttaaccctgcaaccctatccattcgggagatcacttgagatgaaaccaggccatgaatcatagggcaagctctaagctgtcagggacgcggtactcc

SEQ ID NO: 64490 - DNA, 952 bp, Oryza sativa
  unsure (1)..(952): unsure at all n locations
gggaggaccccacccgttcgggtggttcggccctctccccgctgtcacgcctaaanattcccgagtagaattccaagcagaatgtgcattaaaatccccgtccaggaccggccggggtacacaaacgacaatgttgacattcagatccacgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatacttgagctctggggttgggaaaaaatagagcaagactgagtactacccactgtactcagcaagtcataccggaataggggtatgatgcagggaattatcaaagaagagctggagtggttcatttgcataaagcgagcatttataaacagaagttgaaagatttaaacagttgtaataattaattaatattaactatccactgtccaacgctatcccacgttgcaacaggcccaaccatccacctaaactatccaatttcaaaagattacactagggtaagactaatcacggtgaatctggttgaccgcccataaccgcgggcacggctattcgaatagttttattctgatcagaggtgtacaactgtacccacaagacacagccccacgacacgtttccgtgcgccgacatgccaccacgacataccggaaagaggccgtgacaggacccttcgtataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcgactagaggagagctacactacaagc

SEQ ID NO: 64491 - DNA, 1463 bp, Oryza sativa
acccggataaggataatcggaacatcctaactctcaaggcgtccacagccgatgcttcaccacactgagcaaggtatcggctgatgtgctcataattaagttgacacaccctcttgccctgagaacttggagaaatcagggattttaaaccgattaggaaggggaaccctttcaaaccacttgggataagactgccgatacaaactcccagtctcttttggtctaagcccaaattgctccctcattacatcagcaatgacatcagcccatggtcgttgctgagctgctccttgtggttgctgctgcatgggctcgaactgaccaaactgaggagtgaactgttgctgggccgatcccgctggttgatattgggcttgcggggatggaagctgacaatgatagctcaagtttccccctggtagttatgtagattcggctgaatgttgcgcaccaagtgctcaggaaccatctgaggtaccacggtgccatccggttgtgcatgatgaaccaaatgctctgggataacttgattcacaaactgctgcgcaggttgccccccatgtactgcaaatctagccgatgcattggccggccccaggcgctaaatcggctgaacgacctgcagtcgtaccggagtctgctggatcagctgaggtcgttgccttggcggtgtttgctggattggttggagatgctgctgcgttgatggtgcttgctgaactggctgcacgacctgttactggatcggctgtaccactggctgaattggtggtgtctgctgagctggctgcgcgacctgttattggatcggctgtacaaccggctaaattgatgacatctgttggatcggctgctgctgcactagatcaacaattggtggtggtggaaaaaacatagcagcaacctgatcttgagtcggctgattcgaggtttgtccagcaagctgtggatgttccctcattagcaatcgagggttgatcggctgagctgacgccgtggccgatgtagcaggtaagggcgttgatgctggcgctgttggttgagtcgtggatgcgacagatggagccgcctgcacaactggctgagcatcggtgatcaaagttcgataattcagaaaaacgccttcttgcaagtacaccgggcctgtagcctgatgctcagctatcgagccatcggctatcgttttcatcatgttcgacagtgtattgactaagacctcggattgattgatcaaagcatgatgcaccgcgtaatcaacccgatcttgaaagttgttgaaaaaatcttgtgctagctcaatattctgattaagatttcctccttgcggcccttgagcagaatcacctggagctccgtgcacttcttgagggttatcgccttgatttcctatagaaccaccgatagcacccttgttgctcggctgattcgagccatctggggcttgtttcacttctccatcctta

SEQ ID NO: 64492 - DNA, 846 bp, Oryza sativa
cgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagagatctgccgccccaagcgtcgccgcgtctgccgcagccagaagatcaccgcccgcaagagcacctccaggcctgagcttgttcgttagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgggttgtgtggggcacggttatgccggtgtgtggtgtaactgtgtcggagcctgtctttatttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccaggagaaatgctaacaccggtgatggcaaccaacctgaaggca

SEQ ID NO: 64493 - DNA, 73430 bp, Oryza sativa
gatgaaatcctacacaaaacgacatcaatactcttgttttttagcagtttggaggtttggtcatctctggcagactggtactaattgaacctactcctatacggctaatgggttcaataccgagatacagtaagggacacaactataccgagagtgctagctggatagtgctatagagagacacccttctttcaaaaaaaaaaaaagctcactcaatatttatgtattttttttcttcttagagaagtttctcttaaattacttatccgatttataattcgattataccgttgtgttcgttgcaattaaatctttacaacaagatcttacataattatattttgatgaaaaattatatattacttttatcatatatctaaattacctttagatttcactaaattacttcttaggcatataaaagtaattcaataaaacctaaaagtaatttatatatattatagaagtaacttataacaaaaggaaagtaactttaatgaatacctttttccataggacatgaagtcatattttatccatacaacgaatttacttctaatgtcgtgacaaagttacgtccgttttattttaagttatttttataatatatgtaaattacttttagactttatttaatttacttttatatgtctaagaagtaatttagttaaatctaaaagtaacttatatatatgataaaagtaaattatgtatataataaaagtaatttacaaatataaatatgttttcatcataatataattatgtaagatcttgttatgaagatttaattgtaacgaacacaattgtgtaatcggattgtagatcggataagtaatttgagagaaaactttgtttgaagaggaaaaagggcatgcatgcatgtcgtacgagtacgatgtagtagactccatgtcttctccatatttaggtgtcgctggttaagataaaaacgagaggcctctccaaatagatttcacgtacaataagctattaggctaagcattattttcaaaaatacctaaaatacccttgcagacatacaaaattaacaattgatttatttcattagaagtttaaaaaaatatgaaaatttttacgtggcctcattacacaacatgggagtttgtatagatgtttcaagtttttttctggtatatttaatttttagaattttttttgtggtatatgagagaaaatttgcttatacgagagaaatatcttgtgtagtgtatgaaagatgatttatattaaaaacatcaataaaaaatattttatacagcatataacatataagttatactttttctaaaaaaatataaatgtaaaataacctatatacaaacttccatgttttgtaaggaggccacacaaaagtttggtaaaatttgctacagagtatccttctaaaatttgctataagttatacattaaacggtaggagatttgccgtatatattagaagaaataaaaccaagagagtgcagaaacgaaaacaacaacaggccacaacaagtcctgtgacagaaatttacaacccaagggaaaaaaaagactgtgaaccaggttctatcaacagcagtagagcctggattggttgattaggtctatattctctttaattagaaaggccacctgaagctcgctttttgaagaatcctggaaaatcctcctattacgttctaaccaaatattccaccacgttgttaaaaggacactcagaatttgcttccttcgtgatttaggcttgatcgtgcagagggtgctccaccagtcttcaatggaagctgctgtatgttgatgcggtgcttgaatgtcgaaccatctactaacatggtttccaaaccaaaatcgtaaaggggcactcttttgctagatgtgtggcatcctcgaaggccccccctgcataaactacaaatccagtagtttacagaaaacatgattttctctaatgatgttacagagcgacaaatatttatagttttgccgtttgatttgtttcttttcatacgaggtgatcatatttaatttacatcatggatctcctagttcatcgttcattaaattcatatatgaggccccattacaaatattcagaccgctatgattggtgaatttgtggatagatgtataatgtaaaacaaaacccgtttcatattataagtcgtttaatttttttctagtcaactttataaaaaatatagtattatttttaatcaaaaaacaaacgtattatcaaaatatatgtaattttatatccaataaaattaaatttgatattttagatgctgctaattttttaataaatttgattaaacttaacaatgtttgactaggaataatatcgaacgacatataaatatgaaacggagggaataccaatcaaggccactgctatttttttcctttcatctttaaaactttcatccaagattttatatgaaaaagtatccgctaagaatgcacgttccaaataccaatcaaagcggcgcaaaaaaaaaagacagaattgtaattctgggctttacgtgggccgtaattggacccgtcgatccccttgacggaaaacccaaccgacgccgccgcccgatccatcggcggccggcggcggccggtgggtgatgctcggcggcggacacgaggtcgaggactccttcgacccctgcttcaccgacgcccacaccgtgtcgccttcccgcacctccactccgcgcctcctagcttccgcctcgtcactccgccggcggtgtcgccctacgcgaccacatcgccggtgggcggtggcgtcaagctctgtcagggcggccggagactccgcgctcatccggataacctgcggatcgccggatcatctgcagcatatacaaggtaaagtaaaactactatctcccatttaattgctaggttacctaaataattgttagtacatatctgaatgcactactctacgattacaagacgagaaggacttattatctcataatttaattgcaggattattattatggaaaattacgggtctgagtggctgagattttcgtttctgatgaatctcactgatgttgaacaatgatcacagagcaagtcgcctgctgtcgtgtcgtcgtctcaggttaatcgtatcccagaatggagttaacatgggaccgatcaatccaccaattgttagaatcatataagaattcctttcaaaaaaaaaaacaaaagagagaaaagaatcatataagaattacttgtggaactggaagtataataaaaccgttggcgtcatgttgtcaagggtagtatactgtatactggagacggaggctacattattggccacttggtcatcaggtgagatgaacaaacaggttagctctacatagatcaataatataattgcctaatcaagacaaaactatggacaaaaagttaggtaatcctccattttcactgaagattagcctcctctctgaagaaaaactggtgttgagttgaattccatgggctggtagctggttgagttgaaggccttagcttgccatgatagtgcagacgccatggctcttactgctacaaaaatgaagcagccgacgatggccacgaggctggctgcaggctgcaccctctcgctggtaacccctcacgaatgcatatattgattgatcttttaatttgtttctatgttcatcattttgttagttccatggaatagtatataaatgttggatcaatcgtctgcttttggggattgtatggaatgagcctaactatacctacaggcttgtttctgtctgtaaacttattgcgtactagatacagatgattagaaacactatatttcccttttttggtgagattgtcagaaattattacttctgtgttacctagaacttatttgttcagaatatcagatagctttgctagctttctggctttcgtcctcctttcaggtctctgacactagagacttttattttccaccgattggtgatcatttatcttgctataagcctttatgtttcatccctgactcttctgtctcaatggcagttggattgatcagcccgtatcagcaaaggatttttcatgttgctgaatcttgccagaggaaaggatatcaattctgtctgtggagacgaagtaaataagaacaaaagctttcttggtactttacatttgtctatttgccaacattctctaaccatctaaaacagcttctgaaattttaggctcttgcatgttctttaaaaaggattactaaccgatatgtattaatccctttctcttttgtctatgcatataagcaagacctaaatttattcgtccaaggagctggtcatgaagatcactgcaattgggttgtttttgttggtgcttatagcgagctgtcctgtccaaatcttctgcagttcgtcgtatggaaacgagacagataagctctcactgcttgagttcaaaaaggcaatcagtcttgatccccagcaagccctgatttcttggaatgacaccaatcacttttgcagctgggaaggagtcttgtgcaggaagaagacaccccttcgtgtcatttctcttgaccttagcaaccgaggtttagatggacaaatctccccttcacttgcaaacctaacattcctaaaatttctttacctagacacaaattcattcacaggagagatccctctatccctcggtcacctgcatcacctccaaaccctctacttgagcaacaacacattagaaggaaggatacctgattttacaaactgttccagtctcgagattctattgctcaatggcaatcacctagctggacagttgaataatagctttccttctcagcttcaaaatctgatacttgcagaaaataatcttactggaaccatcccttcttctcttgccaatatcacaggactaagaggacttagtttcatgtcaaacaatatcaagggaaacatcccaaatgagttttcaaagttcgtcatgatggagcttcttgctgtgagtggaaacatgttgtcaggaaggtttccacaacccatcttaaatctctctactctcactaatctttaccttactttgaatcatctaagtggagaggtaccatcagatctccttgactctctacctaatctacaagaacttctactgggtcacaatttttttcgaggacatatccctctctcattgggaaatacttccaacctacgtttactggacatatcaaataacaatttcaccggcattgtaccaagttccattggcaaactaaccaaattgtctttgttaaatactgaattcaatctactccaagcacacaaaaaggaagattgggagtttatgaacagtttagccaactgctctagactacaagttctttcgatgggacataaccgtctagaaggccatctaccaagttcgttagggaacttatccactcatctgtgacaacttattttctcaggaaatcagctcaggattttttccttccggcatagaacacctctccgacttgaattctttaggactagataataatgaattaacaggttcccttcctgaatggcttgagaatcttaaaaagttacaaaagttaaccttgcaaaacaaaaatttcccttcctgaattgcagttattccgtcatctgtttcgaatctgtctcaactagcagttctcggactatattctaacaagttggaacggcacataccaagcttcgtaaacctgcaaatgcttcaactactagtcatttccagtaataatcttcatgtcagcataccaaaagagatatttagtattccatcaataattgcaattgatttatctttcaacaacctagatgggcaacttcctactgagattggaaatgctaaacaactcgtatctttgggactttcatccaacaagttgtttggagatattcctaacagtttggtaagttgtgaaagtttggaatacatcgcgtttgactctaatattctcagcggaggcatcaccacttcattaggaagcatgaaagagaggattaggctttcgacccaaaacgaggaagaattttcattaaaattttttaattataatgtattgcgatcccaatatttcattatatttctcatcctccaatagctattgtattactttaaaaaaacatcattacccgttgcaatgcagacattttttttagttttataaaaagaaaaaaaaggacatgcctgacctagcaaaatagatttgtagcttgttgttgttgctgtagttaagtactaacacttctctcatgcatagatacatgatgcaacggacctcgggtgcggtagaccccgcggtctcaggcggtccactgtccagcagcggcgataagccaccagccacacatgaagaatcggcagtggtgtggagctttgtttttcaaagtcaacgggaagtcctcgcgcccaaggaccattaccagatatgccgagcgcgcaatgtggctgtccaaacccaaacaagcctatccggttggttatcaaccaacaatgtggcggagacaattggccagaaccactcatgatggccgctcatttactcaatggtgtacaaaactacttgaccgaaagacgcgcacaaagctagctagtttcctctgagatatgaatctttgattccgtgtagcttggcagcaacctcctgcatgctgatgcgttcaatcggtgttgtcttggtgcagcagagtccaatatttagcacactgcgcaggcagtgtatgcctttctccttgactgccattggtgtttcttggcaaaggtccagctcgtgttgcagctggggatcaacaatctctagtatcctgtcagggaagttcatctctacatgctttgcaatgctcaatccatccataaacatgtcttctgttggccttctccgaataaataattccaagagaacaactccaaagctgaatacatctgaggcagttgaaacttgaccgccctctgagcattctagagtttcatccagcaagagttaagttcacacaaatcagcatgtcagataataaaataaaacttgcagcggtgtaatacaagaaaaacaaactaatacctgatgcgatatatccaatggttccctttattgctagggaataagttgagcttgaatcccctagagatggtgttgaagaaccggtcttgaatcttgcaagtccaaagtctgcaacatgagcaatcatatcatcatcaagaagtatgttgctaggcttcagatcacagtgaacaatagttccttggttgttatggtgcaggtactccaacgcatcagatacatcgaccacaatgcttatcctctgagccaatgtaatgtggttcagatatgaagtgttttcatcattttgtgctgagtgtagtaatgcatgcaagtcacctcgtcccataaactcataaaccaaggccttaaaatcatttccttttgaatcaatacttgcacatgcagttaggataggaactaggttgcgatgccgaacatttctcaaagtattacattctgcgatgaagctcttttgtgctccccttgtctctaggttgaatactttgacagcaaccatattatcatcttcgaataattttcctcgatatacataactgtatcttcctttgcctatcaaattggatgttgagaacccccctgttgctctgaaaatcatattgtatgaaacttggggcaaatgcctagcaaacgagggcaaagataaagattttctgttctgttttcttctccacataagcacagtaaatttgaccatagaaattgacacaatgctggctattgggatcactactttcagtattattgatttcttgtgcttagatgaaaccaaagccatgataggacatgcttgtaggtgtaactcaggtggcccaccacaaaggccctgatttccatcaatcctgaaagctgttgcattcttgaaaattcctttcgtgggaatctcgcccttaagatggttgaatgacaaatctagttgctcaagaaattgtaaattgccaatagaacctggtattgaaccagttaaattattgtttcagtcacagtctagtccgctacacttttctgctcaacatgtctctctttggcctagcccgcaattggagctataagcccagctcgcacatactgtcgtgttcaagctctagaaagtagtcccatgcaatccccccatcaaattcggccaaatctttctcaattttttaaaattgattgagggcttttgatgcactcgaccactctttttgtttttcccaaaattgaagtgaatcagtaacactcgggataaaaacatccagggaagctccagctgccggccatcatcggcaactgttaaataggggattgaatttggtgaattaaagcagtattgaaagggaaaatcacgaggaaaacaaagatggaggagtgaggaatcgatttttacaatcaattaaaggagtaaacgtacggggaggtacatgatgttgcggtggctgaggcgcgctgcgcacgcggatcagaccggaggagatcgaacaaaaaccgggcaacgaaaaaaatgttccacgtgaaaaaaaactgcgaaaaaactagacggccattgaaaaaaaagggcgacaaaataaaaaaaaaacgagcggagacggaccaaaccgtaactcacggtattatgaatatctaagaagtaatttaatcaaatctaaaagtaatttacatatatgataaaattaatttaaatatataataaaattaattatatatatgttttttatcagaacatgaccatgtaacatcttgctataaaaaattatttacaacgaatataatgtataatccgattgttgatcggataagttatttgaaagaaattttatttgaagcttacctattaggaatcttttatttatactgttgcatgcttgcacactttgacgtgagaaaaagatatattgctacattttaccatttattggtataatagttggttttgattaattagtgcacatgtactcggagaaaactacacgtcgggcgctcgatctgggggtggggaaatcgggcagcatgcaaaactaatttaaattgttttttctcttaaattatttatccaaattatgatccgattacaccattaaattcgttgcaattaaatctttgaaacaagatcacacatggatgtatttcgacaaaatttttttagcttattattgaattatttttaaatgttgcacgttgttccaccaagtatatcggaattgtttcactaagtagatcgaaaatgtttcaatcgtttaaatcggtcgttgtttcacctatataaaaacaatgttttagcaaatagcgaaagaatgtttcagatcactgcaacatttgatccatacatagtgaaacattataagtacactaggtgaaacatttttggtggaacaaaaattgaaatgaattcccttaataaagggtttccataatatgtaggtgatttgttgcaaaagaatgtttcaattcactgcaacattagatctatacatagtgaaacattgtgagtatactatgtgaaacatttttggtggaacaaaaaatgaaacggatcacctagttggacaactgaataataattttccccctaagcttcaagtgctgactcttgcatataataatcttactggaactatcccttcttcctttgccaatatcacaggacttagaaaacttgatttcacagctaacaatatcaagggaaacatcccaaatgagttttcaaacttcctcatgatggagattcttcttttgggtggaaatatgttgacaggtaggtttccacaagccatcttgaatctttctactctcactaatcttcaccttagttttaatcatctaagtggggagctaccatccaatttcctttactctctacccaatctacaagtacttgcattggactacaatttttttcaaggccatatccccagctcattgggaaacgactccaacatacgtgtactggacataacaagtaataatttcactggagttgtaccaagttccattggcaaactaagcaaactgtattggttaaatctttaatccaatcaactccaagcacataaaagggaagattgggagtttatgaacagcttagccaactgcactaggctacaaagtttctcgatggcttataaccgtctagaaggccatctaccgagttcgttaagcaacttttccgctcatctccaacgacttcatttaggaggaaatgcaatatcagagtcttttccctctggcatagaacacctctcaaacttgattgctttatcagtaggaactaatgactttactggtacccttccagaatggcttggaaatcttaaacagttgcaaatattaagtttatatgacaactatttcacagggtttattccatcatccctttcgaatctgtctcaactggtagctctcacactacaatttaacaagctggatgggcagataccaagcttaggaaaccagctgcaaatgcttcaaatattcaatgttttgtacaataatcttcatggtgtcataccaaatgcgatcttcagtcttccgtcattaatacaagttgacttatcttacaacaacctacatggacaacttcctattgacattggcaatgcaaaacaactagtatctttaaagctttcatcaaataagctatctggagatattctgaatgctttgggtgattgtgaaagtcttgaagtcatcaggttagatagaaataattttagcgggagcatccccatttcattaggcaacataagtagcctaagagttctcaatttatctctcaataacttaacagggtcaataccggtatctcttagcaatctacagtatcttgagaaactaaacctatcattcaaccatcttaagggcgaaatcccagcaaaaggaattttcaagaatgctacagctttccagattgatggaaatcaggggctttgtggtgggccaccagccttacacctaaccacatgtcctattgtgccattagtatcatctaagcacaataacttaattttactgaaagtgatgatcccactagcctgcatggtgtcacttgctacagtcatatctattatttttatttggagggcaaaactgaagagagaatcagtatcgttgccattttttggtagcaatttccccagaatttcatacaatgctcttttcaaagcaacagagggtttctcaacatccagtttaattggcagagggagatatggttctgtctttgtagggaaactttttcaagaaaacaacgttgttgctgtgaaagttttcagcctagagacaaggggagcaggaaagagcttcatcgcagaatgtaatgccttaagaaatgtgcggcatcgcaatatagttcctatcctcactgcatgctctagtattgattctaaaggcaatgatttcaaagctctagtgtatgagttcatgtcacaaggggacttatataatttactatatacaacaagacatgatagcaactcttcaaagttgaaccacatttcattggctcagaggacaagcattgtgctagatgtatcaagtgcattagagtacttgcaccataacaaccaaggaactattgttcactgtgatctgaaccctagcaacatccttctagataaaaatatgattgctcatgttggagactttggccttgcaagattcaaaatcgattcttcgtcaccttctctaggtgattcaaacttaacatcttcactcgcaacaaggggaaccattggatatattgcaccaggtactggttgggattttatcttgtttggtatatattgctacctattttctttttactattatgtgacatgctgatgtgtgcgaactcaaatattgccaatgaaattgtagaatgctcagagggcggtcaagtttcaactgcctcagatgtattcagctttggagttgttctcttggaactatttattcggagaaggccaatagacgacatgtttaaggatggattgagcattgcaaagcatgtagagatgaacttccctgacaggatactagagattgttgatccccaggtgcaacacgagctggacctttgccaagaaacaccaatggcagtaaaggagaaaggcatacactgcctgcgcagtgtgctgaatattggactctgctgcaccaacccaacaccgagtgaacgcatcagcatgcaggaggcggctgccaagctacacggaatcaatgattcataccttagaggaaactagctagggatctctcatagcattgtgttcatctttcggtcaaatagttgtgtacaccattgagtaaatgagtggccattgtcctagtgaaatactgaaatgtggctttgtcaccacctgcgacaaatgtttatgttctaatatactgtttgatttgtttctgcttgatattaggtggccaatacatcttgcatcttccataagtcattgtatttcagacctcatgttggcttaacagtaccatagcttgtatagtgaatgaccaagaacacaaaaaatcacatgatggaatgctcatgtcccgtcctttgcattgttagcagttggggcctttgcataaacattcatctgcttgcttgtcgtagtttatcgtccactcgtatagctttggcagacaccggttacagcacttgcaggtcgaaaggctttgatcctgctcgaggtaacaacgatggaagaaactagaaactagttaaactacattgtgcaagcatctgacatgaccatcagaatttccgagtactttgccctgaactgaactgatagttggcagatggcattgcaggatgcctcagccgctcctcactcacagcgtgtcttgtccagctctttggctactagcaagatagcggtgaatgccgtgcgccaggggcggggacgggcttggccgcggccgttgcctctgtagagcaccgcggtcttcactgccagagagggtggaccggcctccacctacgcgggccctagacggcgttgcctccgtagagcatccggccttcagtgctagagggggtggacctaactccacctacgcgggccctggacggcgttgcctccgtagagcaccacggcctttaccgccagaggggatggaccaaactccacctctcatgagctccggacggcgccgcccctttaagccacatggtctccaccaccgagggacgtcgccctatcgagcgttgtcatctgccacgactgaggaggtcgccccaccgttcacttgagccccttcagtgtggtctccaccgaacgttggggtatccaacgtaaaccttcaggcacaccacaacacccgagtaggggctagaaattatttgctccccccgaatcccggagccagcagatgagggggtaccgttggggaataaccccaagcctagcatatactattagagaggacctccatacttaggatgttgtataaactaatataataatagactagaacatcccaatagcattgcccctctaatgtaattgataagggtaacactataattttcagttacatataaataaaagagccctccaagtgcaagggaggaggatcttctcgcatggcatcgagggaggagtgatcctctctcccccatcttctctcccaaggattcaagcttgggctctctcccacggaggaggggggcccttgccatgcatgttggactttgttccaataataacgctgcttgatcaccaatgacgagctgagccaaggtgcaaagaacttcggaggtgaatgcaataagcacaaatgtcattcatcggcctaaacgatgagcaaacagttcgaatggagagggaaaatcatgtggggatatcacgtaagtgtataataatttagaaaaatattggggccctattgaaaatttgtaactttttctttctttgcgaacacaaaatatgctaacttggaagtagaaagtttctatctatataaatttcttaagaaattattcataattcattcgtgttaccctcgaatagggatcacaacatcattaaaaaaagtaattcaaaaaatcatttgtataattatgaacaaactaaaaacaacaagagaaactcaaaatattatgaatgtataagaagtaatttaaatcaaatctaaaagtaatatatatatatatgatacaattaatttaaatatacaataaaattaattacaatatatattttttcatcagaacattatcgtataacatattgctataaaaatttatttacaacgaatataatgatatattccaattgttgattggataagtgatttaaatgaaattttatttgaagcttacttattaggaatcttttatttatactgttgcatgcttgcatactttgacgtgggaaagagatacattgctatatttttaccatctattggtataatagttggttttcattaagggtgtgtttagttctttgggtataaagtttttgaagtacacagacacacatttgaagtattaaacgtagactaataacaaaataaattacagattccacctgtaaattaactgtgagacgaatttattaagcctaattaatccatcattagtaaatgtttactgtagcatcacatttttaagtcatgacgtaattagactcagaagattcgtctcgcaatttacatgcaaaccgtgcaattattttttttcacatttaatgccggatgtacgtgtctaaacagatgtgacgtttttgataaaatttttttatctaaacaaggcctaattagtgcacatatgtgtctcgaggttttcgcaggggctcgatccgtggcgccggggagtatcgcctccgccatcgtctacgttgccgacaaccagctcggtcgtcgtcctcgtcagcgacgtcagctcgactggagaagactgctactccgcctctgccaaatcgatacccatcgatgagacgtatcagctacgccgcgctgaaccaatagcccaaaaactgaatcgttttccctgcctctgacctactctctccgttaaaaaaaaaatctagaataggtgtaacatattatagaacaacgaatttgaacagatgtatagctgtgtttagttcagcgcaaagtttggattttggttgaaattggagatgatgtgactgaaaagttgtgtgtgtatgacaggttgatgtgatggaaaaggactgaagtttggattcaaactttggatctaaacacagcctatgtctagattcgtagtactaggatgtgtcacatctagtactaggttgattttttatgggacggagggagtaccattttgtcactctctgtgaatttgggcctgtctagatccactggcaaaattttacacctgccacatcaaatgtttagacatatgcatggagtattaaatataaacgaaaaaataactaattacatagattgagtgtaaattgcgagacgaatcttttaagcctaattgcgccatgatttgacaatgtggtgctacagtaaatatttactaatgccgaattaattaggtttaataaattcatcttgcggtttataggcggattctataatttgttttgttattatactatgtttaatacttcaaatatgtatccgcatatttaatgtgacacgctaaaactttacccccttgatctaaacacagcctttgtctcacggaagtatatctgttgattgttgactacagtaaaatcgtggatggatgtgtggttgctggtacatcactcgttacaggaggggagggaggactggaggagctcctctgtagctctgctccttttcagcacaggtcgtcttcacaggtaaggctgtattagttccacgttaaaattggaagtttaaaataattggaacaatgcgatggaaaagttagaagtttatgtgtagaaaaattcgatgtgacggaaaagttaaaagtttgaaggaatctaaacagggcctaaaatgagccaaaagcctgtctcacattgggttcaaactaatgctgccttcttttccgcatatctaaatgataattttttcctttttcgttattataattttcaaattattaaatagtgtgtttttaaaaaacttgtttatctttaaaaaattcaaatgaactcaactttagagtttgtaaaagttaacgcttaatcattgctgcgctaatggcttatctcattttatgtgccaccaccaaatcgtatattcaaactagtcccaaatcactggttttgagcccatctttgactagtaatgatataaaaaaagggggaaaaatatgatatcagaaaatggtcaggactgcctatcatagttttggcttcacatggttctaagtttgtttcttgcgtcttcaccgtgttcgatccgttgaagtttctaccaagtcacatgaccagcgttttggaaagacaacaaatatggagatgttttattacagcctcaaggagttgtaaaatactattttgggggagttgggatggtgacaatttctgcaggctgagggagactggcgctgattggctccagattggccattgtcatccctgtaccaatcacaccctgcccaactctgcttgaggactctcccttttggttcttgcaaattttccatgtggaagatttttccatagcagcagcgaggacctgctagaagggacagattttcagataatgcttgcatcaaccatggatagaggttgagaggggttctgaagaggaacctattcccaagcaaatggctataagtaggtagcagctgactggcaccacctatgtactgcactctgcaccaactgcccagcacagcgtgtactccttacttggtaaggtacacttttcgtccctcgtctagctagtattcatcggcattctatctgattgagcttagtaggtgctgtttgccaaaattagaagtttggttgaaattggaacgatgtgatggaaagttgaaagtttatgtgtgtaggaaagttttgatgtaatagaaaagttgaatgtttgaagaaaaaatttagaactaaactaggcattaatatgattcatgtgggttttgattgtgcgactggtgtagtggtgttccacattacactcttcattagtgccaataggagttagtatagccatccttcaggggtcaatatttttccttttaaattattttctgtaggaacaactaagaaagcaagttttcggatagaggaaaagctgaatattaattaattcttcctatctgtacttcttgacacaccaatattaatatttttcgccaagatatttttaatcacatccactataaatatagtaggtgacgatcttccatgttccttcaaaaagaatatcagttcatactttttttttgaaacggaagccaggctaagctggagttatattaaggagaatagatagtatttacaatatcaccaacaaaggtgaaagagagagaaaacaagggaaacaaggaagaaaagcaacaaggaaaacctaaaagaaagacctaagtggatattctcgcgatgtttttttgccccacacatgctccaaagtttgatttcatcttgaattttggcgagtagttgcggcatggttttctcttgattttggaaaaccttcctgttttgttcacaccatatttcccatgccaccaacatgtggattgactcgagtgctttggccttgcttttgcctccttgagatgttcttctgatccaccattccaacaatacttcgttttcatcgtgttggtgttctatatcgctgcagttcagtctactcaggaccctctcctagatctgacgcacaaaattaagtgcaatctttgaaaagatgttgggcggtttcaaggttcctgtagcatagttggcagaaatagttgtttggccattgtctgatctgtagcctatctgctgtccaaactctattttgcaatagaagtcatgcaaagtgtttgcatttggaaggtgcccattgcttctaaatcagttttgcagccgctaagcttatcctgccattaaactgtgctatgtaggcggactttgcgctgtattttccatttgctgtccaccgccaagttatggtgtcctcaacaccttctgtgagtgcaacgccgctattccacacgtggtagaacacctcgaagaattccttgactagctcaaccgtgagattgtgcctaatgtctagtatccattggtcatttgctagtccttcgtagacagtcctacctttccttttggcatggttgtataaggctggggctaactccttcaatggttgctctccgatccaatttgattcccagaaactcgctttgcgaccttcacctattgtcaccttggtggcggaggcaaatagccttttgtccatttcgtcacaagggggaggtgttcctgcccaaggtttgtttgggctctcccaactgaaccatagccatcgcactctcaaagctcgtgcaaatttctctaagtccaagactcccagtccccaagtttggtgggtgcacatactgttggccaatttactttgcatttgcccccactaatctcttggtcgccagcccagaggaatctttttctaattctgcccctatcatgcaataaattttttgggggtttcagtgctattaggaagtatgttggtattgaggttagtactgaagagacaagggtcttccttcccacctgttgcaacaatttccctttccaacctgcaagtcgagagtggagcttgtccatgactggttggagatgcgctctcttgattcttcctattgtcaaaggtagtcctagatatgtgatggggaaaccagttcgatttccattgaaattattcagcacgtcctgaagatctatgttttcacatcttataggcaccactgagctcttgcttaggttcacctgtagccctgtggcacgtccaaagttttccagcaaggtgattagactgtccacatcagctcgacttgggttcagaaagattgctgcatcatccgcatatagcgatgttcggaactttgccaccctgtttgatattggcgacaagatcccttggtctttggccatatccagtatcgtttgcaatgggtcgattgctaatatgaagaggtagggtgaaagggggtccccctggcgcagtcctctcttgtgcataattacttctcatgttgttccattcagcattaccttagatgtggtggttgatagaattaaggcaatccaatctctccaccgtgtactaaatcctctccacggtagcatttccaacaaatattcctaggatatagagtcaaaagcctttgcgatgtccaacgtgaaaaggaggcttggtttccttttgttgtgcatcgatctgaccaagttgcgcacatataagaatttaccttgtatgcatcgtcttttgatgaaagcactttgggcatgcaagaccaggtcatccaatctcatcgcgaggaccttcgatatgagctttgccactgagtgaattaagcttattggtctgaaatcatgcaccagttgtggtgaatctttttttgggatcaatgccaaaatggctttgttgatgcatccaaaatttccgcctgcgagtctaaagaaactatcgaacatctgagaaatatcatgttttatgatgtcccagcaccccttgaagaatgccccagtgaaatcgtcaggtccgggtgccctctctgtcggcgaccctttcaccacattccatatttcatcctcagtaaaaggaccatccattgttccttgttgtattctctgcactcataacgcatcccaattaagtgtgcattctcttagtttcttttcgcctagtatggaggtgaaatgatcatgtagcagcttggccttgtcctcatgtgtgtatacagctgcatttctgtgttgtaagcagtgtatgaagttcttccttttcctagcattagcttttatgtgaaagaaacgtgtgtttgcatctccttctttcagccacctaacccgcgatgcttgttttattattgactatccataatctcttgcttttattatctttgcatttaactaagacttagaataatttggcagagaaggctggtcatgaagatcgctacaatcagacagtatatgattttgcttatggctagcaatgtagtccaaatcatgtgcacctcattatatggaaatgagacagatcgactctcattgcttgagttcaagaaggcaatcagtctcgatccgcagcaagcgctgatgtcctggaatgacagcacttacttttgcagttgggaaggtgtcctgtgcagggttaaaactccacatcgtcccatttctctaaaccttacaaaccaaggtttagttgggcaaatatccccttcacttggaaacctaacattcctaaaatttctgttcctagacacaaattcattcaccggagagatccctctgtcccttggtcatctgcatcaccttcgaaccatttacttgagcaataacacattagaaggagcgatacctgattttacaaattgttctagcctcaaggccctatggctcaacggcaatcacctagttggacaattgattaataatttcccccctaagcttcaagtgctgactcttgcatctaataattttactggaactatcccttcttcctttgccaatatcacagaacttagaaatcttaatttcgcgtctaacaatatcaagggaaacatcccaaatgagttttcaaacttcctcatgatggagattcttattttgggtggcaatatgttgacgggtaggtttccacaagccatcttaaatatttctactctcatcgatctttttcttaattttaatcatctaagtggagaggtaccatccaatatcctttactctcttcccaatctacaagtacttgcattggacttcaattttcttcaagggcatatccccagctcattggtgaacgcctccaacctacgtgaactggacatatcaagtaataatttcactggggttgtaccaagttccattggcaaactaagcaaactgtattggctaagtcttgaaggcaatcagctccaaacacacaaaaaggaagattgggagtttatgaacagcttagccaactgcactaggctacaaattttttcgatggcttataatcgactagaaggccatctaccaagttcgttaagcaacttttcgactcatctccaacgacttcatttatacggaaatgaaatatctgggtttctcccctctggcattgaacacctctcaaacttgattgatttatcattaggaactaatgactttactggtacccttccagaatggcttggaaatcttaaacagttgcaaatgttaggtttatatgaaaactatttcataggatttattccatcgtccttatcaaatctatctcaactggtatatcttggactacattttaacaagtttgatggacacataccaagcttgggaaacctgcaaatgcttgaagtattaaacatttccaacaataatcttcattgtataataccaactgagatttttagtatcatgtcaatagtacaaatcgacttatctttcaataacctacaccgaaaattttctactgacattggcaatgcgaaacaactaatatctttagaactttcatcaaataagctatctggagatatacccaatgctttgggtaattgtgaaagccttgaatatatcatgttaggtataaacagttttagcggtagcatacccatttcattaggtaacataagtaacctaaaagttctcaacttatctcacaataatttaacttggtcaataccagcgtctcttagcaatctacaatatcttgagcaacttgatctgtcattcaaccatcttaacggtgaggtcccagtagaaggaatattcaagaatgcaacagccttccagatggatggaaatcagggactttgtggtgggctaccagagttgcacctacctgcgtgtcctaccgtgttattggttacatctaagaacaagaactcggttatattgaaattagtaatcccactagcctgcatggtatcgcttgctttggccatatcaatttattttattgggaggggaaaacggaagaaaaaatccatatcattcccatcactcggtagaaagttccccaaagtttccttcaatgatctttcaaatgcaacagatagattctctacagccaatttaattggaagaggaaggtttggttctgtataccaagcaaaactatttcaagacaacattgtggttgccgtgaaagttttcaatctagaaacaagtggatcgcaggagagcttcattgcagaatgtaatgctttaagaaacttgagacatcgcaatctagttcctatcttcacactatgcggtagtattgatgctgaaggcaatgatttcaaggctttagtgtatgagttgatgccacgaggggacttgcataaattactatactcaaccggagatgacggtgatgcttcaaatctgaaccacattacattagctcagaggataagcataattgtggatttatcaaatgcattggaatatttgcaccataacaaccaaggaactattattcattgtgacctgaagcctagcaatatccttctagatgacaatatgattgctcatgtcggagattttggccttgtgaagttcaggaccgattcctccacatcttttggtgattccaactcaattttttcccttgcaataaagggaaccattggatatatcgctccaggtaatttgaaaattttatcttgcttttgtattactacatatttctttaacatacctagctatatgagctatactttggtcttatatatgcattttacagaatgcgctgagggagatcaagtctcaactgcctctgatgtttatagctttggagttgttctcttggagttgttcatatgtaggcggccaatagacgctatgtttaaggatggactgagcattgcaaagtttacagagatcaacttctctgacaggatacttgagatcgttgatccccagctacaacaagagttggacctctgcctagaagctccagtggaagtaaaggagaaagatatacactgcatgctctctgtgttaaaaattggaattcattgcaccaagccaataccaagtgaacgcattagcatgcgagaggcagccgccaagctgcacataatcaaagatgcctatctcagagggaactgaagaagtttttctggtaggaatacggataaggcttgtgtatatttgtattaagcttgggactgaagaagctagcagtgctattatactttgttgtttgttttcatttctctatgaatacattacaacaaaaattatcaacgagggatttcccagctggttgagtagatctcaaccattgtctcactaagacattgtgttccctttctcttagttacactggagaacaaatatttatagtgaagagtattgtttatttgtttctccttcatacaaggtcaatgaagtttggcaaatcagaaattcagaaaatactccctcagtctttttttatgtctaacgccattgaattttgaacataactttaataattgaattttgaacataactttaataattgaattttgaacataaatttaataattcgtttaattttaaaaaaccatataatcattttttattacaagtacattaagcatggtttctattttttacatacttagattaaacgaatggtcaaatgtatatataaaaatcagagatttgttctggtccagcaaattatacctcaatgcaccagtacttggtggtacctgattgaatctaaccgtccaatgtccaagggcatgatgggaatggatcgggatcaggtgcagtccctatagagactgcaactttggcagtagccaatctgaaccgttcaaaaaaaaaatcagacggctggctcacaccaccgcactagctagcacccaaaaggtcatcttcttcctcgagcggtagagccctctttcttctccatgtcaatggaagtgctctgtgcttcttcttacttcatgacaagttgacaactacgggaccttcgtacaaaccattgttgtgaaagtgttcaacccgtcaaggagattctatttttcgtgcttcatcatgatgttcttctatgaactcccataaagtgataatctgcactgccactgtcaaacgccaaggcagtaattaacctgcgagtagaccaagccaacctcgcctcctcctcgttcgatcctacctagctacccgtccaaatcaccaccaaaccacgagcatcaggcaagtaacaagctaagcagcacaactcctggccttgagcccttctcacccattgatacctccgccttgttggtgaccacgctccgggtgccgcctccaccgctccactcttgaagcccactggacatggagaggactaaagggttgttaattcgtagacgtcggatgcttcgtggatggttagatcaggtgctactgctaaagttgcagtaacaatagcaacttcacctgatccgaatccgatgggaatcatcctggactccacgccacccatcctctcgcaggcaccacaatccccccaacacttctccccactgcaaaatactccatgggcgtttgacgctgccgattcattccctcccatcaatgccgctgcagcacacctgttttgtcggcatgagtagtgctgagccatcagttccacctacatgcaggggcggatctatagtgcaatgaccaatgtcaggcgacactgatggcttttggtaaaacctatagcaaaactgattatctatatattataacaccatgatctaaacataattagtatattatgacactaatagatacgttatgacaccaacgaatcaattttctggatccaccactgcctacatggttgcacaagaacccacgcaggcttcccgccgatgtcgaggtgctgcagcacgccggcgtgctgtgtcgcgtacggcaaccactacttctagacaagcaggggcactagagatggttctcttcttccgctccgtcgtccggccgcggtggtgggacaagccagaccccgcctggacggaggacacacagtgacaatgcgatgcatgcacagtgaggattgattcggagtttctgactaatggtagtacataacagattaacagatatataggtacattactaatatggtactcccgaggattatgttgccatttgcaaatctctgcacaatgttgaatagttccacattggttgtggaagggcaaatgacctaagatataagtgggggagctcctcacctcaatggctagcttttagggtgggaaaaaccctttacaatcctacaattggtatcagagtctggctaggttaacatctctggcccgatggatacagtgtgtgaaggcccaatgtgtgaaggggccatgtacagtgtgtgaaggccggtagggcccgaatacggtgaagggctgagggacaccaatgtgtgaaggggacatggacatggccctcgacctcccgctttagggcatatcgcccagagagtgagtgcttgtttgctccattgacgacgactcccaggtgtgcttgtcttggtccggctcgtctgtagatagggacgacaccatggcagcgacggcagccaagggtcacacagcggcggcggcggcacgcatctggccatctgggggaggaaagacgccgctccaatccacttcccaaattttttttctatgcgaaaataccaccttacccttccaccggtgcggtaccacataaacgactaagcagtacatggtggtaccgatcaatattagccgttggatccggtccatctaacagctaggatttggtaccgcccaagcatgctggacagtaaaaaatctcacctacattttctttttgctacaaatcaaaaggacctaatgtgggctcttaattctcactagtaatctctctgagtctgtagtatcagcactgctggatgtaatttcattcaatgtaggtattgatctgcaaacaatccaggtcgttaacaacaacaacggttcaaaacaaggagcaaattgcaaaaatacgtactatcaacgacacagacagggaccattcgctgcatcccagaaacagcggacgaattattacagaaatccatgggcgtgaaaattcttgtcttttcaaattaggcttgttaaacgcatctataagtttttgcattcaatttttaccgtccgtcttatttgaaatttttttataattagtattttttttgttatgagatgataaaatataaataataatttactcgtaactcatgtttttaaattttttaaaattttcaaataagacggacgatcaaaattggacgtgaaaaaccatggttacgtacacttaaaatgggacggatgtagtactttgcttctactacatggagctgagccggtgagatagattgaagatgaggatcaaatcaacttcgtcaaacaagcaaatcattaattagcacataattaattaaattttaattatcgtgaacttgaaaaagttagatttattaataatattttaaaacaatttttatataattttttttataaaaaatacattgattagtagtttaaaaaacatattagtagatgccgatataaaatctatatcttaattagaaaagaattgggcaagagtatctatccacatgattgttgtggtgtcttacttccatttgataccagggtaatccatttcatcatgctcgtggcgtgcaatgagtggacaacagtgaacagttattccccaacaaactctttacgtatgtagttcttgccctactgctacataataagagaggcattacataatttacaaacgattaattcactaaaggaccgttatttctcccaaattgcttgaagacaaacgtctgtgatgaggagtcacgtcgtcatttgactggagcaagatcgaaccgtctgagttgacttaatagcactgatggtaatttatgctatagaaccgttcctgatgactcagtaacacacgctttgcaaatttacactcaaatgacccgtccgtgatgagtacaacttgtatacaggactgaaagtgtgaaaagaagcgggcaatccttagcggatttgtgctatgaagtttgggcgtaaactcgtagcaaaatcaagattctgcagtaactaattaacgaggtggtggaataatcaatggggatgttgctgccatcgccacgacgatggaagccactggggggtcctgtctagatctacactctctgcagtcgatcgagacgcttttttttttttttggcatttgcaaatttgacaccggtttttttaattttgcaagggtgccactcgaatggtagttctagtggtatttttggaattttctagtggtattcttacaataacgattcaaagtagtgttaaatttgcaattgcccttttttttttcatcgttaaaacgacaatacaacttgttaaacgcccaacaataatgtccttttcctctctgaattgctagttacgaattgttttagattggattgtttgtgatactaagttttcaatttaaatagttgtatatatttggttggatatagaagtcaggtaaaatatacccttctctaaaaaaataataaaaaaaagaaaacgaagtcaacagtatagctatgcaaactaagaattagttgcggagtgcacaatttgttcatcatattgcatccgttttatttacgcttggcatacatatagtccaatgaatataggagttctctatttgttgattaactgattcttttaaatctcagttactttttttagaaacaaatacttttttcataataacaatgtgtgcttcaacattatatcctcacattttgggataccagattaaaataaagagagaataaaactgagctcctcgacaaggtgatatgaataaatcgagctacatacatgcatgcatgtatggttgacttagaccagtcagtcgtcgattgatatcgccgataaatgttagtcatggcaatgtgttagcacgtaccgtggtccgtgggtagaaacttacaatcttatccttttttttataatagaaatatattatatctccatgcctcataagacatacaactataaatttgttacaatcttgttatttgggattatagacgatgtattaaataattaaagcatataaaccaacaagatatacagtacatcgtgatgaaatgtttgcagtactttttatctttcgtgcttgggaaaatgggagatgaaacgaatgagactggagggtgtactttgagaaccaagagctgtctgttttgagcacatatgaacaataaaattaaaaaaaattgacttaaaaaaagtcaagggagtatattctaaacctaccttttggtagaaacttacttttacaagcatggcaaagataattcttaactatcttccaaaaataaaataaaaaaaggatgccaaacatgcactcgcgactgccaatcgattgattaattaggttgtcctcatgcaatgcaaatgtcgattgacgacgtctacccttatcggaatgacttattagcaaataaagactaatttatgagtaattagtaattcaaaagtaaataataatgtaaaataaattatgataaaagaagtacaaaatcataaaattaagttataaaattaaaattttactccctccgttttacaatgtaagtcattctaatattttccacattcatattaatgttaatgaatctagacatatatatctatttagattaatgttaaaaaaatatctatttagattcattaacattaatatgaatgtggaaaatggtagaatgacttgtatcgtgaaacggaggaagcagttcatagctataagcgtaaacgtaacgacgaggccagtcaatctcacagcgacttcttccacttaaattaatgtcgatctcaaactacccaagtctgacgccttcctactaaccaccttattattgtacaagctgcaactcatcgcgacgtcgaagcaaggcccgcaaagtcagtcagtaaagtagtagtagactgatgagattacgtttcaattggttcgttgtgcctataaattaaggcacataccatgcgtgcaagtatgtatcattctgccctcggttgctttactaagctagttttgttgctcgatcgatccatcggtgttccgcaaaataatttgttattttggattcaatcaatcaggtcttcagtcgcctttaaacaattggacagcttgattcgagtgccggcagcctgcagccgacctagctgtaagcatctctgcttgtttgttccggctatttcatttccataatacattaataaaaggggtaacaattaagtatggaaattttgttattttttacagcctaaccctgacataatatttgtgtctcgttaagtttatttttcacctatcttacacgtacatatcaatataaaattaaaaaaaagactataataactttactttatcaaatcccaatacaatagccttactttatcaaactttgatgcaataattactctaaaaacaagggccccttaaatcgtaggaatgaaaaaacggaggaataggaaaatataggattctgacaggaatgtaaatgtaaaacagaggattgcaaaacacagaaaaaatataggaatgatcgtttgattggatttcaggaaaaacacaggaattggatgagagagatagactcaaaggattcttaccaagaggttagacctcttgctaagttttctccaaaacataaattttgtaggatttggaaaacttcaatactttgaattaaagggctacatagtaaaatttcctatagatttcaatcatatgaaattcctttgattcaaatgtgccctaaacttatttaggacaaatagaaggagctaaaaccaaacctattacggaacagaggaaatgtatcactacttggctgagttctttaccccactttcccaactcacatatctcgttttccgcgcgcacgcttttcaaactgctaaacggtgcgtttttttaaaaaaaattatatatgaaagttgctttcaaaaattaaattaatccatttttaaaaaaaattgctaataattaattaattacgtgctaatggatcgctccgtttttcgcgtggaggagacgtgggttcccaacccgaaggagctaacagagtgttagcttgcttttcatcgcatgtgccattatggagcatagtacttccaagctagtgtaagactctgcatctaattaggtttcaaaaataaaagactctgcatctaaaacctgcattaactagagggatcagttcctcagacgaagacgggggtgatggtaacatcttgccatggtttggtcccaagtgttccagatgtgattgtagtggtcatttttggtaccatattaaaagttcatgcggatgaaggcctgtttataatctttggtgctcaaaccatggtatattaggttaaccgccttacacgaaacggtttactatacatacgtgcatatctggaattttataaacatgctgttacaggtaaccattatgcaattgaaaaatgctatgtgtccacggggcgataaatcattgtcgtgatactataatatgaatagattcttttttctttgatattttcgatacaccgttttatgtgacagccgaaaaggtgtttattgcaactattgctaacacagattcagtatcaccatgataggaaaaagtaagaattacaatagtatgaattaccccctaaacgacaaaaatagacatttgacatctccaattcatcgaaccggacaaattacacccctaacctgttccagagtggttttgatcctacgtggtgtaaacttggtgatccagttagctaaaaaattataaaaataagtaggctccaactatcatctacatctctcccatcttctcttttcttctgccttcttccccttcgatctctctctctctctacctctggacggagcaggcaagagggcggtggactaactccctccataggctggcgatggcgacaacctccatccttcaacttgtgtgactccctccatggagctggtgacggtggcggtctccatcctctacggtagaggatgccgccccaaatatccatgctggaggcagtgactgcagagcttgctggaggaggaggtgacgacggagcttgctagagaggaggcactggtggtggagcttgctcgaggaggcagcagaagtacgcgaagctcactagtagacggcataacaagcatgctatcgtgtcgatgctttcccgccacatgcgttcgccgacgagggggtgaggggattcgtccggtttgatgaatcagggtgtcaaatgtctaagtttgtagtttagggggggtcatacgtattatcctagtagttcaaggggtaattcatacttttcccaccacgatatgcatatgtttcatatgattttaagcttgttgcaactgttctgaacactaaaaacactcgcaaaaaaagttattcctttcgaattatcttttgctcggccacaagtgtttagaaaggaaaacaaatccgaatcataattaattcctcatgtaggtaactaagtactacttcttaacaaattaaaagatgaatacactttttaacacctttactagtaatatactccctcagtttcatattataagtcatttgacaatttttctagtcaaactttgttaagtttgactacgtttacagaaagattcaacaacatctaaaatatgaaattagtttcattaaatctaacattgaatatagtttgataatatgtttgttttgtgttaaaaataatactataatattctataaattagtcaaacttaatgtagtttggctagaaaaaaaagtcaaacgacttataatataaaacggagggagtactattctattcgttcgaaaatacaaggtgtccttgttttccacaaagtcaatactttaaaattttggctaaaaattaaataaaaatacatgtgtttagtgtcatgtatatagtatcactaggttcgtatttgaatgtatatagtatcactaggtttgtatttgaaaatattttcacgtgaggctaattttgtagttgtttataataaaaactaatggttaaaaatacaatgttgcagaccatgtagaaacctaatacgtcttatatttttaaatggagagagtaggtgacatttttccatgtttctttacaagaaaaaaaactatttcttcacattatggactatttataatatcttactttaatttattatatgtagaaataactaagacctagaatttggcagtggtggattggtcatgaagatcattataattggactgtgtcttttggtgattatggctagcagtgtaatccaaatgtcacaccctaaaaatcaaaaatatataaattgttgtttaattggaattattagaatttattttaaaagcctagaagagaagatctaattttaattaataaattccaatataaaatagggccagataaaatttcattaaatactttacttaactctataattcctagatttttctgggatttatttgagctaaggaagtatttttaataaatgaaattgcatttcatgaataatttaaattgaaaaaggtttttaaaatcctcttttggctttgggccgaaagtcggcccaaaaccttctctctctctccctcggcccagtcggcccagtccgaccgcagcccagtccgcccgctcgcgcgcgcgcgtcagcccgctgacaggtggggcccacctgtcagggccgtcgtcttcctcgcaccgtcgcccggccgaaccttagccaagccgcgccgccgtctccttccaaatccggctgcccctttccgtttccgatgaaattagtagaggggaaatgatcttcgggatcttctctacctttttccttttggaatcgatcgccaattcggtttggaaatccgtggattcgagttcgattcggatcgatctctctcctccgaaccctagttgttccttcacgtcgccggtcgccgtgggccttcgtcgccgcctccttgcccctttaaaaggacccccaagcccgccgctacccgtcgccaccctcgccttcgcctctcgtcgccggtagagccctagcgccgtgtagcctagcgccgccgtcgccgccgttcgtccagccgtgcgccgccgccactccagtcgtcgtcgtcgctcgggaaggccgccgtcgtgatcgccaagtcatcgccgacctcgttcgcccctccgtcgtcgccgtaggccgccggaacaccgtcgccgtcgtcaagccgaaggtcgccaccgcttcttcctcgacgccgtcgccgtccgttgatctaccgccgccgttttggtcaccggtgagttcgccgcgtcgctctctacgtgctggtgccctccgttcgtgccgtcgcgccgtcgttcgccgacgagcatgcacgcccgagccgccgccggtggtgacgtcgtcgctgacgtcatcgtcgtcgtccatccgtgagccgcggtggatccgatcgatcttggccgtccgttttggataggatcgatctcggccgcccaatctcgtgaaccgccgccgtgcacccgattcaccgcgaaccctagccgctgacgcaataattcccttttccttttcaaaaataattcattattgcgtcataattcaattaaaatccatataagtgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacttattgtttgttatagcccttttgttcttgattactttattccttgataccttgggttattataacttgactagttgggctttatatattggttcagctagatattagatatgattgcttagccatgcttagaaacattagcactattgggataacttatggctcactattatttaatgatggcttaatgatagctcacgatggtcaatcgtgattggttaattaattaaattgccaactaaaacctgataatggtgagttgtgagcacatggttttgatggtcgtgctcatgacaattaaggaccggttcacgagtttcggttgtgaaacattaactgtgccaaccacaagccagcgtgggcaacggctttaccttttgtatagtatggttcattgcggagcaccagactgagaagtggcggagataagcccacgggggtcgctggggagtccatgccttgttttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctagccagagtaaaactattcgaatagctgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcacgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaggagttctacagtgatgctgctggtgtggaggattaggtgtagccctggtcaagctgcctgtggagtggagtcgtctgcgccgtttatcttttttttttccgctgcttagatctttatgattgagaggaactatctacctctgtaatgacattttattcgcttattaattagagtaataattgtactctattatcaatttgttattgtgtgcctcggctgattcctggacgagggttcacacacatataagcgtttggaattttggatagaaattccgggcgtgacaccaaaccatgtgcaattcattatatgagaacgggacagatcgactctcactgcttgaattcaaaaaggcaatcagtatggatccacagcaagccctgatgtcctggaatgacagcaattacttttgcagttgggaaggtgtcttgtgcagggttaaaactccacatcgtgtcatttctctaaaccttacaaatcgaggtttagttgggcaaatatctcctgcacttggcaacatgacattcctgaaatttctctccctatccaccaattcattcacaggagagatccatttgtcccttggtcatctgcatcgtcttgaaaccctcgacttgagcaacaacacactacaaggagacatacctgactttacaaattgttccaacctcaagtctctttggctcagtcgcaaccacttagttggacaattcaacagtaatttctcccctcggcttcaagatttgattcttgcatctaataatattactgggaccatcccttcctctcttgccaatatcacatcgctacaacggcttagcatcatggataacaatattaatgggaacatcccacatgagtttgctgggtttcccatactacagatcctctatgctgatgggaataagttggcaggtaggtttccacgagccatcttgaacatttttactattgtgggtcttgcttttagttctaattatctaaatggagaaataccgtccaatctctttgattctctgcctgaaatgcaatggtttgaagtagactataacaacttctttcaaggaggtatcccaagttctttggcaaatgcttccaagctgaaggtttttgatatatcgaggaataacttcactggggttataccttgctctattggaaaacttaccaaagtttattggctaaatcttgaaaaaaatcaactccatgcacgcaacaagcaagactgggagttcatgagctgcttagcgaactgcaccggcttgacagatttctcagtatctgataactgtctagaaggccatgtaccaagttcattaggtaacctttctgttcagcttcaacaattccttttgggaggaaatcaattatcaggggttttcccttctggtttccaataccttcgcaacttgattagcatatcaatcgatagcaataatttttcaggagtccttccagaatggctcggcagtctacaaaatttgcaattaataggcttatataacaattactttacagggattataccttcatccctttcaaatttatctcaattaggatatctctatctacagtcaaatcagttttatgggcatctaccaccaagcttgggaaatcacaaaatgcttcaagaattgactattggatataaaaatattcagggtatgataccaaaggagatattcaaaattccatcattgcttcaaattgatttatctttcaacaacctagatggaagtatcccaaaagaagtaggtgatgccaagcaactcatgtatttgaggctttcgtctaataagctatctggggatattcctaactctttaggtaattctgaaagcatggaaataataatgttggatcggaatatatttagtggaagcatccccacttcattagacaacatactcagcctaaaagttctgaacttgtctcagaacaacttgtcaggatctataccaccatctcttggcaacctccaatttcttgagaagctagatctttcattcaaccatcttaaaggtgaggtcccagtaaaaggaatattcaagaatgcaagtgccattcgaattgatggtaacgaggccctttgtggtggagtgccagagctacatttacatgcacgctctatcataccttttgattcaactaagcacaagcaatctattgtactaaaaatcgtcatcccattagctagcatgttgtcacttgctatgatcatatctatcttgttacttctgaacagaaaacagaagagaaaatctgtagatttaccctcatttggtaggaaatttgtcagagtttcttacaatgatcttgccaaagcaacagaggggttttcaacatcacatttaattggaagaggaaggtatagttctgtgtatcaagggaaatttacggacgaaaaggtggttgcagtgaaagtgttcaacttagagacaatgggagcacaaaagagcttcatcatagaatgcaatgcactaagaaaattgcgacaccgcaatatagttcctatcctaactgcatgtgcgagcactagttccaatggaaatgattttaaagctctattgtatgaattcatgccacaaggggacttgaataaattacttcattcgaccggagctgaagaattcaacagggaaaatcacggtaaccggatcacacttgctcaaagattaagcatcattgtggatgtagctgatgcaattgagtacctccaccataacaaacaagaaactattgtccattgtgatctgaagcctagcaacattcttccggatgacgatatgatagctcatgttggggactttggccttgcaaggttcaaaattgacttcatgggatccaatgactccaactcaatttactcaactgcaataaagggaaccatttggatatgttgccccaggtaatgctcatttccatattgtgtttttgtttccctctaaattgtgaattgtttcagcatagtatcatttcgagtaaaccgttcccatccatggcggtccatagagtatgctgcaggtgctgaagtgtcgacctatggagatgtctttagctttggagttgttctactagaaatatttttacgaaagaaaccaaccgacgatatgttcaaggatggcctcgacattgtcaagtttgtcgaggtgaactttccagataggttaccgcagattgttgacccagaattactacaagaaacacatgtgggcacaaaagaaagagtcttgtgttgtttaaattcagtactaaacattggactcttctgcacaaagacatccccatatgagcgcatggacatgcgagaagtggctgcaaggcttagtaaaatcaaagaggtgtttctcagtggcaactaaggtatatggccttgttatctatatctccatgattgtttctcatattatatgtgcattgttctttccttagtaaaataacaattaagaaggaaaactgatgctgagcttacattgcagatatcccaaaatcttaagtctgtggactggaccctgtagactctgtacttgtcaatacatctttggcaactgggatgagtgcctgaagctacatcttttatgtctcgctatatatacaactagctctgtactccacgaagttgattacatgcattttatttccctttgtgatgatgaccacaaattattgtacttgattatatttactaaactacttcttccgtctcacaatgtaagactttcttctagcattgcccatattcgtttagatgttaatgaatctagacatatgcatgtgtttgatttattaacatctatatgtatgtgggcaatactagaaaatcttacattgtgaaacagagagagtatcattgtgaaatggagggagtataatttaacggatgtcatgacacatgatttatgtaatttccaccaccgaaataagttgagtaactcatttaagcatcttgtaagagaagtgactaaattacacccacctcgcaagttatagtcttgatgtgttttactgttttttttataaaacaaatcatagtggtagaaaacagagacttatttgctaatatcctaagcggccatgtttgtggggacctaataaaaaataggactacctattaatctttcgatagacttgagcttcaaatcttacagaattttcaaccaatggatatagcttattttgaaagaattaacaaaaagaaagggataaacatttcaaaaatcataaatttagagaaaaaaacatttgtaaaatctaattttggtgcattgtaatagagcgtaagtgcactataactaagttctgtaacttaatataactacaagttgcccagcgaaaaaaatataactacaagttagatctacataaacacaaatcttgatgcaagatcttacggacaagaagaaaaatcgaaagacaggagcccaaaaatctgtagcaaagtgaaatagcaaaaccgataaaaaaaaaagcattcttatatgggcatcagatagactgttcagctctgcggcgagccatcgaacggcggcggcggcaatagtgaggatgcgtattggagcgtgacggctggagcttgtgctagccgatgccacatccgccatgcgagccggagttttaggtctccatccaggatcggacgacgtacggctaccaatgcggcgacctagccatgcatggccggcggcggcgatgagcgacgattttctccgctttctctggcccatatctcacggaaaatatatcaatccggcggccgcggcctcgattgatcacatcgccggaaaccagcccgacctgctccttgtcggcgatctgtaacctcaccaacgccaccgcactgcagcaggcttctactcctgcattttcttcgaatcgacgacacctatcagccagactgggattacagcgctgaggtttttgttttctgaaactctgaaccattttgtcactctgaatcttcttcagaactcttactttgtgaattggtctcgcagaatatggtgatttgttaactacagtgaatcatttacaacttgagttcagcagctgtatatctttttaagattggattaggtagttgctcgatctgttctataagcttcagtgcgaagtgacaaaggacatcagactaaaatattcagtagtacatatatactaatgttacaattccatgtccttgatcagtgaaagtgtactgaatatcagatgttactaatatatactacactaattttacaattacatatgtatttgatcaaggaaagtactaaccttaatccaacacaacaaattccagggaagcagtagaaagacttgacgaagatggacaggataggtgggtgactatgtctttgatcagtgaaagtgtgctgaatatcgaatgttactaatatatactaattttacaattccatatgtatttgatcaatgaaagtgtgctgaatgttactactaaccttaatcctacacaacaaattccagggaagcagtaggaagaaatgacaaagatggataggataggtgggtgactgaaccttgcgcactctggtacatacaacactcattacagggaagcagagtgcatgggagtggagatagtgctaaagccatcgacgttcgtcttcacccacagccatgcgagtggagcacttgactgacaatcacgatgtgttaggcagtcctccgcacttcatgtcttcaactgcagattgtgcatcctttctgaagaaaactggcgcctgattggaatctttcgtgcagttgactgcaaatcaagtctttgcatgccaagattgtgctaattaaagccacggtatccttctgttataaaaggaagcagtcgaattgtcgatgaccatgagccccatgagacaggctagctgctcctctcgctggtaatctcagtcatgcatatcaatctttcatttaattcgtttctgttcatcattttgttgttgggatagattggtgtatgttggattgcatgcttttggggatttgtgtgtagaatacatctaattatattcacagcacattctgtctagaaaggtaatgcatatatatacagatgatttgagacattttggttccattttatctgaggtgatgatcagcaattactaaatactactagctctgtttttttaatatatgacgtctttgactttttgacaaacgtttgaccattcgccttaattaaattttttatacggatacaaaaaaaagttaagtcatgcttaaagaacatttgaaaataaatcaagtcataataaaataaacgataattgcataaatttttaaataagatgaatggtaaaacatatcttaaaacgtcaacggcgtcatatattaaaaaaacggagggaataatacttgagattttacagtgtgtgtcataaccacaaaccatattagtttgcatgtctagcatattattacagtgcaaagtacattcagctcattaattggcacctaggagctgagggtttcccataacaatactcccctatatgttgattatgaagttcgatgagcgagctgacctctaagagcaagttttataattgaggtggctaacacctctaattccatacatatcatctccgtataacttaaaaggtaacttatataataggtaacctataacacacaaacctcaataactctaaaagaaaatctaagaagtgctatagacaagcgtctcaatctaagaaatgtcattgataaatctaacttcctagaaataccatcatatgagtgcctttgtcccaaaaatgtcatcgccattagattttcattagcagcccttcatgaaatgctataaaaagattattttaccatacgaattgttgaaagccgatgaaaacttccgccttttccgtcagtttacactaatttgtaggctgctctttacactaaattattgtaagttaacgaatgggagaatagctactttagtccctaaagtttctctgtaggatcagtttagtccctaaccttttaaatggtccaaagaaatccttaacctttgtcataaggcctataatagtccttgggtccaccaaaatcatcatatggatatgccatgtcatcattcatgcaaatctataatgaattgtccaatatacccttacgtatatcatagaaaaataaatataagggtgaattagacataaccataggaaaaaaatacctcttttttcacccttttgaggtatatttttgctcttacatgtaccatatatatttttttaacttttttcttttgttttttatttacctatgcataggaaggtgacatggcatgtccatgtggcgattttggtgggaccaaggactatattagcccacataacaaatttaaaggacttgtttagacaatatgaaagattaaggactaaaatgatccaggagcgaaactttagggactatattagctattctctcttaacgaaaagagcaaaagttttaatcgtaggggtaaaatggtctttttaaaccacttagcggatggctgctaatgctacctaaaggcgatagcatttcttggacaaaaacacttatagatggcatttctaggaagttggattggtcgatggtatttattggattggggcacttgttgatggtatttcttagattttctcaaactctaatactcccatatttgtatagtttgtataggggttgccccttatatgagggatggttccttccctctctcctttctccccacctcatcaaataagtctacaagacatcttaggagatttatagtacttgctctaaggtattggctcttactacttgggttcgagattttctagaggatgatgagttgttccatttcctgtagtatccctgtttggggatgtcagtcatttagaaccgaacagagacccttggatcgatgcctatatttgctctagttgcttactactccctccgtttcacaatgtaagtcattctagcatttttcacattcatattgatgctaatgaatctagacatatatatctatctagattcattagcattaatatgaatgtgggaaatactaaaacgacttacattgtgaaacggaggaagtagaaatctagaataaggaaagggtcttgcagaaggagagataagacagagggatgaaaaccaaatataaattgagtagcaatttcacaactcatcatcataataccagataatgtaacgattgtcacccatttcactgcaggattttgaagaaaatttgcatatctgaattgcacggcttttagaggactagagttacattatttcacatgcagtggcataaatcattggttttttctcaaatcttattgatctagaagagagagcgtgcgttcacttcaggaagtaaccattgaaatccctcaggtacttcgcatgtcaacaaataaatatttgccataacaccagtttgcaatttaagtttcgtgccttacttgtatcttaaccatgtcatcaggcacttcgtttgctagccatgaagtttattgaacccgggaaatttctcttggtgttcttggtttgcagtgcacatgttgtcatctgctcctctaatggaaatgaaacagatcggttatcactgcttgaattcaagaatgctatcactcttgatccacagcaagccctgatgtcctggaatgacagcaaccatgtctgcagttgggaaggtgtcaagtgcagggtgaaggctccacatcgtgtcatttatctcaaccttagtggtcaaggcttagtagggacaatatctccttctcttggaaacctaacattcctaagatatataagtctccaagaaaatttactagctggacaaatccccctgtcacttggtcatatgcatcacctcaaagttctctacttgagtaataatacactccaaggagagatacctgactttgcaaattgttctaatctctgggcgttattgctgaatggaaatcacctagtggggaaagtacctacagatgcccgtttgccgcctaacctttattttctctggattgtacataataatctgactggaaccattcccacctctctatttaacattacgacattaactaaactttctataggatttaatcaatcaatggtgaggttcccaaagaaattggaaaatcacgcgttctgcaactatttgctgcttctggaaataagcttttaggaagatttcaacaaaccatccttaatatctcttcccttgctgatctagatcttgggtccaattatctacatggagagttgccatccagtcttggtagttcactgtccaatctacaggggttggctttgggcaacaacttcttcggtgggcatatcccaagttccttggcaaatgcttctaagctatccatgattcatctgtcaagaaataatttcatagggatggtgcctagttccattggcaaacttcaggaactctccgtgttgaaccttgaatttaatcaactacaatcaagtgataagcaggcttggagttcatgaatagtctcagcaattgcaccaaactcgagcattatcacttgcaaaaaatcaactagaaggagagataccaagttcattcggcaacctttctatgaagcttgaactcttataccttggaggcaataaactatcagggcgttttcctgcaggcattgcaaatcttcacagcctgtcaggtctagcactgaattcaaatcgttttacaggtccagttccagattggctaggaaatcttaaaaatttgcaaataatattcctagcggcaaacatgtttacaggatttattccatcatccctctcaaatttatctctactagaaaatgttgtcttggactctaaccagttctatggccatataccccgaggtttggaaagcctcaaagtactacaagtactgagcattccaaacaacaatcttcatggtagcatcccaagagagctcttcagcattcctacaataagggagatttggctatattccaatagattggatggacctcttcctattgaaataggaaatgctaaacaattagaacatcttgtgctttcatcaaataacctatccggtgttattcctgacacacttggtaattgtgagagtattgaagagatcgagttggatcagaattttctcagtgggagcattcctacatcatttggcaacatggaaagcttgcaagtgctcaatatgtctcataacctcttgtcaggatcaataccaaagtctattggtagcttgaagtatcttgaacaactagatctgtcattcaacaatctcgagggtgaagtaccagaaataggtatattcaacaacacaacggccatatggattgctggaaataggggtctttgtggtggggcaacaaagctacacctacctgtgtgcacttatagacctccaagttcaactaaacacttgcgatccgtagtactgaaagttgtgatccccttagcttgcatagtgtcacttgctacgggaatatctgtcttgttgttttggaggaaaaaacatgagagaaatctatgtctctcccttcattcggtagaaattttcctaaagtttcattcgacgatctttccagagcgacggatgggttctccatatccaatttaattgccaggggaagatacagttctgtgtacaaagggagattgttgcaatatggagatatggttgctgtgaaagttttcagcctacaaactagaggggcacaaaaaagcttcattgcagaatgcaaaactttaagaaatgtgcgacaccgaaatcttgttcccatcctaactgcatgctcaagtattgattctcaagggaatgatttcaaagctctagtatatcaattcatgtcacaaggtgacttgcatatgatgctatactcaaatcaggatgatgaaaacggttcagcttccatccatattgcatttgctcaaaggttaagcattgtagtggatgttgcacatgcaatggagtacgtccccataacaaccaaggaactattgttcattgtgatctcaagcctagcaacattcttttagatgacagcctaacagcacatgttggagactttggccttgcaaggtttaaagttgattgcactatatcatcttccggtgactcaattatttcaagtgcaattaatggaactattggatatgttgctccaggtaaatcctatttttcatggtacactatgtttcgttgggagtgttctcttcctattttaatgtttggacttaactattctcatgtgctatatgctctatgcagagtatgcaacaggtggtgaagtttcaaccttcggagatgtttatagctttggaatagttctcttcgaaatatttttacgaaagagaccaacacacgatatgttcaaggatggtctgaacattgcaacatttgtcgatatgaactttcctgacaggatatcagaagttgttgaccaagaattgttagaataccagaatggtctatcccatgacactcttgtggacatgaaggaaaaagaaatggagtgtctacgttctgtgttaaacattggactttgctgcacaaagccatccccctatgagcgcatggacatgcgagaagtggctgcaaggctgcgtaaaattaaggaggcctacctcagcagcaactaaggtaattaacctaattcaatgatatgcactcgctgtacatatttccaaggtagtttatcataatgtgtgtttgtattatccttttcttagctagtaaaatgcatgtgtaaataaacatagggctgatgctaagcttacattgcagataccctgaaatcatcagcagcatgtggaccctcagaccctgtatactctgtattctacacaatattggcaactgcgatgattggacggaacctacctcatgtgtcttgcattttccattgggtgttaatatggcactataagcttttttttatggcaatgtaacatacattttaccagtatacatttacgttgcagtatttctctttgtgtattgaggagagatataaaagaaatcacctttctgcttctgctttcttgttacgaaccagagatgagatctgaacaatagaggtagagcagaggaaacaggggagacagaacagagttggtagctttaggaggaaggattgtttggttatttcatattcgatgctttctctcctattacacgagtgcttatatggatgcactggttacagctgtcgagccaacccattcaggcccagagatccgaacattcgcctgtctcacacgcttaggacgcgcctgatgacgaaccgggtttgaagacgtagtcgttgtcggatcacaaacagtagccgtaacatttctggatgggtgtatcgtgaaagtctggatggatatcaatgatagtggtacataataccataaagaggacttgactgataacattatgaacattccagtaaaacaaaaatattgggtcattgctaatctgaaacgcttaggccttgtttggctaaggggttattagagaaatgatttcccatccaccaaaagatatctttaaatcctaactgttcattctccctcttccattttatcctaacccttcacttattttcttatcccaatcccactttcttattacattatccaaacaaacccttagtataatactacctccatattttaatgtatgacgccgttggctttttatccaacgtttgaccattcatcttattcaaaaaatttatacaattatcatttattttattgtgactcgattcatcatcaaatgttctttaagcatttatcatgatataaatactttcatatttgcatgaaaattttgaataaaacgaatggtcaaacgtttgtcgaaaagtcaacggcgtcatacattaaaatacggagggagtagatagtaggaacttgtttttgtaagatgttcgggctgccctcattagttgttgtacgaaatacaaacagggtgccccatatgaagagtctttaggctttacatgggccatgatgggccacagaatcgtcatcgtgagattccatctctgcagcaaagccagcgggaggcaacagcggcgaggcagacgcgaaggtttgagggatctgctggccaatgcgacccacatcctgagattgcatggctccgtccaggaatggaccacggctgggctaccagagtaccagtgcagccacgaccttgggatgttgccggccatcgagacgacgtccacctggtcctcttcctcgtcagtgatgtcagcttcgccgacatgtggctgacctccacctccgccgaattgatacccatcgaggaaacatatatcaactgtgctgggattggattactgctgaggtttgtctgtttaatttgatcattaatccatataaacttggtagcacacggatcggacaaaatcaggcgatataaactggctttgggctttacatggggctgtgatgcagtcgagccgtgcggcgatcggcggcggatggtttcagcgctccagccaggaacggacctcccggaggcgatgagcagcgctccacgccctccggatcaggtgaatcctactctcatgatataatgtttcccttttaagttgggagcgttttcttcctattttaatgtgttgacttaactactctcgtgtgctatgctctgtacagggtatgcagtaggtggtgacatgtcaacctacggagatgtttatagctttggaataattctctttgaaatatttttacgaaagagaccaacagatgatatgttcaaggatggtctgaacattgcaacttttgttgagatgaactttccggataggatattgttgggacaaaatccaacaagcatatatgtgtatcacttatgtattcaatatgcccagctgtgagcaatgtttacatatttatacaaggatgtacaaggggaaattatatcgctaccctaatcgctgatctatctaggcggctggctggtgggccagctttagggctctttggtaagctcctcggtgacaggagggctgcgcccattaagggagcgccgccgattcccaagggcgcctgctattacccgggtaaagacgtgctccgggtaatagcgtgcgctgtctgccctcgttagcggcatcagaggtggttggcagatgcgtagtgcgaatttatagcgtcccactacgcatctgatcacccatcttacgcccaaggctctcgaagctctagcttcctctggagccctcaaacagctccggagaacctagaaggctttggagtccttggatggctccggagcccacgggcaactacgggacaaacctacaaagggattttgcactctcgcagcgaaggcagacgatttacaatgcaaatcaataaagatggacgaactaggctagaactatgtgcaatattgaaaaagtgattcaattggctaaattagattgtgtgtagattcttcttccaattgaactagccttgtcccttatataaggatataagggttggtcttgcctcctgcagatcatcctccacgcctaactcaggataaaaaccaatggaaacccgaaacataccctcctgagtaaggagtcctgacacccaatgaaaatatagactcggtatcggactctaccggtctgaccacgcgcacaagtagtggtctgaccggccaacatatggcggtcagaccggccttgtgagggaaaccagcactcttccaaattttggtaatattttcctaatttaaacctaggtgccaaatttaggtgtaaacaagtcccaccttaatttctctcccctatccacacacattgtgttatattatatggttacaactactatggcttgataaagggtctaaacactgtttcccacttcagttgaataaattgctattctcgaatagcatgagtggtttagtgctaaaaataattttgtacaagtactgagttgttatatttagaattaagtttgaattatgttttagggctaagggagtagacgaaaaccaaaggctttcaattttttttttattgtagatccacggggttagaccggagggcacttgtacataactgcatatctgtgacggtctatcccgtgtttggtcttgcgcaccatcacaccgtcatcatctttaatggatcgaaataaacaccgatacaaatatacttgttcatacatatttcatgagcatatattacgagctcgtcaccgataagacctattggtgacggacttatgtttcggcacaaagtttatctttgtcgggtccaaacctaaccacgtggtgcatgcaataaccgtgtgcccctgtggcctgtgcagtgtgcatctatcagcagcgcatgtgttcagcattaatttgttcgacgatcaattctcgaccccaatctcctacagtatcaagcttgatgcatgcttattgacttgactcaagactcttcagatggtcgatatttagctaattaatgagtgacgatcgcgatcaatcctaggaaaggaaatggcactccgaggtacaattgattttaaaaaatcacatatacgtaacaacgataatatttacattatcataaacacacataggatatgacaactaaaaataaaacaacaacagactaacagggatactatcttgataggcaggggcggatccagcatgggtgctgggactcaagtcccctctatcccgctggatcaccattgatagaagaggagatgaaaggggaagaatatggagaaaatgaagggtagggggactcaagaagaaattaggagatgagtcccctcttaaatcttgttctagatccgcccctaatgataggcactaatatgggatatgaaccaagactccacttaaaacttctccaaaaatactctcgctgtaaagaaaaattgaacaagaataagtaccatccacaatactcagcaaacaacatcgaaaaaaatattctctccattttaaaatataagacacaaccaacctttaacccaaagaccaagaaataattattatcacctcatagtttggattaccctgataaatagaatacatgcacccaataaaattagagatcttcatggtggatgatttaaataataatattttagtgaaaaaaaagtggtagttaatgatatgcatgcatgctcaccttatattataaaacaactttaaaaagtagttatgccttatattatgaaatggagggagtatatgaataatgcaagggtataaggaattgtattatagggatgttttgcagtaaataagcattttaaagcagttgattatttaaacattttaaaacaaccatactatttttttcttttaaccagaaaacagtacgggagccccactatatactaattataagcaattacagggtttatgtacacaaggaagattacatagcgtccatccacggaaaacattgctaatttgctgccttcactactgcgaaactgatctttgctaggtcgacccaaaaccacaatagtcccggtttcaaaaagaatcgggcctaaagatcatctttagtcccagtttaaaaccccacagccattctatgacctttagtcctgattggtaacaccaaccatctttagtcccggttcatcccaagtcagtggcctgtcagggggctgaggatctttagtccaggttagtgtcacaaaccaggactaaatatcaccactttagtcccggttggtattaccaaccggaaaaaattaaacgcgtagtatataatccctctctctctctcttatcctctcctctacaaccggcctctcctctcctcagatcgatcccttcctcctctcctcccctcccctctcctcctcccccctcctccccttcctcctcccatccccggccctctcctccccctcctcccttgccatccggcggctggcggggttgcgctcggcgggcaggcgaccggcagtcggcggggccgcacacatggcgagtggcgagcggcggcaggcggcagccgctaccagcatcctttctctttttttttcaatttgtgattcactgagatatataattttgtgattcgttgcatggatctgagatgtataatctgtgatgtatttgatttgtgatatatttgatttgtgtgtataagtaacttaagatctgtgatgtgaatgttttgtgatgttactttgatttgggatttggggatatgcatcccactcgatttgggagaaaatacaggattaaactatggctagagaaacaatgaaaaaaaaagaaaaggagacctacgcactggtactgccgctgccctctctttagtctcggttggtgttaccaaccggaactaaagataccttctctctagtcgcggttggtaacatcaaccggaactaaagaggcatcttaagtcccggttgaaaaaccggaactaaagggggttaccaataagaagtataaacggtttctccacccgtgctttgagcagttactaatgtggttcagtgagatatttatgtatgtatgatgattgtttgttcgcctgtgtatattaagaaaccgccagagtaaatgtaattttgtcgcatattaatccggtgatatacattctaaacaagggagacatcctgtgcatatttttccggtgatttgtccactgaataacggaataattcagcggattaccaagtgtacgatcgaagtcgcgagctgggctacgaacgaaacgtattgggtcaaaaatggacctacaatagtagtcggactccgccgtcggactcgaggccaccattaccgctgctaactaacggctcgtttggcagaggtttaaattctaaatttaactttagaagaagttagatttgaagtgaagttgtatagcaacctaaattcaaactccacctttttagtttattttatgatagcgctccacccaatttcgctcctattttagataaaactaaaactatttagctagatttgagctccagaagagatggagtaggagttagagtcgtgccaaacataccataactttaggtcttgatgccatcgactccaatatatttgctgtaaaattggtgatttaagttagtaattggctgatttgctgttggctagtaattgttgctgctaaagtattatttgtagtgtttggtgctatacggctatgtattgctgttgatggttaaatggttaatcttggttggcttgttgctgcatgtttaatgtgtgttactacttgctccctccgtcctataatatactggctctgtttgaccacttgtcttattcaaaaattttgtgcaaatataaaaaacgaaaagttatgtttaaagtactttggataataaagtaaataaaaaaataataattctaatttttttaataagacgagtggtcaatcggtgtaaacaaaaatttaaaatcccttgtattataggacggagggagtactagtgtattccttatgtaaaatcaaatgtgtttttgattattattctgtgataaacaattggcatcggagattattggttttgttatttggaatttattttcgaagtggttttggagatgattggatttcacaggtgaatctacatgtactgctgtcatttatgtgtccggtcagaccgggcagtggttgccggtcagaccggcgtgtatagggcggtcagaccagcgcagcccacggtctgactgaccgacgctgtgtcggtttcggtttcgggtcatttgtttggatatccgtgattgtttcatgattatggcttctagatggatactatacgtatgttgatactgttgtttgctactaatgagtcaagttggagatagtttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatggagatttcatatggcatacgatggaggtattgtgtgtgtatgggatgcggagccgaatttggaaggagtccaaatttgttatgattggttatgtaaagtttgtttcttgtactagagggtttcctaaggtgtttaaaatttttagtataagtttggttcgtggctttaggctgtctatctcgggtataaatagagggagagcgtgaggcttccctgtatcgcttttgagagcaattgagttgagtttttcaattagggtttcgagtttagtcgaaatttttgtaaggaatgctgttggtgcactttgtaaacacagagagaagtaataaagtcgtcatccactttaagagttcttcgatttgtgtttcaccgggtttcgatggtctaaccggcggtcagaccggcggcaagcggcggtcagaccagcggcagcgacaggcgcagcaggcgacttcggcggtcggacctgttgatctataccggtcaggccagcggcattcgagcggtcagaccggcagatcaatctcggtcagaccgatctccatcgatttcgagggtaacttttatttcgccaaaagttttcagtttttgggtataccacccattcatcctccctctaattggcttagttattgtgatttaatccttcaccttactgctgcctccttctccctttgaggtttaatttcgggtatgggcacctggcgaatgcctcgtacccgtatgaggacggccggagacgggaaaacccctccccgtgtgcggggatgaggatgggaacgacagaaatttctcagtccggtgatggggatgtgaatccgacggatacccgatgcccaactcgcagaaaagattagtagtaattgatttgatttgaattgacaagaacgctaccgttgggcgttggccattaattagcaaactggtgacaagaacctgctgacagcctgccttggtgccatttgccaactagcatgagctgcccctgcactgcacggtgcacatcgacgcagcggggccgctattttctctttttatttttataaacatgtttcctggttgttaaacactccctccatcctatattagtggtcgctttcagttttttatttataaaatttgattattcgtcttatttaaaatttttttagaattatcatttattttgtttgtgatttgttttattatcaaaagtactttaagtatgacttatcatttttttatatttgctctaattttttaaataaaatgaatggtcaaacgttacaaacaaaaagtcaaagcgataagtaacgtgggacggaggtagtagattgtaagatattttgactttgatcaaaatcaaactattttaagcttgactaagtttgtaaaaaaaataataacatttttagcccatgacaaatttattatgaaaatatattcaattatcaatttaatgaaactaatttggtattataaatattactatatttacctataaacttagttaaatttgaaatagtttgacattgaccaaagtaaaaacgtcttataacctggaacaaggaagtagtatgtttggtaaaaaaattttctatagagaactatttaaaataaatccatttcgtaatattataataattaatacttgattaattatatgctaatgaattatctcgtgttatctgtaaaaaaaacttttagacaactaaaccgatctgaacttatccggctttgtgctgttcctgttaaggttcctttggaactcgctattcatctactttctctgttttatattataagtcattttaatttttctaatatttcttaacattaaataaatatattattaaaatatatttaatgttatattaattaaactatgttggtattatagacgttactaaattttcatactctctctattacataatataagggattttctgtcacatccatacaaaatcccttatattatgggatggagggagtataaattattaggcatatcttgaaaagtttgattaaaataagtcaaacggcttaatataaaacgagggtaggattttagttgatacatgaagctagacaaatcattaacggtacgagtaataaagtactaataattattacgaacacataaaatatatttattttatattttaaagaaaattctatatagaaatttttacataaaacataccactataataccatttagtagtttatgaatactcgcatagaagtttctttctccatttcaaaaatataagacatagaccacctttaacctaaataaaaaaataattattatcatcttctagtttaaattaccctaataaatactctatccgttaagtcattttgagtttggtcaaagtcaaactattacaagtttaattaagtttgtagaagataataataatatttttaactcaacacaaatttactatgtaaatatattcaattattgatttaatgaaactaatttagtattataaatattactatatttatctataaacttaattaaatttgaagtagtttgactttaattttaactaaagttaaaacgagttataaccttaaacggatggagtataatacatgcatctaattattagagatatttagtgtgatagatcttaaaaaaaggaataatttagtgggggcggagggagtatacatgcttgcaaatatgtatactcaaaatcctataatataagggattttaagtttttatttgtaacgtttgaccactcatcttatttaattttttttttgaaattattatttattttatttgtgacttgctttattatccacggtatccacggtactttaagtataacttttcgttttttatatttgcaaaaatcattgtaagtagggagtactaaatagccgtacttaatagctggtcagtctttagcgtgacttcggcgtcaaccatgtcactgcaccttgagcactgtgtagtgtgtactatgcatgctgacaacatgcacagacatgttggtcttctcgccaaccgaaagtgtaaccgattgcacgaacctgcatgactttgggtgctttgagtaatgtgcatgcactttgaggcctctttatttaaaggaaattcatataaattttaaaaaaatttattcctaatgaaatttttcctatatagccctttgaatcaaaggaatggatcttatggaatcctatgaaattcctatggattgcctaatgccatgcaagttttggaggaattttaacatgaggtaaaacctcttggaaactttcctttgagtctttatctctcctctaattcctgcgtttttcctgtggtccaatcaaacgatcgttcctgtgtttttcctgtgttttgcaatcctctgttttacacttacattcctatcaaaatcctgcgttttttctattcctatgttttctcattcctgcgattcaaaggggccctgactatgtcaatggccataaaccacacgtttatgattacgttagatacgcaacctaaccaatataaggatgttagatggtatattttttttaaaaaaagtatatatataagttatttaaaaaattaaataaatcaatttctcagttatataatagtaaataattaattaatcatgtgttaataagttttctcgtttcacatgtcctcgaaggttatgttgtttctccgcctttcccaactcacctatctctttttccatgcacactcttttcatactactaaatgatgtgtttttttcaaaaaaaattatatataaaagttactttaaaaattcatattaataatgcactaatgagccactccgtttacgtgtcgaagagcttactccctccgtcctaaaaaacgaatctagtactggatgcgacacattccagtataacaaatctgacacattctggtatgtctaaatttgtaatagtaggatgtatcacatccagtggttggttttttatgggatggagggagcagttaccaaccatcctgaaggaacacagccatttaatgtctttctatttggaaggaacaaatgtactccctccgtctaaaaaaaggcacacctaggtttccgtgtccaacgtttgaccgtccgtcttatttgaaaaaattatgaaaaaaattaaaaagacaagtcacgcataaagtattaatcatgttttatcatccaacaacaagaaattactaatataaaaaatttttatataagacggacagttaaacgttggacacggaaactcaatatttgtctttttttttgggacggagggagtatagccagtcaattacgtgcgtgcatgtcttgtactaatattttatactgaaagtgtgaccatggctagatgcttagtaaaatacaaaatattctttggattttcttcatgcccgtaaaaataaaaagggttaatttcatccatgccactgtaaatgttacaaatcaaaaatatgccactactattcacgttatctgcttggtgccactgtgaatttctaaaattggaaccatgccactccatcactcttttcgtcctcatgtctcccccccccccccccccgcatctcccctgccgtgccccgtttgccgcagcatggcccggcatcggtgtcctccgtggcagcgccgttccccgacctgatgcggtacgcgcggagttgcagctagcgcggcgctggcgcagatcctggacttcgcggcgcagcgactcgtcggggtctcgctggcgatgccgtgcccgctgtcgacgatgacacgatgtcatcaccgagcgcgtagcctcacgtcgtcacggagagaggatggggaggacaaaaagagtgacagagtggcatagttccaattttataaatttataatggtactcaacagataatgtaaatagtggtggtatatttttaatttgccgcagtggcatggatcaaattaacctaaataaaaagggtgtgcatctctataggtggcagtcgtaaattgcaatgacactaataagacacatcattagtgatgggtgcatgttgggaaatccagcatctatgtgaagttttcaggtgactagtcgacaacggctaggtaggttattacatatattatacttgtatgattttgatgaataagagtaataccagctttagccaacatgagtaggtttattaccttctaatgaagaggcggaaccttttgttaccttctaatgaagaggcggaacctatataaaaatccttgtttccatctttttatacaattttgcatatacccatactatgcaaataccgtagttgtgatctaaaacatcgacaaagctgctaatcaagtctctttaacacagggatactctgcgggtcaagacagaacattagtagactgttgtgaccactcactggaataacacaggaaaatctcacctggaaaaaaactgtctacaaattaatataaatatgtttcaatgcatttgtgacccattgttgtgaattcttattttccaataaatacttcacctttttcacgatactttgatatggattgttttctaaagcatgttttgtgcatggactatggttggaggctttatcagtcagctaataatctaggtcgtactccttctaaaaaatgaaccaggattggatgtaacatttcctagtataatgaatataatgaatctggacataagtatgtcctgatttgtagtactagaatatatcacatttaatactaaattatttttttatgggacagagggagcagggtattattgaaatgattcccattgcaacgtacggacagctaactagtaactaaaaattggaataataatataatgaactagctagctagtacgtagagtagttcataatgttacctgggttagtggcggagcatgcctaaaaaattttaggtgggttatacatggggtggtagttagtagcattcctacactaatcctagctagccgatgcaaggtatactgggtagcatgtgtatttttagttgttttatgatagtatattaattacaatattgcttgataattagattattagtatgtaccaaaacctacgtaatttttgttaaaggtttgttactggcagcagtcggcagtggcgatagatgaagctagtgctagggttaaattcctcactgcattggtgagtgcctcggtggttatgtgtgttcgtcgagctattcaagtttggatcgcttgagatggttaccgcagcgggtcaccaacggcatcgcacgaaaaaatcaagttatctaacgtaattaatgtgttgttcatcaggaattaggagacgtgctagttttgtctgacgattaaattgtaatgaacaaaataaagccttctcgttctgatcagatattggagtagtgtgtagcagtagcataaaagcgactttgaaatgtaattagcaatagttttagcaagtgattgaaaataactcatgggagctgtcgagctgatgagatgtcatgcactaagtagcagtaactgagagaaaatcattgagattaggtgccactgatgggatttccttaactaccaagcaacaaaccggaaaaaatcgaccactcggttatctttctggtaggcaagcagagtggtcgattttgtaatcgggattggatcgggcacggatattatcggatacgaatagaagcatggataatatcgagtataaatatggaacgaatatataccaagacgggtaagatctagatacccgaatatgacttgaaataatgtggccggacgggcggtagggtcctggcagcaggtaagctggccatcagatggcccaccatgccgtatggggcccatcgcctctaatcaaggtgaaaaaaggatactccctccgtttgaggttataagatattttgatgttggtcaaagtcaagattttttaagtttaattaaatttgtagaaaattatagtaatttttttaacgcaagttaaatttattatgaaaatatattttattattgattcgatgaaactaatttagtattaaaaatattactatatttgtctataaacttagtcaaacttgaagtcaaacttgaaatagttctgactttaaataaagtcaaaacgttttataacctaaaacggaggaagtacgaagtatacaaagtagtactattcatcaataccatgaatctggtcaacagaatataattcaactacgtgcgtcgcccctataaattaagtgcgtgcgtttactgatggctgcatattagtttgtgtgtgcgctaagtaatcgcccagttaggcggtcatctctggtgcttgttgcgcggcctcttccgtccacgcaatatctgcggttgttgctggatccgccggtgcttgcaaatattttgcaaatttctgctgacctgtaagcacacatctcatcgactccctaatttcttttggttctgttcaggctttgccaattccatacctcccgttcatatgaaatgcaccttgatcccaaaagaataattcaccagccgtttataagaaaaacctattatccttttaaagtaataaaaaaaaggagcccccacgttctctctcatgacttagaaattctgatattaatcggagaaaaagaaaattagaatccataagaaataaaatttaaaaataataaaaatttagaattaaaaatagggaatataagaagaggagactagagcccatacaagtatacaatttagaactaattgaaactcgaaattaaaaaataagaaaagtaaaacctagaagtcagagtccctatagaaatataatttaaaaataactaaaattggaattagaaaatacgaaatatcagaacaagatttcatagctcatacagaataatttagaaaaaaagacttaaattcaagattaaaaaataaagaatattaaaagatgagtttagagtccatatataaatacaattagaaacaacagaaattcagaattaaaaaatagaaatattgaaagaagagtccagagtccatataggaatctagaacaatttgaaagtcaaattgagaaaaaaaataaaaatagagcttagagtccatagagaaatacaatttagaaataactaaaattcaaaattaaaaaaaataatattgggagaagaatctagaatccatataagaatataatttagactctaagaatataatttattttataattttaaaaataaggaatagtggaaaaaacttagagtccatataggaatacaatgataacagaaatttggaactgaagaataagaatattgaaagaagaatatagagttcatataggaatttagatcagttgaaagtcagaattaaaaaatttgaaaaattaaaggtagaatttagagtctatataaaaatacaatttataagtaactaaaattcaaaatttaaaaactaactaagattgggagaagagtttagagtacatatagaaatacaatttagaaataagtaaattcgaaattagaaaataattaataactatcaatacaatacaaaattcaaaattgtgttgttatttgtaatatattttgataataaaatatgctatattatatgagaaaaaataacgatgttacatgctagttctttagaatggctactgtagaggcgtatggataacagtaaataaccaaattaaagaatacatcagtattttcttaacaatgtacagatataaaagaaaaagagaggaccctcagtaaattttcctccctccacattctagcaaaaactcaggaaacaaaaaaaaacagaaagaaaaccactccgatctctcgtttcgcgaagggacgaggcaaatgcgtcgtcattagcattgatgtcaagcatcatccacacacactggtgaagcaatcaagaagcgagacatgcagcctccgtacgagctcaaccttgtatatggctcgagctcgcgccgccgcagcgagttcgtccagtacgccggccgccgccgctagaccttgagcagttcagctccggtgatccggcccggctgcggcgcctcccaagctcgagacgttgaagccagcgtcgatgctggatcccacacccggccgcgccgcctctcccaagctccgatccgatattcagacgtcgatcggtgttcggagaccgcgccgcggccgtgggagattccatttccattggagggcgtgtcacgtgtgagagatagggggagatccgggttaaggttaagatgagatacactacataatttttttcccaaatgatcaaaatctacttttacatgcaattgagccacagtcagatcaaaagtgtctgcgaaaatcgctacttttttatatggatggcgcacccgtacacgaaaatctaattttcgcttgcggatgcttatatcatcctcactcaaaaataaaaatcctaaaaaaaatcaaaaccgtagctaggtgcggtccgccgccgccaccagatccacgcacgggtggcctcgccgccatcgccctcgccttctctgccaagtgggggaggaatgttcccctgcgcgtcgatggtgggggcggccgcgcgaccgccgccggtcgtgctcctcccgctactgtcgctgcccgttgcacgaggtcgctgctgcctgccaccgctcaagcccacccaccgccactggctagctagtcagctgtcagcacggctctcaggagggaagtcgagtgagagagagagagagagaggagagaaggtgagaaatgagatagagaggagtaatatgatgaagagaggggatgaatgaataatgataacttgaaaagaaaatttagtgctaagagggaaagaggatgtaagttagacttttagatggaccttgaagagcctcgcccgcgaaaatacatttgccgcataggaaaataggcttattttcgcatacagctccataagagattcgtttgtgaaaatagatttttttgcatgcaggcctttaaaagagtcgtatacgaaaatggaagtctatttttacagacgctaccagctatggtccccctaaaacctatatgggttctcgtacataaaaatcgttttatttagtagtgttaaataaatataatcacttacacttatagttttatatgttttatttttccgatatttatattcttgtgttttgattctagtgaacaggttagaaacgcatcgaaacaaatgatcgaatcatatacttttccacgaaaatcttataaaataaacaaccgtataaagtttttaaagaaaaataagcacaaggttatacctcatgttttctctttccaattactccaaattccctttgtttatactatgggtcaatcctacgatagtttttaatattcttcaacgtagaaattcaatattaatgcatgggcatgacatttaatttttacgttttatgtgtttttccaattccgtcggtggatttggatatcatctacttcctctgtttcacaatgtaagtcattctaacatttctcatattcatatatatgtctagattcattaacattaatatgaatgtaggaaatgtgttagaatgactgatttattaacatcaatataaatgtggaaaatgttagaatgacttacattgtgaaacagagggagtagcttcatatagcaagtcactataccacggattctttttctttgttatatatagaaaacgcacaatgtaatcacaagcaccacactcatatccttgcatcttttaacacatgcttcaaaaggcaggagtctaagcataattaacacacgatatttcacttcacgtcatgtagcctccttaccaagtcacatataaagcacttcgtgaccgtgggatggatgacattcttttgacttaatctctctaggacttataacacatttggtattacaaataatatcaaatggaaaaaaaatcatcaactacaccccgtcgagctgtacaacttaaatatagagaattatcatggttagggataagtcataacttttatcctatgactcacgggatatacggatatggcacaccttcgtatgtacgacaatattccgtatataaaaaggaaatcgacaagagactatggaaataatcgcgcgggtaggcacataacagagtcctgctcggagaggtttaggattttaccatatagtgcaaggtctgaggtctccgagttctacttggagatcaaggtgatccattgtataaatacataccccctaaggggtccaaggtatcgaatcatatcactagccaacccgtcaccacataagcaatctgtaggacttgaagcctactcgcttagagatctcatcgagactatctcgtaaaggatctcgtcggtaatctcgggatcagttgttcttcattgtactctgcggttttctatattaatctcatataaactggattaggttgttacgttacgagtggactgaactagtataacccttgttttcttgtttgcttgatatcatatcgtgtagatcctcgtaccaacttatcccaatacccacattatccggtctacgggtattgtcacaccccaatccggcaccgccgtacaacggcacctgataggagcgtgtcgtaggaaaaacggcgtgaaccgcttcctacgaaaccgcgatctcagtaccagtcccaggacatagcgctggtacccacggtgacaaatacgaatcattgcaatccttaaaataattagaggacttatttaccttaacttaggttgccgctcgggacagcccgagattacaaccgacgacacggacgaggcaacaccaacaacggcagcagcagcggaaacaacggactaacccccaacaccacaggcaacggctgggaactaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggctgttatttttcaatcggttttgttttcaaggttttcaacaatctaagtgtgtgctttccacaaccagagcgagacaagtctcagctcagtcggggtgagaagtaacaaatttatttatcaagatttgcacaactcccagagttggcctcaaagctggttttcccaaaccaaaccatttttccaaacttcccaataatagtggtccccaaacgaccaatcacttccagggacttccggtcccgctgtcccccggacagctaattgcttcccaagcattaggtttcccaaaccttaacaccttttcataaaacagggtaaaacaaaaactacgctaaggaatcacctcacatccacccatgcccgtgggcacggctgttcgaacagtttaataacctctgcagagggggtacactttacccacacgacgttactagccttggtcacctagcccatgcagaacagccacgtctggtgactttggggctttcacgacaaggcatttcgaaagccgacacagggttaccatatgccaacgagaggggacccagaccaacaacaagttaggtcctagaccatactgcgccaggaagcccgggggttctccccgacaccaccccattgaatccacatgtctcttggcatcaaggctcccttgattagctatttactcagccagaggtgtcccattccacccgtgtggtcgcactattgtatgctcggatgtaattccaaaggaatcggtccttagatgcgaccgcacaagtattccgcctaggaatggccttgtgtcgcgagttttatttttaaaactcattttctttcataaggcaccgacccaggcgtcgggttttccaaagcttttgtaaaccaagttttacccaagaagttacttagattttaagtttgaaggcgaccgtcgatactcgcacagagtgcacaaatatcgaggcgcaactagatggttacaagggaacatgatataacaattaacaatggaaggatcagatgcaacaagttgggtaggcccaccggtctgccttgcagacggggcaaacagattaagtgcaatcctatcaatgcataatattttgcaagcaaattaattaagttcaaatataggctcaatatgttcaaaggtggcttgccttgcttagggtcttcacgaagcttcacaaatcttcgagaattccacttgaagaaaaatatccggtaaccgcaactaggcgcaaacaatcaaaaacctaaacaaagaccaaataaaatatcctatttaggctaattaatagtgccattagatagatcacaatttaatggaattattggaagtggaacggggtaaatcggagttacggatcaagagatatgaattttggaggtttaattggaatttatggacaaaggaaatgatttattggaatttatagaaataatattctcaagaatattattgacagtcactgacgtgcgggaccaagggaaattatttagggaattttggaatggagaattggtttatggaggcaaaggaaaaaggattcaataaatcccttggaaaagaaaaggaaagagggatgggatttatacttcctccttggaaaagaaaaggaaagagggatgggatttatacttcctcggggtggctagggcgcggcccgaggggtttacaaggcttagccggccaatgggctgagcgcggccacggggaggcggcccaacaaagggggcgcgggggggggggggggtgagagaggcggcccggtggacgcggtccaccgcgcggggcccacgtggcggtggttgggttcacggtggggagggcgcacgcgggttgcggcgctagggtttcgggtgcgtgtggcttaggagcggtgcactgggtggacaaacggcggcgggcccacgcgcagccccatggcgcaccgtggtccgcgcgcttggaggggaaagcggggctggccggtttgactcggtctagccaagttggcaccgacgtggcgcctacgtggcagccacgcgggccggtgggaggaggaagaaaggggaggccgagacggacggcggacagcggccgagttcaccggagccttgcgggacggatttggtcttcggggagcacaccggagtgacgagggattcgagagggagcgatccaacggctcggattcgccggagagaggccggcgacgatgaatcgcggcggcgcacgccggcagcgagaaaagggggaaaatccaccagagcaatgggagttcgattcggcggggtgggagcatctccgatgttcaaggggtgcattcccggcgtcggatggggtagagaagtaccgaggagggccggcgacgagcggcggcctccgggatcagacggcaatggcggtggggccatgccgggcggcggcagggcttggggcagcatccacgcgcgttcgggagggctatcgagccgctacgcaagctggagtggaagaggaaaagcggggagggagaacgggggctaccgcgtcgggagatcgctgggaagagcgtccgacagcgcggcgggaccgcctcggcctcgagccggggaaggagatggagagaaggcgatcggagtccctttcggctccgcgcgcacgccgacttcccggcacgtgcaacggcgaggaaggtggtggcggcaaggcggcaagaacagaggaagagcggggagcggcttggcttttataggcggagaagaggcggtttaggagggggaaccgacttagatggtcaagggagctcggctatcgcgtatggtcaaggtgggggcggcgaacttggcagtcacgggcggtagagggggggtcgatggtgccggtcggggaaaaagcaaaaggggagggaggaaagggggctctgcccatgccattctgggagaaaggaggagggagagagagctttgcctccgggagttggacgcacgtggcttggagcggccgggcacacgtcgcagggggtgcggggccgagcggcgcaggcggcgcaggcgcggcaaggctgacggtggcggtgactggtcggtcggccatgcacgagcgcacgcgaaggcggtggcggttcgaatcggcaaggcgctggcgcggcgaggagcgagagcgagcgagagagagagagagagagaaagaacgagagagcgatctcttggctcggctcggcgcgtgcaacacacgtgcgaggctgagggaggggataggcaggggggaaatgggccgagaagaaacggcccacaagccagagggaggcaaactagactttttcaaagagattgaattggagagaatttggagtttaggtttgaattcaaagatgatatttaggaacatagggtggagtcaaggaatggattcaaaacgggaattgaatatttttgtagtcggagcgaatattcggtaaggattcaaaggagactccgtatccttggggttgggacaatggtatgggatagatttcaaaggtagttagagaggtcaatagatagatagatagctgggtagacaggtcgataggtagactgataggtagaaggatagatggatagataggttagataagtagatagatcgatcgataggcagggagggattcaaggtagggatttgatatttttggaaacgggaacaggtatttggcgagggttcaaaggaggcgattaacctttggaataattgaactcggaattagaatcttgaggtggaggattttgatggcgatgagaggaaacaacaggatttgaattgagatccaaggcacgacttagactcacactcaaagaacaaaaattttcgcaattaggattttcagtaaattagcttttaacgtctcgcgaaaagcggggcgttacaggtatcccccgtggataagaatgtcttcatccaagattatttagaaaactcaaattctcatattcttttaaaaaatagacaaaaaatattgggcccctaaacaatctcaaatgaaaagttttcacctataaagttgtagaacctgtctagagaaaatacttaggccatattaaaagaaatattgtaagggtctcaaaaaaacttttggtttatcacaatcggacttaaaatgactttctatacatttttaaagtttggactttataaggaactggatattagaacttgcaacaaacttttgtgcacctaaacgatcttaaaaataaaatgtttcgactatagagttgtagacatcatcgagctctataattttgatataaaacttgtctccatcccaagtcatttgtaaaaactaaaaaaaatcattttaaaaaatagatccaagagcttgtaacgaatatttggaccccctaaacaatctcaaatgcaacaatccagcaatttactctgtttctaagccacagtcgcaccgactctgcatcattaatttcaggcacccgaaataatccactccatatcagcaccctgcttccagtccgtttaagaaatgtggtgtaggatttggtatgaccactatccatccaaatccactccgttttacttccggttcatgatcatgtactagaattaaaggctatgcaactctgagcagcaaatatttactagttacaactaaatagttacacggtagaaattttcacttcgtttgaactaatatagttgttgtatgaataggtaacaaatcaagcaattcttgagagggaaaaggtggagctggataattcttccaccaggtactcactacaaattaaataccattccctccagaataaatatattacgccttggataacacatctggtcaaaattttgaaactttgtctcatcgaatttaaaaatacttgatttgaaaacatagaattggtatgtatagatttgtattgaaaaatactttcatgatatcataaactgattttataacttattctaattaaaaattgcgctcaagattacaactcaaagtccaaaaaagattcaatgctatattttttttatcgaatggagttaatatttacccatactacactttttgagcaccttatttattactctgcagatccaaaatataggtcattttaattttctcaagtcaatattttactctgtatgatccaagatgagttgagaaatatccaattaagctcgtcttttttcttttgattcctcattagtcttgcaaattaaattaatagtgaagtgaaatgaggaatcaaaagaattaaggtcatgactaatttaatttgatcctgatgagttgagaaaatatccaattaaggtcatattgaattcgggaagtagttattatgataaacagcattcttggctgctttttcacaaaaggatatatagattcacagttgttagtttagatgtcatgtctttacccgtgcatataatcaagaccttaaattgtacagaggtagctggtcatgaagattgctgcaactggacagtttctcttggtccttatggcatgcagtgtaatccaaatcgtgtgccaatcgttacatggaaatgagacagatcgactttcgctgcttgatttcaagaatgcaatcattttggatccacagcaagcattagtgtcctggaatgacagcaatcaagtatgcagttgggaaggtgtcttttgtagggtgaaggccccaaaccatgttgttgcacttaaccttacaaatcgagacctagtagggacaatatccccttcacttggaaacctaacattcctcaaacatctaaacctaacaggaaatgctttcactggacagatccctgcatcccttgcccacttgcaccgtctccaaaccctctccttggccagtaacaccttacagggaaggataccaaaccttgcaaattattctgatctcatggtgctagatctgtatagaaacaatctagctgggaaatttcctgcagatttacctcatagcctagaaaagctgagactttcatttaataatatcatgggaaccatacctgcttctcttgccaacatcacaaggctaaaatactttgcttgtgttacactagtattgagggcaacatcccagatgagttttcaaagttgtctgcgctgaagttcttgcatttgggtatcaataagctaacaggtagctttccagaagccgtcctgaatatttctgctctaactgaacttagcttcgctattaatgatcttcatggagaggtgccaccagacctgggtaactccctgcccaatctccaagcatttgaattaggcggcaaccactttaatgggaaaatcccatcatcaataacaaatgcttctaacctataccttatcgatgtatcaaacaataatttcagcgggggattggctagctcaatcggcaaacttactaaactgtcttggttaaatcttgaggaaaataaactccatggacgtaacaatgaagaccaggagtttctgaacagcattgccaattgcactgagctgcaaatgttctcgatatcttggaatcgtctagaaggccgtctgccaaattcatttggaaaccattcttttcagttgcaatatgtgcacatgggacaaaatcagctatcagggcaatttccttctgcctaacaaaccttcacaatctggttgtgatagaattgtctggaaatcgtttttcaggtgttcttccagattggctaggggctctcaaaagcttgcaaaaactaactgtcggggacaacaactttacagggctcattccatcctcccttttcaatctaactaacttggtccacctctttctatactcaaataagtttagtggacagctaccggcaagttttggaaaccttgaggcccttgaaagactgggaatttcaaataacaactttgatggtactgttccagaggacatatttagaattccaacaatacaatacattgatttatctttcaacaatctagagggacttcttcccttttacgttggcaatgcaaagcatctgatatatctggtactttcatcaaataatctatctggagagatccctaacaccttgggcaactctgaaagcttgcaaataatcaagttcgatcataatattttcacaggaggcattcctacatcgttaggcaagttactcagcctgactttgcttaatctgtcttacaacaacttaacaggaccaataccagattctcttagcaatttgaagtatcttgggcagcttgatttttcattcaaccatcttaatggtgaggtcccaacaaaaggaatattcaagaatgcaactgccattcaacttggtggcaatcaggggttatgtggtggggtgctagagt

SEQ ID NO: 64494 - DNA, 6602 bp, Oryza sativa
  unsure (1)..(6602): unsure at all n locations
caatgacttcaaagctttagtgtataagtttatgccaggtggggatttacataaattactatactcaaacggaggtgatggagatgctccacatcaaaaccacattacattggctcagagaataaacattatggtggatgtatcagatgcactggagtacctgcaccatagcaaccaaggaacaattgttcactgtgacctgaagcctagcaacatccttctagatgataacatggttgctcatgttggagactttggccttgcaagattcaaatttgattcgacaacatcatctctaagttatttgaactcaacctcctcccttgtaataaagggaaccattggttatattgctccaggtaactgttaactttaccttgttttgcattgctacatatttaatttattgtctgatatatgccaacttgtgaactcaactcttgtcatatgtaattttagaatgctcggatggtggtcaagtttcaactgcctcagatgtatacagctttggagttgttctcttggaaatatttattcggagaaggccaacagacgatatgtttatggatggattgagcattgcaaagtatacagctatcaacttccctgacaggatacttgagattgttgatcccaagctgcaacaagaattgatcccctgttctacagataaggaagatttggacccctgccaggaaaatccaatagcagttgaggagaaaggcctacattgtctacgctctatgctaaacattggactctgctgcaccaagccaacaccgggagaacgcatcagcatgcaagaggtggctgccaagttgcacagaatcaaagatgcatatctcagggaatactagggatctctcgtagcatcgtgtgcatcatctgtttaagtagttcggtacaacattgggtaaagaagtggccattgtcctactagaatgtgctgttccttgttacaacgcgcggcaagatgtttctgctctaatatactgtttgatttgtttttccttgatagagggtggcatgacatcttgcatctttcatacagagttctagagaaaaggcctttatccttcatacggagttcaccatattccggatattccggatcttatattggcttaacagtcccatatgtctaaaaaaacttgtacatttatgaggatttttaccgtccaaaggtacctggcggtaccaattctttaccgttggatccgagcaaatccaacggctggcagagattggtactgcggggtgtcagttctgtccctgatgtggtactgttgacggagtagatcacgactacggtatttgcatactatagggattattagtgccaaggcatacgcgagaatgagataaaaagagacaaatatttttatacaggttcgggtcctttaactgacaggtaatagccctactcctgttagccgaaaccggtgttgtttttattcatcagaatcacacaaatacagtacttgggataacctatctagctgtcgtcgacttggcggcatagaacaccaacatataattaatgacgcgatagcctttctcctcgaatacagacgagatcagagatggcgctagatccctcttgtcggcctttgtggcaccagattgggtatgtctagacttatctccgatgtcgatgtctggcggcgtgtattggtgtctatttcgactgaccatgtcccctctcctcctattggatcttgtatttacacccatagatgtccccttgttcaattagaactaagtagacaagtatggatacgaccggagtaatccttgtagtttccaacttgaactatgtttcttctttcttattcggaacatctttcgcatgcggggtctgatttcgtataagacttgatacatggtggacccaaccgagcttggttgtgtgcatgagcttggttggatacgagcttggttggttggttaaggatcatcaagtactagcacaagctagtttgcaaataacaaattaaataactaatatggagctaaataaataatactaaaataagacaacaatagcatggagtacttgctttcccttcacctagagcatctcaattgtccgcattaaagtcgccgcccgtcataagtgtattcactttttttcttgaagcaaatgacagcaggagatctgctggatatattagaagggggaaaagtacagggagagagtcaagagcaccctaaaaacagaggcactttcagagattacagacaaaataaaagcagctaaagaccgcactcaaaaccgtcaggtttggcgcacaagctgtatgaggtctatattttctttaaccagaaaagctacttgggtggcacttaggtaactttgttgaaaaaccctgcgattacgttcaagccacacctgccaccaagttaccagcaaagcccctatcaatttctttttctttctccttgcatcaaagaagcaatcttttcccaccaatctaaaatgcataagtgttgtgactgatttggcgcttgattgagatctagccagccacgaacctgattccaaacaagattagtgaaactgcattcttttgctaggtggtttgtgtcctcgaatgcatcagtgcagagactgcagatccaatcacatggccaatgtcgaatcaaaaagttttctgccgtgagaattttctggtgcagaattagccaaccaaagaaacgttgttttggttctgcttcagcttgccacaggggcttgaagctaatgttcgtagtagttccatggaactatgcctcataagcactcttcgctgtgtaatcaccatgttgggtccatttccaagtgatgttatccagagagttggtttgcaagacgatgtgttgcaattggctgcccagatgcaccaaatcgttaatttcagctaaagtagtgatcagtctcaaagaggtgagccagtgattgttttccagttcgagttgaacacagtttcctttcctttttgcaagtctgaaaatggacggcgctacgtctttgggggcacatccggacaaccaaaaatcatgccagaaagatgttttctttccatctccaagcgtaatcttagtacttgctctaaataaactcttatcaagctcatcacatggggtctccatattaatccaaggcttgttttcatctttccattcataccacagccatctgagtctcagagcccggcaaacttctctaaattgaggattcccaagcctcccaaagatcttggtttacagacggcagtccaatttaggagacaactacccccacttactttttcaggttcatcacccttccaaaggaaagctcttctaaaaggtcaatccttttataaagccatttgttttgttgaagaattgtgagatggtagattggggtcaaggacaaagtatttttaaccagaacttctctccctgccgaagtgaaaaagcggcctttccagccagggattcttgagcctactttatcaaccagtggctggagatcaactttccttagtttccttgtgtgcaatgggagtcccaaatatttacaggggaagtctgaaacttttccagggaatatattgaggcagtcttctaagtttattccactgcagcttatggataaatctcagttttgtccatgtttgtgtgtaggccgctaacctctacaaaagcatagagaatctcacgaagggttagcaaatcttctcgagttggcttcaagaaaagggccacatcatctgcataaagagaacatctgaatcgcctgtgtctttgaagacttgcaaggaggtcgtgatcttcggctttctcaaacaagatatggagtggctccatagcaagtatgaaaagcaagggggagagaggatctccctgtcgaagtcctcttgcatgattgatttatgtgccaggtgtgccattcaaaaggaccatcgaggaggaagttccaagcaggttagagatccaattgcaccatttttggctaaagccgaaattttccaggacttccaagagataggcccaattgacagtatcaaaggccttcaatatatccactttgaggaaaagagttggctttttggctccgtggaaatacttaatcatgttttgaacaaacaaaatgttgtcttgaattgctcttttcctaatgaaagcaatctgactttgggaaaccaaggctcctagtttgggagcaagtctgttagctaaaattttagctaaaatttttgcaaaactgtgcataagacttataggtcgataatcttcatctttagaggcatcggttttcttagggacgaggcaaatgttggcagagttgaggtcatgcagtctgaaggaacctaagtctccgaagaaggagaccgtgttcatgagatctgttttgataatatcccaagcctgcttaaagaattgccacttttaagatatggcaattaaggatttgccactcgctctctatgacatggggctctcgtgggcatccacatcgtcgagctccgcctttgctgccgtttgggtgaggagagaggagtttgagagaggagaggagaggagagaagaggacaaggagctgaggacttagaaatatcatgtggagctctgtatcctctcgcacctatttaaatgccataaccgattttcacatgcggacagcttaaaaagcccacctgcaaaaaaaaaagtgtattattgtagatagcatctttaagccgtctgcctatgaaaatagatttttctggtggccaaccattagaccactctttatatattttcgcaggctgataattgtagtaaaaaataatgtctgtatgtgaaaatatatgtgcctcactgtagaaaattatttttctagtagtagtgttagctgctatcttgctatctatctagtcccatgtgctatctattgtaaaccacggtgatggttgttatcaccgagatataaacagaggtgtggcccctgaaccgggcttgaacggttctgcagctctggttttcctatccccggctctgaaagttgcggcgccgggtgaagacagttgcagcaagctggatatggtacaggcatattgacttgactcgagaccctccgatcaacctaggtacagcagaaaaggacatgacagtcggacgtcttttgactgagcgctgaactgaaaagctgttgaaaccatacgaaatgaaattttctcgaaatttcggagtcaattggtgtggaaatttcttccacgtcgtctcggtcggtcgttccgccgaccgacttcttactccaacatcttgctctttccattattacgcatacgctttccaaatattttcctatagaactttttatagaatagctgaaaaatcgtattgaactatatttttattgttttaactaatatttaattaaccatgtgttaatttattatttttattttacacggggaagggttcccaacattaaggttgtgttctttcacatcagttcccaactcatctccctcgttttttccgtgtgtacgcttttcaaaccgtcaaacagtacgcattttgcaaaaagtttatatatgaatgttgctttagaaaatcatattaatccacttttcaagtttttatgctataatactttattaatcacgtgttaatctaccgttcccaacccctccaagacagcacagcctcacggcccgaataaattgcctcgatccatcaatacccaactatttaattttttttctttttttcagggaacccaactaataattggcgtcataacagaaacaattggcagctgttgacgagcgatgacgccctgcctgagtcagtcagtcaagattgaatgagcattataccaaggcctatctatctatataatcaaggaaccgcgtgtctgatcgaactcgcgtgccattctaatctggagattgctatttgctggtcgatcgatctgtatggctattgcgttgcttaccgcaggcacgcagtaaggttgggtttccatccacccttggccggcttcgagtgcccctgctatcgcgagctgtaactctgtaagcttcttctcggctctaagtctcatttgccataggaacatgtcgttttgtttgaagttacaaaaaaaaaagctttaaacaacagtgtctttttaaatctagactagctagttggatacacatactttgccacgaataaaaaaaatacattataatattatctaaaataaaaaaaatcatgaaacatgtttcccatctttttttttctatttggaatatccaccttagtttgattttgtatatggatatccactaatatttgattgttttcttcttaatattaataagttgaagggataatttgcatttttttaatgtgagtatgtatgtggcagattcactgttattaccactagatgctttgaaatgagtctaaacgttgggtgcataggtatagctagttttatttcaaagacaattgtgacatataatactcccttcatcccaaattaatacaacccgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64495 - DNA, 1970 bp, Oryza sativa
ttgtgagatacaattcacagagttgaaatcattatgctctgtctccttagcaacactcagcacgcagttttcattatctgaaaatgtttcatagtccaaattcagaggggcaacataatgcacaaattctttggattgaagatgatttgtctgttcctgattctcctccatcataattctgtccaagatattcatcttttccttttcttcagcttctccgacataagaattattaaacaaaaccatgcaggcttcacattctatcccacagttctgagaacatataggattctcattttggttttcttctttctgatagctgtaactcaaaggagtaattctttccttgcttctgccagtctcaatgcggagggttttgactgacttcaacttggacctcctggcatttgaagtgtccttttcgcctgacttgactgatcttccagcatcttccactgtggcaagcattggttgtgtaatcgaagattcaacagaatatataacatggttctcttcaatcaaatttccctcaatccttccctctctgctgtcatcaaattctggaactgaagattcttccagagcaaataaatcagcgaactcaggtataggtggtgctgagggaatcacattagcatgaaaatcaatttgttctgacacaacttgttggcttgtctcctgagaattatatcagatagttagccttccagaatatgaactcaaaattccaaagggaaagaaagaaaatcaagtagtagaacctaagtcaacagtgcgattagtatttgactgtaagcaatggagattttgatttggtaggatttaacttcaacatgcaaaatatataccatgcatccagtgcaacacatgggcgtataacattcagacaaatagccaaactaattgtttagcttgagatgaaagttatttttataatcaatgcatctaaagtaacaaccattcgcaagccatatgaaatcactttggagcaatttagatagtgcacaatataatcagcagctcccaatataacacatagatttttaccctaatctgctcacatgcacaacgcatttaggccattatgaagtggccgagattttcaaaaccacaacgcagaagatttctatagatggtaaaagcatcactaaaatagcattaggcagaactccagaacgacagtgtatagcaaaagcagctaaaagtcatcgtttattagaaacttgacatttccaatgaaaggggcaggggcactactctaagcaactactaattcaaaattgctgggtactggattatttagttatcagttaagaattaacagagcagagcaaatagggaatccagtagcacatattagacttcaaaatagtttgtaatgcatttcataaaactgtgagcatagagtatcaataaagtggatgagctaatagtcatttgccatgaaagaatttagcatgtattttattattttggcaatcagcagcagccaaggacatttctatcgcctgcatcatatgaatttcggcaatcaagcctattgcttagcgtttcaaaacgctcaacacatatgtccagaattctaccaaactatagaacatgataacatgacaaaacacactgataatttcagcatccagttacatgagtttacggggatcagacctgatgagtctcagtatccgctgactccttttgatcaggctccaactgcttgcttgcctcctgagcatttcaacaaacacttatattgcaacaaccatgcccccaaaataatcacagctatggcactgatcagaatagagaatctgctacctgacaagtactaagctcctccttatcctcctccagcagcggtggcagcagatcctccatgtcaaatgcttccgggagcgacagccagtgaagccggtattccctcctcgagctcccaagccgcagtacatcaccggctgtcagctccaccggag

SEQ ID NO: 64496 - DNA, 2899 bp, Oryza sativa
caatctgcggacgacatcagttggataagcatagtatcatacatacaccaatatacaggcttgctacttcgcgtgacacacagggagctaccaagtaccaacaatcagcagtacgcacatcctggccagaggagcaaggtcgacctcctcggtgtcaatagtggccgacggcaagcagcacatgcacaacagaagggaggcgtcggggcagtgcgcggccgcggactgcgacgaagggcgaactggaaatggctgcaggagaacaaagaccagtggagggcggaacttgttgcttctttcggcaggagaacgaagaacaggactcggcaggttcgatcgatttatccaggggcattttggtgagtcaagttatgaaattatagcaaaataattttaattaggaagaaacggagaaaatggcattgtagcgaataccacttggttgagagtggtattttaatgaaaccatatttaaagatggtatttcagcgaaacccatttttaaggagggcataatctctattttctccgctgacatcacctgagataccggggttggcctgtgatgatttaatttgttgagggcctatatgcattctttgccatgacaattaacgatttgtttagggctccctatgagtttgagaaagaaatgactgttgatggaaattaaggccggtgaaacttcttctgtctgctctgtgcgacagacataaaaaaaatgcatgagatactttgttgtaaattacttctggtagtactacactgtgcgcttttgatattggtataccaatggtagagatcctaattacttgcaaaaagaaccttgttgtaaatattatatgtattctacaatataataaatcatataataagctacatagtcacaaaactacacaccctgtttgaggagctcgagatcctgataagtaggttataacaatataaaaatattgggtttttcaactactgacttttaatttattttttagattatatgactacatactctcaaaatataggtgagaacctataccgtttagaaagctaaagattctagaagttgtagctaccataaactccccaaacaaaggcaaagtttgatgttgaaaatttaaggatgaatagtcagttcactccttcaacttttgctcagaggtcgaattagtccttcatgttttataatgtccaaacaggaccctaaagattatcatgcggcttaatatagtccttacacccacttaaaacgccacatggacatgccacgtcattcgtgcatgtaagataacatttaaatgtccattttaaccttcaattttctatcaaataaagaaaagaaaaacaaaaagaagcaatcataaaacaaaaaatgttaatttttttttatctatcaatgctacatatttttgccaatggtcaaaagcttttttttgtgtgttttctcaatagtttttctttatttcatatgaaaacataagggtgtaaagaacatttaaatattgaatttgcatgcatagatgatgtggcatgtacacatgacatgtttagagggtctaaggaccatattgaatcacacaatgaacttaaggtacttgtttggacaacacgaaatgttagggactaaattgatccttaagcgaaagttcaaggatcatgttgggtattcacccaaaatttaacacaaatttatgtacttaagccatgaagctgtgaaattatggatttagcattgaatttattgcaaaaggacagcattgttgtcccgttgaaactttgaaatatgtgtattgtaatgaaattggcaccaaaactatagttttcatatactatgattcaatatatagttttatgataaatttgatggttaacatgtagtattataatattgtgattgacatatctacttaacatatccagcagaacttcaatcatcgtttcttaaaagaattactcatctacttttggttcgaatttatgtaatcaaattcaataagtcaaattatagttttgtctgaagtaactcctctcagttctattgtgttggtgctttcatctttaagggtgatgtacatcattgtcaattttctttgcggagaaacttacgattctttataaagtactttaaggtatctaaattttacactaaaaattttgatacctcgaaaaacctatagtatctagagatactaagttttacaataaaagatgattatattaggtcaccgtgcatggaaagccccattgactagttgctctggaaagaatggtactgaaggtgaaagtcactagtacaagaataaggcttcaggatacaaagctgattttttttttcggtgcgcttgcaccaaatcaatattttcctgatggaatttatcattagtgacgggcatgcgagcactgacaagaaaacaggattatctattcttggcgtgacagttatctctgtgtataaaattacatagtagcttttgtttcaaacatggttagatatctacatcgatggtttggttgctcagcctataaatgaattgaagagttgtagattaaggaattttgtgaaatgagtggcatgaatgaactgaagtgcgtgatgcagctagctagccagaccggccgctctctggtgttctctctctagcgcagttgtgagtttgagcttctcctgtcgcttgtgttcctgtttaattttgctattaaaatttgaattgcatttgttcatttggcctcctggtaagtatggaattcatctaattatatcattttcctccatactagctccataaaaactgatcagaaacatgaatcttgtcttctagaatagatttgatcatcagttgacacgtgctatatactccctcgatgtctctgtcccaaaataaatgcgcacttctagttcaaa

SEQ ID NO: 64497 - DNA, 12039 bp, Oryza sativa
attcaaaaacttttgtgaaatatgtaaaactatatatatacataaaagtatatttaacaatgaatcaaatgataggaaaaaaataataattacttaaattcttttgaataagacgaatagtcaaacatattttaaaaagtcaacgtagtcacacaataagagacggagggagtattttctaaccttttaggacaaatctacccctgtcttctccattcaatcgttcatcctttctttcctctgatcctctctactgtcccctttcaacctgtcatcgccgcgtccaccgcagcgtcgcaccccgccgttgcgctacggctcctcggcctcctcgccggacatcgctctccggatgtgaggactgaggcgccgccggatccaacagcagcaagcaagccctgtctacagccttccaatgttgaaatactttattttgctgcaaccctctagcatcctgctccaaccttgtagcgcacaaattacaaatactttgttcttgttgcagccttactgcgtcctggcatcctgcttgtctagggattgttcttgctgtatgccagagctgagaggagagagaaagggaggggaagaaagaagaggatgaggaggaacaagagaaggtaatttggtttggaaatcgaagtgaaagggtaagtagtggtatatcccaaatacttgttaaattataatggtacggatccaattagccctatttttaaacagagggagtatctaatatgtcttgacgcccattctgcaaaattaatatagctatcatgcaagggcaaaagatttcacatgcttgttttgacttgtatttttggtgtaggagcaattaagaaaggcaagtcctcagaaaaaggaaatacctgattattaatttttcatgcaggtaattcttaacaaaattagaatgaatatttgctaggacatttttgaacacctttactattaaagtagtaggtgacacttccatttttgtccagaaaagaatgcttggttcacacttagtatttataactattcagagtttcttgcttttattatctatatgaatataactaagacataaattcggcagagttggttaattggtcatgaagtttaccacaatccggcagtatctgttggtgctgatggctagcagtataatcaaaatcatgtgcagctcattatatgggaacgagacagatcgactctcactacttgagttcaagaaggcaatcagtatggatccacagcaagccctgatgtcctggaatgacagtaattacttttgcagctgggaaggtgtctcctgcagggtgaaaactccacatcgcgttatctctctaaacctcacaaatagaggattaattgggcagatgtctccttctcttggaaacctaacattcctcaaatttctctttctacctgcaaattcatttactggagagatccctcagtcccttggcaatatgcatcacctgcaaattatctacttgagcaacaacacattgcaaggaaagatacctaatcttgcaaactgttccaacctcaaggtgctatggctgaatggaaacaatctggtaggacaaatccctgcagatttgcctcaacgctttcaaagcttgcaactctcaatcaacagtcttactggacccatccctgtttatgttgccaatatcacaacgctgaaaaggtttagttgtctgtataataacatcgatggcaacataccagatgattttgcaaagttacctgtgttagtatacttgcatctgggtgcaaataaattggcaggtcagtttccacaagctatcctgaatctttctactcttgttgaacttacccttgcttccaatcatctgagcggagagttgccgtccaatattggtgactctgtaccaaatctccaaaagttccaattgggcggcaacttcttttatgggcatatcccaaattcattgacaaatgcttccaagttaaatctgatcgatatatcaatcaatagtttcactggggttgtgcctagatccattggcaaacttaccaaactgtcttggttaaatcttgagctgaataaattccatgcacatagccagaaagatctggagtttatgaacagcttagccaactgcactgagctacaaatgttctccatatatggtaatcgctttgaaggcaatgtgccaaattcttttggaaaccattccactcaactgcagtacatacacatgggattaaatcagttctcaggattaattccttctggtatagcaaacattcccaacttgattgctttagaattgggtggtaatctgtttacaactgtgattccagattggcttggaggtctcaaaagcttgcagaccctaagtttatttaacaatttattcactggacccattccaccatctctgtccaatttatctaatttggtagaacttggtctaagcacaaaccagctcgatgggtacataccaccaagcttgggatacctccaagtgcttgaggaatttactatttcccataacaatattaatggttgggtaccaaacgaaatcttcggtattccaacaatatcattaatttggctatcattcaactatttagagggagaacttccttctgaagtaggcaatgccaagcagctcatgtacttgcaccttacatctaataaactgtctggagatattccaagtactttgggtaactgcgaaagtttggtagacatcaagttggaccagaatgtttttactggaaacattcccataacattaggcaacataagtagcctaagagggcttaacttgtctcacaataacttaagtgggacaataccagtgtctcttggtgacctagaacttcttcaacaactagatttgtctttcaaccatcttacaggtcatgtcccaacaaaaggagtgttcaagaatacgactgccatacaaattgatgggaatcaggggctttgtggtggtataccagagttacacctgcttgaatgtcctgtcatgcctttgaattcaaccaagcacaagcattctgttggactgaaagtagtgatcccattagccacaacagtgtcacttgctgtaacaatagtatttgccttgtttttctggagagaaaaacagaagaggaaatctgtatctttgccctcatttgatagcagctttcccaaagtctcttaccacgatcttgctagagcaacagatggattctcggcatctaatttaattggcaggggaagatacggttctgtatataaagcacaactgtttcagggtagaaatgttgttgctgtcaaagtcttcagtctagagacaaagggagcacaaaagagcttcattgcagaatgtaatgctttgagaaatgtgcggcatcgcaatctagttcctatccttactgcgtgctcaactattgattccaggggaaatgatttcaaagccttagtgtataagttcatgacacgtggtgacttgtatgagttactatactcaactggtgatgatgagaacacttcaacttcaaatcatattacactggctcagaggttaagcattatagtggatgtagcagatgcattggagtacctccatcacaataaccaaggaactattgtccattgtgatcttaagcctagcaatattctcttggatgataatatgacagctcatgttggggattttgggcttgcaagattgaaaattgattcaacagcatcaacttctgctgattcaacttcttcaattgcaataaagggcacaattggatacattgctccaggtgccgcccattttcatacagcactatactttttttttccattttcaattgagaattgttcatgcaagtttcattaacatttttttaattgaagtttcattaacatttggaataattcaataaactctccttttctaaatggtctatagagtgtgcatcaggtggtggtcaagtttcaactgttgcagatgtttatagctttgggattattcttcttgaaatatttctacggaagagaccaacagataatatgttcaaggatggtctggacatcgcaaaatatgttgagatgaactctccagatagaacactaaatattgttgatccagaattactagacgacaaacaattgcaagaaattcctgtaaccatgaaggaaaaatgcattgagtgtttagtttcagtgctaaacacaggactttgctgcgttaagatatcccctaatgagcgcatggcaatgcaagaagtggctgcaaggttacatgtcattaaggaggcatatgccaaagcaatctctggtaataatggcattatttgtatcatacggagtactatataaataagtatgcaaacagctgatgcttgaggcttgcattgcagattcgcaggcagttatcagcgacaaaacttagtcgctgacgaagtagaacatccggcacatgaggttgcatgctgtttttttctctcgtatttattgtaaggattctgacgtaatctgatggagaaagcaggcatgcatgcttgcagtagcaaatatgttatgctttttccactgaaagttataaataaatttggctttgtgacattattgaattataattatgagaaactggatatattttgtattgttgccaaaaatgatgacattttcctcccacaatttattctaaaggttgccagtaacttctccagaatgaccacaatataacataatcttccagatcaaacgcatgcaagaaagggtagagatatgatattcttgtaatttctaatgcatttatataagaaaaggatgcagttcttgcagtattatcagacggcatggaacagaacattttcagcagggactctcagggcgtcctgatcctatttaattatgaaatgatgcaagatgcaaggaagaatgtagtgtatacctccaattttgtcctaacttttactgttccatcctctctgccacaaagaattaggcaatagatctgctcagctctgcacagaaaaaaattggggaggggttggatggacgtgaggcagtggctcggcggcaggcaccagcgctggcaagagaggctgggaagcagcggcgccggcgccggtgaagaaggtgggcgaggaggaagaaggagggcggccgactaggctagggagaaagtaagtgcacatccagaaaatcattttgttggtgttataatatatctatactaattatacttagatcatggtgttataatatatggataagcagtttcagtacatgtttttcttctgctgtagatccgcctctgggaggaggagaaagaggtggccatgggaggttagggtagggaggtattagttgccggcgtagcgtagcgctggggtggtacaaggcggcgcggagatctccggcgactggccggcgacaagtttcgccggggaaggggatgcattttgcaggaaggtccttaatatttttgtgaaaaaaatgacacttactaatggtcctgttttgcaaaatagcccctgcctcgttgctggtgggctgacatgtccacatccagcctggcccaaattaactgctgatagggccgggccgatagagtatgagaaacagaattacgagcccattgtcagtgtagttaacgatgaaactgtttggaaatgccatcgctctgcccatcaaccgtgaataattttccgaatcgaaccatcgattttattaattgggtattgtagatctcttggaattcgacggatagatcgatcgagctaggaactcgaaaatattaatgcgtccaaataaacagaaatttcaaagtgctctcgagaaattaaaattatctaaatttcatagtgccatccgttgattcctagtcaaactcatctaaatccgctagccgcggccatggaaacccaaccggagatggcggtacccacggtggccggtaatgctcgagcacatcggcgaactcgaggtcgatcacgaggattcctactccaactcctgcacagccgacgccgtcgccgccaacaccgcggcggtgacctcgctcgctgtcagaccccggatattcagagaaagaaatggaacccagaaatcgcttttgtgtgcgtcgcaaggacctaaactagggttcctacgctagtaatcaccgactctccccattgtgtcacatggtccttttgctctgtgatactgtcaggtcatagacaaacagtatagccagcacagtaacaagaacaagctagcatggtgaactacgagtaacaattttttttcaggaataacacaaccccaaacaccatatcgaaaattattaacttttaagcatgagtcaccagccttcctctcctagtactacacatgacaaacagtaacaaacggaaacaagacgatctctacgcataccctttgcccggcagtggccgccgccccgcgccgcgtccttcctcctcggcctccttgcgcgcctgctcgacgcgctcctcgacctccccctccgtgtacccttgctcctcgagcgcgtccctcagcaggagcagccgcagctccacctgccgcttccggtcgtgctccaggatctccttgctcggcttccgcatcccgccggcgtcgtcgaaccccggggccgggggcggcgccttcgggggcccgcccgccgacgacgaccgcggcttgatgaagaacttgttggtctgcacgtgcccattcgtgcccgacccccgcgcggtctggagaccgatatatgccgttgtacattgcggcggcggccggggaggtggtggtggtggtgggccggcgtaaccctagctagggtttcgatcggtttggttcgtcgcgagatcgcaaggcaatgtttggctaatgggaaatggaaatgatttccaccaacaaaaagacatctttaaatcctacccccatttcccattatccaaacacaccccaaattcgggagggagacgggatgagagagagagagaggaggaggaggaggaggcgagcgtgatcttattcggcggcgcttcgtgggacggagaataataattcaagtcggtttctgccccactcgaattgatgaaattttggattaaagtgtacgcttttcaaactgctaaacggtgtattttatatgaaaacttttgatatgagagttattctaaaatatcagattaatccattttttaagtttgtaataattaaaactcaattaatcacatgctattaccatctcgttttgcatagagcacttaatcatcttcatctatatctcaggagattcaaacaccacctacataggttgcttcgtggcgagatgacgctacatatggggtatttgtcggcggaaagggaaatatacatgttttttcttaaaaaaaactggaaatatacagttcaaccttcgttgtttactctatgctgataaacagacaaaaaaaacgaagaaatcaaaatcaaatttataggtaaaacttttatgttatatatttttaaatgtcaatgtaagaaataaattttaatataaatactcaaaactaacttaaattttgaaaattgtctgcactaataaactaacaagcaaacgatgttttcaatctcaccagtaaaaaggtccacaggtatgcaatagggagggtcgacgatacaaacatgccttgtcctcatcggcttcttctttttttcttttattataccgtaagtttacacatgcacacaccacagtaaacgcaacacactcacgtacccacgaactgtctatgcgtaatattcatggataatactccctccatctctaaatatttgacgccgttaacttttttaaatatgtttgatagttcgtcttattaagaaaaattaattaattaatatttcttttcctatcattttgattaattgttaaatatacttttatgtatacatatagttttacatatttcacaaaaagtttttgaataagacgaacggtcaaatatgtttaaaaaagtcaacgacgttatatatttagagacggagggagtattatttaaatcttattggatgaagttatacaaccatgaattcaacatcacaccactaacgcttctccatgagttttctcaaggtgaaatttgcatgtttatgaatagaccttgatttatttaattttttttcgggggaacagaccttaactgcagctttcaaaacatttaggacctctttgattcaaaggaaaattcatagaaattttagatgatttcaatcctataaaaatttttcctatataaattttggagaaaatttaggggcaattgcatccacacccccactttcgaagccaattgctgttttacccccactttttagggtttgcacttttaccccctttttaatttgaagcagccgtctacccccatttgtgacagccgtttggtgggtcccacgattttgtgttaaaaaatacaaaaggaaatttaaaaaaggttttaggaaatatgatattacgtttatacccctaagggaatggataggaatataggatgagtgagtctcctcccaggctgacaccaccatgcgtcgttttcctggagatcaaaaccctagcgccgactgagaccgggcggcggcgtgcgcgcggcgcggaggctgcggatcgagggcgcgcgagagcggaggcgtcggccgcaggaacattgttcagagaactctcaatcgtgtgtagtggagtactagtgtgtatggtcactgaaatggcacttttaaggaggtgttgctattgccttttgcttcactactcggctccatttatctaaaaatattaagagtaaattgtgtccgcggtacataaacttgttaggtgggtgcaatttagtgtaaaaacttgaaaaactctcgttttggtgcacaaacttgtataggtgcgtgcggactatgactaaatagaatagcaaatctaattttgctgagttggatgatgagtagaccgccaactaagcattcacgtaagaaggacaggttgcctgctcgtaagcaatggcccgttttatcagaaaaccccttctattgtttggtatttcgatcatgtataatttttcagtgaaacgaatctgagaggtgttcatagcggcggggagctggggaggtcgaatccgcggtggctgtagtgatgggggtcgagcccgatagctacgccgtggggggagtcgagtccgacggtggctacaacgggtaggtcaagtttgacggcagtggctgcaacagtattgccgagactgacgatagtgatagatggcgaggaggtcaagtttagtgggagagcttagaagttgatgctgcggtaggcatttgagtggcttgctttaggccaacatcggttatctcagactctgacaattcatatagcaactttgaagcctagctccaatgcttcagtgcagacattgaagcagcaaggaattaagccattgtgccgtcagattaacagcatgaacattaaatccactgaagcaacaaggatataatgcttaattgtacacattgtgacaaaatctgaacacaatgaaacacgtgagtgcatattttgaacagaaactgagatcctgaataaaattcagtgaataacctgaatgaaaactaaatgcataacttgacatgaatttgattgtgcactagtaatgtagctcaaaatcgataacatggaaccaactttatgaatgcatagtataaactactgtttctttttcttgggagagtttttcttcttgggtgctgcacttctcttcctcaatgtggccctgccttgtttggttgatgtggttagtggtagttgaaccccttctctcctattagtagcaatgaaagcagactctggcactgctcctggattcaccctttcttgatggttgctagcagcctgtaaaagattatgtactaattttatgatggttgctattagctgacaaaatgctagcttaatgaaggattgttttttctttgagaacttaatgaaggattgtcacctccttaataaaagcttccaccacagatgaactcagatagttagaattttgctggggtatgctaagcaggtgcatttcctgaaacaaatatatgttctgtttaaaattccttgttagtgtagctaaacatatacacaagcaaaatgagcatcaatagtacctgagtgatgacaggttcctgaaacaaatatacaatgagtttaaaattcatagttagtggagataaacaaatacacaagcaaaataagtataaatattacccgagtgatgacaagctcttctgaatcaacaattgatgaagtcgccatttgctgcataggttgcttctgaagttttaagtcagccttcctctgtttacaactagttttgttgtgaccaccatttttgcagtagctacaatgcatctctactccatgctttgaaattttagtcccaccctctagttcttggggctgttttctcctagttttctttggcctccccactttcttctcatatactggtggcttcacctctatacccggcatcttctcccagtggatactatctctcaggggcattatgtgggacctataagcttgttcatagcacctggttgaatagcaaaatgacactacatcctgtggcttgattctttcatgtcttagacaggaaatggcatggttacaaggaatcccagtgagctgccacctcctgcaatcacatctctttacattaagttcaacaatgtattgagatcctctgtcgctaacctgaaatgctcccatcccagcaggcaaaacatagcatgtattagctatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctaagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgtaatagcccaaagttggttctttagtgtctccctttatgtaacacttgaaaattttaatatagatgcctcacacagaatctttgttcagcatgagaaaactcccttctcacagctggaacaagcccctggaaacgaattataaagaattatagttaggaactaaaatgtaagttatgtatattatgaaaaatcagacgaagtcataccttctgcctatcagtcatcactgtccatgcagatgtattctcaatgccaaggtctttttttagagtgtcaagaaaccaactccagcttttcaagctctcaactacaactactgcaattgcaatgggaaaaatgcagtcatttgggtccataccaacagcagttaggatatggccaccaaattttgttttaatatggcatccatcaagacaaatgataggtctacacccagacataaaccctctcttgcaagcatcgaatgacatatacaaagtatggaagcaaccaaaatgtaggttcaggtagaatgagctccctaggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcggtgtcattttgtcattatctctaaattcctcaatgtacctttttgcaagatacttagctgtgacggccttgatctcccactgtttagagcaggtgtgcttctctatatattcccttaccactaagcatttgactctattatccatagatgcagacaacatccatggacaaccttcagcacacttagcttcaattcttgttttggtattccgtgtcttcttaatagcaactcggttctttatagtatattgatcta

SEQ ID NO: 64498 - DNA, 5953 bp, Oryza sativa
  unsure (1)..(5953): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgtggggattgtttagttggtcaattcaattcctaatcacagtcaaaccgtgtgagcacattgataagcttttgaccaaacaagtagtggttttcatagcactactagtacttattttgaattcatgtcgacaatttacaatttacccagatgtgcaaatctagcaatgatggaaaaagtgtaatcaacagaattttttttttacctactcttccttgtcagtcatgtacagaaggatacaaaatatgacacagaacaataatcgagggtgtaacgagcaccactatttctcactaattcctgaacagctaaaagaaaatgtaagctcaacagatatcataactatgcatgccaactcagaaactgtctgtttcttgaaatatacctctaggacagggaatcaacaggagacagagtcaagaacacacccatctttttctgtgacattgttatcttttattcctttttgcacatggaagaacagtctgatggatgaaataaacttttttttccagctagaaagaaacttcacaagaaatatcttgcatcgctgttctcaaaatagcataaacaggagccaacttttaacatggtcaagatggcatcgctgttttaaaatagcataaacaggagccaacttttaacatggtcaagatggtgaccagagagaaaaggtgagtgctactgctacacatgttagtagcacttagcaccatctgccacgcacgtctacagctaacctgaagcactccgcgtgggctaattaaactgagcagcatctaatctagtcttgtgacccgttcaacacggtcatctagtcttcaaaaaacttgatcaattttatgctgtcaaatataatgaaagggaaaaaaaaactccatccacacacacaaccaatgatcccaggtttcatctcctgaactttgaaaccgttcgagttgcctactccatctgttctataaaaaataaccatgttgacatatcgttcgagttgcctactccatctgttctataaaaaataaccatgttgacatatcatagtattacgaatctggacatgtctctgtctagatatctagtactaattggctttttatggaaccgagtgagtaccttaaagatatatttgtgtctagcttgcataggctgtgtttagttcacgtcaaaatttgaagtttagttgaaattggaacgatgtgatggaaaagttagaagtttaagtgtgtaagaaagttttgatgtgatggaaaagttgaaagtttgaagaaaaagtttggaactaaacacgaccatagttccacgaatgtaactcaaacaattaaaaaaattaggccccccttaaatcgtaggaatgagaaaaacgggcaaaacaaaggattacaaaaacatatgaatgaccggaaaggaaattttctatgaggttagagctcttgctaattttcctccaaatttttataggattgttcattccatagaaattttaaaagatatgataggattcaatcttttgtttcaaagatcttcctaagattttttttcctataggattaaaatcttccaaaatttctatgtttttcctataaatcaaaggagcagtgaacttagaccattggcatagttgagggataaaatacaaggtttttttaaagaaaaattgaagtgtagatagattctctcttctatgaagtcaacgttacgaatcaagttcagttgacgtggtacacataaacatctcattagctcagaaaaaaaatggagtttaaattattgccctaaacaatatactcctatcctaccaaaatatagcaacctaattgattatacaacacctaacaacacaaattttagccatattcattaactccgggacaggggcaacgctacagtcgaatcattggggttagtcgaccctgacgattttgtgaacatctcgtagttatttttagtttgtatcagggttcacctcttcgacttagtattggattccgaaccattgtggtatgacttttcttttccaaaatttgataaattttggtcaaattttactgtttcaaatttgaattctcaaaatgaaacttaatttggaatctacttttgtcccatatcaaaacatcgaaattgtgtggtttccaacatgttttggttgaaaacataaactttagttagtactgaccccggatagtgctccatggaaaggtaactttttacaggacagtgctgaacccacggctgatatatatactccatttgtccataaaaaataatctagtaccggatgtaatatattctagtaccacgtctgaacaaaagcctatctaaatttgtagtattatgatgtatcacattcggtactagattgatttttatgggcgggagggagtattttattgcatgtaaacattcctgagcagtagagtaagattctgttcccagcaaagagagcttggtcactattctattgctgtccagtttagctatctgctcagaatctacagactgataatatataagaatccagagttcttgagtagtaatgagtaagtacatctgaacctcaccagccggctcatcatcatatccatgtgagccattgcaggttttccatcctgagcgctgctttggaaccaaattttatcagctaataggatgggatcaacttgcagataagatgcctctgaccatatcaccaccaccaccactagtgtgaaatggagactttaaacagccattccatgttccaactttcacaggtcatactagtttctttcagactttcattaggcatggaaatcataccaacagaaatgtagccaccgccctcaaaatccacctcacaagtccagcggtgttactctaatcacataccaagaagaagaagaaatccaatatctatatacaaaggcacacaaggcctaactgagcccaatggcatcgtgccatcgtcagttcaccacgaggccattggagccaatggccgattctcgacgaagttcgtcgcctgcccatagtgagaattgtgcagcaggatcagcttcaggcccttggcgggctccatgggccttgggatcctcctcctggctccatggtggctgttgtagtagttctcctccagggtagtctcgtccaggcacgaccaggctgaacctctcggcgcgctggccgcccacatgaacctgctggagcacgggttcaccagggtctccctgaattcctttgctccctcgcaagggaatcccttcaataagacagaaacacaatgaactcaattttaaatgggtggagtatggtttatactctggttcagtggctctaatttgcatgaactgcaaggaccgagtcaagttaaggagtttaaggttacctctgccatagctttgatcttaagcgtgacgctgttggacaggatgacgatgttctggtttccttttagtttgttgaaaaggagggcgcagtcaagaacgcgatcttctgttttcggggagacgatatctgagaagcttctcggggagaacaaggctatcggattgaaggtgccggcagagatttctctttctccattgttgcatagcgctgtaggggttgcaggtggagttggtgctactggcagcatctcggttgaactctgaacatggatccaccagctctccttttccatgcactcattgatccattggagcatggaggtggcctttgataacattctgaacaatctctcccgctttttcaagcactcaagctccctgatcactgacaaaagggtaaacaagctttcagctaacaaacaagaagcatagcatggaagatgcagtcggttcagttaaaaacaagggtatggattacaagtgacaactgcactaaactcaataaagcatattgcactgtgagcgacaaacatagtgagaaatgcaatgcaatggaccactttatacataggtgagcgtgcgcatgctaaacagcacaagaaccaaacatacaaggttaattgcatctatttagtactatctccatcccaaaatataagggcttttggcaatataaatgcatagccaaaagcccttatattttggggcagaggttgtaagagaatagcaagacagttaaagctacagaagcaacttgtcattcactcaacatcacaaaatccatggattacaggtagtaaaatctagcatggcatatttgttagaactaagcagcacgacagaatgacagatcatgaattcagatataaacagtacataaaaagaatatacgctggaagatattgcaggcaaccaagttaaagcattggttaaatgtctagtagaccgaaaggtaggtggacgggtgaaaaatttactatgataaagctcttaacttaccaatcattggtatgaccaattgagttccttttaagcctcttagcagcatgatggacttcctagattcatcatcaagaagacattccatatcagttaccatggtccagactttcattccttctttggtcttttcagactcttgtcctttgtgctgttcagcaacaaaaattaacttagttcagattccttatcagaagaaaaaaagggaaaaaatatgtaaaaaatggaatattattgacaagaacttactggaacattattcagttcaccctccaacttcattgccacatcaactgctctaggattaacctgggtactatcaagtgaactagtgtgtcttaagggagaattcgacaagagtgtctggaaggggagcctatcaaccacccttttctttgtgatagtactttccattcgtgcacggttttcagacaaatcctttgttttccgagaagcagaagatactggcgtcaagttctctttgtcagagtagaaggcctcttgatcttggtcagcatccactgtgaggctctttggaagacatctccttgctttaatgcctcctgaagatataggtgtcaaattttccttatcagaatagaaaacatcatcatctactgcgtgacaaactttggactttgctgataattcattgggttcttgtctatggatcctcctttttgaagtgcattctacagacagcgaattatccacccttggtccaagaaccttcctaccaatgatgggcttcagatccctggaggctggtgtcacattctctttgtctgggaacaggtttccttgtctcacaggggatatagtatcatacttttcaggagaaagcactgaggtttcctcgtctgtaaggatgctatctttgaaatctagatgtgcaattgtcataaaccctgcatggctcttctgcatatttgcatcaactgaagttagcgggataagattcttggcgataagttcatttgaattcatctgttctccaatgctcaatatggaactttcatcatctgaaaagtcgttatgttccaaattaagaggggaaatggaatccatcaattcttgggaaatggtagtgggcttcaaccttagctgacttctctccactattatatctcctgagacaaagggggtgatgttctccttgtcccatggactgttctcttcattttcttcatttcctttcatgttcgaaatttcaaatagattctcactgattgtgccttcactctcagagtcctcaggagccacaaaaatcttactttgagcaaaattctcattgcttgtgagagttgcatccaagttaagaagggttaaaccttcatgccctgtgtctttgttgctgtttgtattttcatcagatatgtcttgcatgaatggattttctaagatgggcccagacaactccttatgtacagaagcacaaagctgtaggattttgctgtcagtgaagtcatcgcctttgaaaaccag

SEQ ID NO: 64499 - DNA, 1519 bp, Oryza sativa
cggatcctcctcctccccaccccgcccccgcgccgcctcctccacaggcagcggcgacgggggcgcgttgaggaagatgttcttcagcacgactccccccttggacaccgcgaacgccgcgatcggggcctcctccccctccgccgccgccgacgccatgctgcaggcagggctagcgatctgcgcgtgcgccgcgatcggagacgaggcggcggcgcgactcgctgggtttgaagcgttgggattttttgggggatacgaaatctgtggagactagtagtagtagaggcgggggatctcgcgatcgaggagacgttggaggaggggagaggaggcgccgggtgggttcggatttggaagcttcggaaatgcaacggctagaaattttattctagaaaaagatagagataaggacaaacgtgcgcgttccgttgggccgggcctgtaagatgtttggcccaatcagcattggctcatacgaggcctagcccatttatagggttgggattatttttgttggtaataagtttaggtatcttaatttgttgccgagtctaaatttcgtccctgaaccacaatactagatagataggatgcgtcactcaactcccataaccagttgaaataaggtccttatgcggtttgcacaatgattttggttgacgtgacttatttgattaggtcttcgttccacgtgggattgacgtgacgcttatgtggtaattcaatccggaaaaataataaaatcatggggcccacatgccaattacaccacaaaacaataaaaaatggtgggggtccacgtggaccctattgtcatcctctcaccttccctcttctctctcctctctcttccacattataatttttaaatattataatataattacaatgcaagtgtatgtaatttacatttgactattttttaaaagaaaaaattgtggcaccataaatataagcagtcccttctcttttttctttcctttttcctcttccaaatttctctcatcataaatatttttattttaaaattatcatcgtttaaggtgtatatgctgtgagattgttacttcgcaaatgcttttcatctatagttaaaaaattttactaattaaataaccaaaatttaatctttggttgatgaggtatagcaaaatgttttaacttatggaatagatactagatcaatacttcaacacttcccatcagccgacgaggatgcctgacgatgaacccaagtgtctgtgtcaccgacgcggcgccacgttgaagttcatcgacatcggcaacacctgcgacaccacccagggttggaaattttggaccaaaatttcggtcatttcggtcccctccgatacgatattacttcggccgaaatttttaaatttttaaattttttcatgaattttggtaatatttgttcaaattcaactaaattttgttcacaatttcagaaatttcggtgacctccgatcaaagtgaaccctgacaccaccctctgcgaccattccagtggcgg

SEQ ID NO: 64500 - DNA, 9153 bp, Oryza sativa
ttcctgcagccgactatgtcttgatgatctgcatacaaaacaaatgatcggaccctaggtacaagagcgaccatactattagtgtctgcatcacacttaaccctcctcaacccatcatttaattgtttgccaggaagcaaccagtaaattttggtgttatcagatttctcatatcctagttcttcaatgaaatcatcaacccacaacagtgaccaagaatctgactcacaatggtcaaaccagcttactctaccatcaacataagcccggtttacactatctcctgatttatctccttttgttgctaactcaattggcagtaggctatcgtgaaactgatctctagcatgggcatcatcgtgggctacaacacaaaagaagattcggaggaatcggaagatgtatgaggggttatttacaaatatgtgtagccaactcacgcccccataacgtgtgtatgcgccaatgtggcatcctaatcacgagccaactcaataagattggtgatgaagtcatgtcttggccttggttcgcacgcactacgcaagtttgtgtaccgaaacgagagtttttcaagtttttacactaaattgcacccaccttacaagtttgtgtaccgcgggcgcaatttactcaaatattaactaaagtccctttttctaatcatggctttcatgagccttaaacccaagtttttacagacaagtgacaggtcgatgaatcaggtcactgtaagagcctgtcaatacattgtgcagagcgtgcagcatcagtgcaccttcagccgtggcttatttctatgggacactatgtcaaaattttgtcgaaatgctgtcgtaatttttattcaaaattttggtcaaatttttgtatctgcctagtatttgtgatttttatttgttaaaatataaaaacatcacaagagatgctcacatttgaattatttataacactcacaaagctgaaaaaatgggggcaaaatcacacaaagctgaaaaaatgagggcaaaactacaataaccaacaagggtatatatgtcattttctctataactaacaccgttagttgtggctgttacaaatgggggtccatggctgcttcaaattcaaaaagtggggtaaaacaaagtgggggtatggatgcaatagccccgaaaatttaacacgaggtatgaacgtcatgaaaaaaaatcctttggatctttatatctccttgaatttctgcgtttttcccatggcttaatcaaacgggcattcatatgttgttcttatgtttttcttgtattttgcaattctttattttacacttgcattcctatcataatcatatgtgttttctaattgtccgtttttgttcatctatgtgattcaaggaggcccttaaattaatccaacaagcagtatgctactccctccatttctaaatattcgacgttgttgacttttttaaatatgtttgaccgttggtcttattcaaaaattttaagtaattattaattcttttcctatcatttgattcatggttaaatatatttatatgtatacatatagttttatatatttcgcaaaagttattgaataagacgaacggtaaaatatgtgctaaaaagtcaacggtgccaaatatttaaaaacggagagactagtatcggctgtgtttagttccaaccaaagtttggaatttggttgaaattgaagacgatgtgactgaaaagttatgtgtgtatgaaaggtttgatgtgatagaaagttagaagtttggaaaaaaactttggaactaaacacacccatggatcaggatcagtatagagacagatacatgcaatcgatccaacactcccctgtacgaggacaaagcttaggtgcaacaggttacttcccgcggtggccaaattcacacgagcagacagaaaaaccgccacgtacgcttgccaagtcacgggacgatgcttacctccacgctcatcgtcacccaccgtgaatgccttgctgctcgatctctgcacctgcgtttgctgccgccgacaagcaagccacggccacgagcagccatggattcctcctcgatcgcatcggtgaccatgtcctcacgccattgcaagcactctgcactgcaacaacctataaagactcagccgccattgacgccaccgttgcaatctccatgaccagcagcagatcaagaaaatggcggcggcgacggcgagagcgagacggcctcatgtcctctgctttctcctcctcgtgatggtcatgccatgcgcgatctcggccgctgatctggcgtcggacggccgtgggaggttgtatcaggtggccatggaccaggccgcgcgcgccctcgccgaggcccgggcggcgcgccgggacgacccgcgcgacggcgtggcgcggcggggcgccgcccaggcttgggccgactgcgaccagctcgtggcgttcgccgtcgggcacctgaaccggacggtcgccgcggcggcgaggggggttgacggcgacgacgtggcggcgtggctcagcgccgcgcgcacaaccgtgggcacgtgcctcgacgggttcggcgagctcggcgcgtcccccgggccggagttcgccgccgcgctggcgaacgtgtcgaggctggtgaccgacgcgctcgcggccaccgcgctccggcgcgggacggagaatggcgcgcgcgctgcaacaaactcaggcgatggcgacggccggatgctcccgctcgacatggcgaggccgggagacgccgacgtggtcgtggcgaaggacgggacgggccatttctgcaccgtcggcgaggctctcaaggcggcggcgaggcgggcgacgaacggtggcgggaggaccgtggtgtacgtcaaggcgggcgtgtacaacgagaacgtcgaggtgtggaccaccaacttgatgctcgtcggcgacggcattggccggacggtgatcaccggaagccgcagcgtccggggaggctacaccaccttcagctccgccacattcggtacgccacgttcatctctctctctccttgcgagctgtgagtgtgagtgtgtgacactgacatggatggatgtccatgaagccgtgaacgccgacggcttcgtggcgtgcggcgtcacgttcaggaacgcggcgggcgccgggtccgggcaggcggtggcgctccgcgccagcggcgaccgcgtcgcgttctaccggtgcagtttcgagggacaccaggacacgctgtacgcgcacacgctccgccagttctaccgcgagtgcgccgtcgccggcaccgtcgacttcgtgttcggcaacgcgcggcggtgctccagcgctgcagcatccgcgtccgccgcccgccgctcccggggcagcccgccgtggtcaccgcgcagggccgcgtcgaccggtacgagcgcaccgggttcgccatccacggcggccgcgtcaccgccgcggccaggttcggcgcccccggcgcggcggcgtcggcgccgttcgaggcgtacctggggcggccatggaaggagttctcccgggtggtgtacatggaggcgtacatggacgccacggtgggcgcggcggggtggctggcgtgggacggcacggcgttcgcgcagagcacggcgttctacggcgagtaccggaactccggccccgggtccggcacggaggggagggtgaggtggggtgggtaccatgtcatcaccgatcccggcgtcgcggcggagttcaccgccggcgagatggtgaacgccggcgagtggctgggctccaccggtgtccctttcactcctggactctagctctgtatgtatattggcattttgtgctagggactggtgattttgtgtatacagggactagattgaggtccccatcatttgtaaaatcagccgcggataaaatttaaattttaaatttaaagttgattttttatagaagtttattttccagcattgacttttaaatcactaataactaataacgtatatataaaagtttaatttataagttatactgttatttactaatataccgtatactatgtattatcccatttatccgtatatgtccaactgatgaggaactaaaactactgacggtatcctatcttattataaagttataacccactaactctaacactcaacatgcaaatatgccatctcatcatccactaacaataattacatgcaaaactaatacaaacatgcaacatcatctataattcattgaatttacaagtcaacatctaatcatcctccttcacattatttttcagaatatttttaacatgtatatatccaacatttttataatccttaacatatattcatgcatataatcaaagtgcgggatatcatgtatatttcatttacaatctcatacagagtctattaaatgtatttatcttagaacatagtttgacaaactatttttatttgttgttagtaactaatataatttttatttttatctcgattattaaaaaaatttaaaagtcacttaggaatttccgtagaaaagcgcggggaatcacctagttatctcatagctgttccaaagattgaaagtatattgtaagatacacgacgctagcaaaaatagcggcccagaacatggaccggcttgtaaacatactggaccaatatgcaaaggaaaaagttcacctgccatcccttacaccgagtttgttagacatcccttatcctcaatatcagaaaccggcgatggtcggcgctgctccaggtattatccgggacacgatggagcgacatggacggtggcggcggccggagatggcgccgctgcaaacccacgccgccgacacgagccacagcgacagcgacaggagaagaagaacggcgtgccggcgctggggcaggaggagcaggaggcgtgcacaccgcgtgtgccaactccctcttcgctgcaggagctcaccaacgacgccttcagcggcgacgaaagaaaaaggaataagaggatgagaaaaataacaagagagtatgggagattgacaagtggacccatgggcaaacttgtctttaaccaatatttctctctccgttttatagaaaataataaattaatcccgcgggtgtccagcaactaattaccacatttttacagtgtccacgagtagatttactttatttaggtgtctcacaacaaaggtcacaaattttgagttttctatagcaaattttgcctaaactttatagtatttgctctaagtacggtccaaatcctgtagttctacagtatttgtaaagaaattcaaatgcaaggaagaaaacagttaaacagttgaaggttgtatttgcaatttttgtagatgaaaggggaaacgctagtctgtgtgacacgtcactctcgttccggctcggccagtcgccgacggccaacctcgcctcccagtcgctcaccgccgctcgcttcccggcggctcaggcgggcgcggcgatttcgctttactccatataacgccgctgcgggccggcggccgcgggcgtcggccatgtccccgcatggggctatgggcgtagcggcggctgggacgccgctgaaggcggaggagatggccggcgggtgtactggatggatctccgtcggcccgtcggcgacaggatggaacggcgaggtgaggtccaaccgcccaaattttctcttctttttttactttgtcttcaaatctatattgagagcacttactgtttctgcgatttgcattcagtgtccatcttggagctacccttagaaattttgggataagttgcttgattcatgaggttatgcgatttacaagagcatataatgcagttgttttctgttgtgcatctgcatcctagtctaaattaatataattgacatggtttgcctttttcttttttgaaagaaaaagaaggataatagaattcagaatagacatttgtgtgcactgtgcagaatttggcagcaaattgttcagctggaatcaattattgcaaatgggggtcattcagccgcaaagccgacttgtttgaatggccagatgcagcgaaagtctctgacagagacaaagaacatgcaagcaatgaagtccaccgagaaccaaggactgtagtagaagtagcaaagtctctgaagaagaaaatgttagaacttagtccatgaatcacggaagacaagttgagtttgctaaccgagcatcagatgattggcacgcctataaatcagagaatacggtgcagtagcatacagtctgtcagagctttgctactagatgacttcaaaatcaggctgccgatctgtaagcatttccttgtttagttcattcctttccattgttcagaattgagatatcttttcattaaagaagataagtattgaaaactataaacttataaagatggcactaagccaagaatccagtttagaattggttccctgacagtggcttgtcactctagtatatatttgatcagaaaccgcttgtgttttggaattgattagaccaggaaaatagctgctaattctatgcgttgtctgataaatgatccatctgtgctaaaactgtagggatcagaagcgaacttgaagtgaactgagtggcagctacatcagtccagattcaagacagagttccattccttctgtctggccacatgatccagatctacatttgaacatagctagtcaataatgatggttattacaactggaaagattatcttgattttcttagcttgcactgcacatgtcgtcacctgcagttccttatatggaaacgagacagatcgagtggcactgcttgaattcaagcaggcagtctgtcttgatccaaacaaaccttgatgtcctggaatgacagcatccacttttgcaattgggaaggcatcttgtgcagcttgaggattccatatcgtgtcacttctcttaatcttacaaatcgaggtttagtagggcaaatctctccttcacttggaaacctcacatttctatcaattctatcccttacagagaattcattcagtggacaaatccctgcatcccttggccacttgaaccacctccaaactctctggttgagtaacaacactctgcaaggagttataccagattttacaaattgttccagtatgaaggctctacggctgaatggcaataatctagttggaaaatttccgcagctgcctcatcgccttcaaagtctgcaactttcatacaatcatcttagtggaaccattcctgcttctcttgctaatatcacaaggctaaatgtgcttacctgcacatataataacatccagggcgatatcccacatgagatcggaaagttatccagcctgcaattcttgtatgtaggtgcaaataagttggttggcaggtttccacaagccatcttaaacctttctactcttattggtcttagccttgggtttaataatctaactggagaggcaccatccaatcttggtaattgtctacccaaccttcagctacttgaattagaagacaactgctttcaagggcaaatcccctcttcgttgataaatgcttccaagctatatcgtcttgagctagcaagcaataacttcaccggtgtggtgcctagatccattggcaaactaaccaagctatcttggttaaatcttcagtccaataaacttcaagctcgtaacaagcaagattgggagtttcttgacagcttagccaactgcactgagctgaaagctttctcgatagctagtaatcatctagaaggacatgtgccaacttcattaggtaacctttctgttcagcttgtacaattgtttttgagtggaaatcaattatcaggtggttttccttctggcatagcaaaccttccaaacctgatttatattggactggacaacaaccagtttactggtgcagtcccaaaatggcttggaactctcagtaatttacaacagatattgttacatgagaacatgtttactgggtttattccaacatccctttcaaatttatctgtactgggatctctctggctagactataacaaaattggaggacctttaccagcaagcttgggaaacctgcaaacgcttgaaacattgagcatttcaaacaacaaactccatggtagtgtaccaatggagatcttcagaatcccaacaatacggttaattgatttgtctttcaacaactttgatgggcagcttagtgccagggtaggaaatgctaagcaactcatgtatttatatctttcatccaacaatttatctggagatattcctagttcactgggcaattgtgaaagtttggaaggcatcaaattgggctcgaatattcttagtggaagcattcctacttcattaggcaacataagaagtctgaaagttctcaacttgtctcacaataacttaagtggatcaatacatgctaatcttggaaagttatggctccttgaacaagtagatttgtcatttaacaatctcagcggtgagataccaacagaaggaatattcttgaatgcaactgcagtgcacatcaatggaaatgagggtctttgtggcggggcactcaatttacacctacccacatgttatgtcatgcctttgaattcatctaggagtgaacgatctattttgctgtatttggtgatattatttgctagcctggtgtcagttatattcatatatctattattgctctggaggggaaaacagaagaaaaaatgtacatctttgaccccatttgatagcaaatttcccaaagtttcttacaatgatctcgccaaggcaactgaagggttttcagcatctaatataattggaagaggaatatacagtcatgtttacaaaggggaattgttccaaggcagagatgtggttgctgttaaagttttcagcctggagacagaaggagcagaacatagttttatcacggaatgcaatgctttgagaaaagtgcggcatcgcaatctagttcctatcttaactgtgtgctcaagtctggatactaagggaaatgatttcagagccctggtgtataagttaattccacaaggagacttgtattctctactgcactcaactagagatagtgagaatggtttcacttcgaacatcattacattttctcaaaggctaagcattgttgtggacatagcagatgcattggaatatcttcaccataaca

SEQ ID NO: 64501 - DNA, 848 bp, Oryza sativa
aggaatctccagttgccatgaaggaaatcttttctgagggtttacattcagtgctaaacattggactttgctgcaccaagcagtccccgtacgagcgcatggacatgcgagaagtggctgcaaagctacatggaacaaggaggcatatctctgaggcaactaggtaatataatgtaagatatgtaccctgcctatagctgtgagatactctgctaccttctcgcatggcatgtttaatattgtcactctctcttatataatgaaatcacaactcttgttattgctgtaataatccgacactacatttggtttggaatcttacacaattacactgcagatacatggtattgttggaaactctgcactgttatcatattcttttcttttagagtaattgataccaatattcagccctcatgctttttgctgttgatggagataaggactggtcagctttatattcacagaacattgaaaattttcttgttagttccttaatttgtcaacaatggaactttcttctcagctactagctgatttgggtgatgactgccatctgcgttgaattttgtactcagctgttttttttcccctgtgaatggactgggaaattgggtctctcgaacgaaaccttatttggtttgatgttgtgtttcataatcaatttgattatatttaatggatcgaattatatataacacatgtcacatgtggtacttttctgggttacaacttacaatgctttgagattgctcatggcataaaagaaaaatacaagggcctgcttggaagccagctggtatttgacccgaaactggtactccctccatccctaaatgtttgacgcc

SEQ ID NO: 64502 - DNA, 908 bp, Oryza sativa
tcactgcttgagttcaagaaggcaatcactcttgatccccagcaagtcctgatttcttggaatgacagcaatcacttttgcagctgggaaggagtcttgtgcagaaagaagacaaccaatcgtgtcatttctcttaaccttacgaaccaacgtttagtaggagtaatctccccttctcttggaaacctaacattcctaaaatttctgtacttagacacaaattcattcaccggagagatccctctgtcccttggccacctgcatcatctccaaaacctctacttgagcaacaacacattacaaggaaaaatacctgattttacaaacagttccaacctcaaggtgctactcctcaatggcaatcacctcattggacaattcaataataatttcccccctcatcttcaagggctggacctttcattcaataatcttactggaaccatcccctcttctcttgccaatatcacggagctattgggtgttggtttcatgtcaaacaatatcaagggaaacatcccaaatgatttctcaaagttcgtctcgattgggtatcttgctgcgagtcaaaacatgttgtcaggaaggtttccacaagccatcttaaatctctctactcttgatgttctttaccttggttttaatcatctaagtggagatttaccatcaaatcttcttgactcgctacccagcatagaaatactttcattgggagggaacttcttccaagggcatatcccctgctctgtggtaaactcttccaacctaggtttactagacatttcatctaataattttactgggcttgtaccaagttccattggaaaacctaccaaactgtatcacctaaatcttcagtccaatcaacttcaagcacacagaaagcaggattgggactttatgaatgg

SEQ ID NO: 64503 - DNA, 8661 bp, Oryza sativa
  unsure (1)..(8661): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcaacaactcaacaattatataatataaacagataagatgtggaggagctaatgattggctgactgttgcatgaaaggaaatatatgaaattcgtggtaaccatatttatacaagtcattaacaaatatcataatctcttttcaacaaaaaaagcaaaaggaaagagataaagtaaagcacccaaatgcattgatgtaactgaacataagttgtttggcaaatgataaaactgttgactggttttggttgatctgtgtgctattagtcattttggagctctaatcacaaatattagtgccatctaactaataatattattaatataatatttattgcaaaagacgctagggcccaattgttaagtggttattcggcttatgccacttgatgcagttttttttttctaaacttaattataatttggtggtgtactatgaaataaataaacccattcccctaaaagttttgcaagctctagtgttgactttaaacctttattaaatgtgatatttttctcattgctcaatgatcagcttgttagctatttgctgattcctttcgtattttcctccttttgttttgttcaccatgttgcaagttggactctgtatttgagaagaacagtttgactttctccttcagaaaaaaaaaagcttttgactttgttaattattattggcaaatcagaatgctatagaaaacattgtacaacagaaattattactgatcactcatgtatcagtagagatatgtaggcagttggtcaaagagccagtgttcatagaagaatcttccaaaaaaatgaaaacaaaaacagagtcgttgcattctctgtcaagtgtcaaccagttctaggtttgatttggggaaggaaatgcaggaactgcacattgacccttgaccaaagatttcattcctatcgcgatattcagatcttattctctgatcatccacttgacataatttgataaattggtcaaataactctgattcgttcattcgtttttgttaatccatgtagaaaaaaaatgtagcatcaagaaatgccattttgactgtctaactgtagtaggattaagtcaaagttatcatttacctgaccaattttactatttcatataaatatttgttcatgttgaccttctgaatcttatataatattctgaaccgatgattgctgagtcttctggtctccatactatccagagagatcaccactgcattctacgaaagagtttgacaatgttcaagtgaactctaaaatatgtgttaaatcaagcttatccttgtaaaaatgtgcatatgcattcagaatgtgaagttgactttgaacaagaagatgatgggcttgacctttgacatgcaagcactgccctaactaatacccagttcccaatcatgcacgagagtgtctccatgaccaagaaacaagacttgggaatatgatgtcaaagaagcaaccagaactgatgcagatgccaacttgtatccacagacagatacagcatagagccacacattgcacaagaggaatgactggctgactgccactagttttccaggccaaatgttgcatgtatcacctgtcatgttgattggccaggagttttctgaatgaaatagagaaagtaagaaaataaaaattataaatacagacaatttataagtttttatagggaatgcgcaaaaggattgcgcgaattttttttttgacacaaaattgcgcgaattataagttttcatgtaaagaaaaattagtattgcgcgccaccgagttttactcatacccacaacatgtcactcaaagtatgcggtctcgaattaagaacaaggacagtgtagagcatagtcatagactattgaagtgcgcggcaagtgagattctcaatagcaaagctcagtgaagaccttgaaaaagttgatatattatgataaagactgccaaatattcccctttcacaagattccttattttgtttttccccctttttctttgcaaggtctcaacgatttaattatttcagctcatgatttctatgttacaaggagaggctattacatcaatcccccaattaacatccaagtcaatactttttagtttttactcctactgttacacacccaaaatcagaggagaaaccaaaaagaaaaaaaaaactcaaaactcataagttacactctcgcgcgcaattcatcaatctcctcatatcacaaagaaacacagcaaaaacaaaaaggagtcaaccagttaccagtatatgaacaatcttgctttgcattgcaattggcaggtcatcgagatgttgaccgcagaagcagcagccttcatcgtttgatccgactgacgagctctgaatttgatcggcaatggcgattggcagcagcctgaatgtcttgagagtggcatggtgctctgcgtttttgtgtttggtcatgtatgtgtatgtaagtaggttggtgcctgcgcttctcagattgcagcggccgccgccatggcggcggccgcggaggcgaagacggagatgttgcctgaagtggccttgccggcggcgaagaggggaggtttgccggcggcgatgctgctgcgttcttggtcctcgaagaggaatgaccggacggcgtcgatgcacggcgcggcgacgagccgctgccacgcgtcgtcggcggcgtggccgcgcctcctgaacacctccgtggcgtcgacgcggcgggcgcgccacatgcggtccagcctctcgatcttgcggtgctggcggcacgcgagccggaacgtgttcaacttgatctccgcgacggccgcggcgagcatgcgcgcccgctcctcctcgtcggcgccgtcgccgcgggagcggaggtacgcgtcgagctccggcacgccgatggcgcgccagatgcccctggagtagtggtgcggcgcgggtcgaacgctgcggccacctcccggacgaggcctcgccggcacatctcgtcgacgcggcgggcgacgaaaccgcggagcacctcgagatctacgtcgacccagaggaagcagcactcgtaccgctcccggaacgcgcggccgtcgccttcgacgagctcctcgacgtaggagttggaccccccggcgatgatgggcaacctccccctctcaaccgcccccgccgcggcgcgcgccgnctcgcggcggaagtcggcggccgtgaactcgtcgtcggggcgcgccacgctgatcaggtggtgcggcacgccggcgcactcctcctcggtcaccttgttcgtcaccacatccaacccggaatgtatctgcatcttatcggagttgatgacctcgccgccgaaccgcagggcgaggtcgacggcgaggcgtgacttcccggtgcccgtggcgcccatcaccacgacggccttgtgcttgacgccggcgccatgcctcagcacgagcggcgccaccgggacggccgcgtcgaagcgctccctgtccctgatgacggtggtggtgcgcggcagcagcgtcagcgaggccggtggcgccggagcggcggcgaccgccatgtacgcctgcatggtgatgatggtggtgatgctcgctaggtgttcgaccggtgttgatcgctagctcagctcgcgcgcgggcggtggcgcgtgcgcttgggtagctagctgaggtggattttgcgatggatgctgtggaggaagatgaggctggcagtggggtatttatagggggggagagggcgctctggaatgtgaagggcgatcacccacactgtgggttggaggacgcggcgccttgcagtcgttagggggagagggagtttagtgatcatgctgcagtgctctgatatgcatttgatagtgcagtgacaagaggtatgtggtttcaaccctaaaaatcccgcgttcaattcccaatacgctaataatttcttcttaaaataaatgttcggaggaaagtttaaatataaattatagagataagataaaattctagagatagaatattattatagataaatgtagttctagaaataaatttgttttaaaatttgtattgtactctaaatctctatctcacatatactctatatatatctgtgagagagtcactacaatacaacagaatacaacaaattatattttccacatgcacgattgccaaaacatttctttagttatagttttctattataatatatatacagtgaataaataaatatttactttattgatagtgctttttaagagtaatctatgtatgccgctggtgtagttattgatagtgcaaaattctaaaagagaccttaacgtccttaaccttgtttaaaatgttaggaatatgaaaccggatggagtaatagttcttgtacgataaaggatgcatgcatgagacgtacgctgcgcctgtgcgtcgaggatgctgaccttggtggagtgctccgcagcggctgatgaggatggcgtcattgtgagcattcagaagaagcacgccgcggacgcgcgcggccacacgcggccacctggggttttcagataatatgcctaaattttgtcaataaaaaaaactcttgctgtctgatcaagagtaaaagttgttatcattagataggccaaatttatgcgcttacaatgatttttttttgtctatcaagttatgaattgtcctagagaacataatcgtgttacacatgagcttgctaaaattgacgcatctctaggtctacaaagtcactttgtttggcttgaaggattcccagacattgtttgtaatttggtactccctccgtcccacaatataagagattttgagtttttgattgcaacgtttaactactcgtctcattcaattttttttttgcaaatataaaagacgaaaagttgtgcttaaagttctgtagataataaagtaagtcacaaataaaataaataatagtttcaaaaaaatttgaataagacgagtgatcaaacgttgcaagtaaaaactcaaaatctcttatattatgggatggagggagtagctagcaattcaactgtgttgggctatctgaacaatggagttgtcttattctttttttaaaaagagactagcttgagcagacaaatcaatttagagattttttttgaggcgaggtatatagaattagtttttttaagaagtatatttgtgtagtaaattttcaaaaaagaaaccaaaatgttaaaatttcaaacatcttctcttttgaaattggagactggatcgagatgagctgattgcattcgacactgatatgcatatatatggatggtagttacgtatccatacaaatggtggtgcccgtgttcatgatgcctctttttctctcaaagtgagtgacactttatatataacggtacagttgaccagaggcaacagacgacgtactgctgccactgtactacaacggattttgagttttttttttcactgtttgaccactcgtcttatttaaaaaatggaattattatttttttgacttactttattatccaaagtactttaagcataatttttcgttttttatatttacacaatttttttaataagacgagtggtcaaacagtgtaaacaaaaacttaaaatcccttatattataggatggagggagtagcacttttaactgttccttttggctcaactagatactgtactacagtagtcagtacgcgctatagtgttatgcaaacccagccaagccgctacgtacaaataaaacaggaataatttcgttgacctctctgatgcatgatctctcatagctgctggagaaaaggagtcaagtcgttttcatggcgtagaaaacagatcaacgacaggtcttttggcatatactactactacatgttaacagttaccacatctcaattaaggttgtgtcatcggttatgtgtgccagtgtgcaacaatcaccatgtcatgccagatcgtatctttgactctgaatgagaaatagaggacagcaacataggaccatgtatactctctctatcccataaaaaacaaacttaaatacgggacgtgacataaatatcaactgtgtcacatttccgtattatgtttttttatgaagaaagtgtatattaatgagaagctagtagccatgagcggaagatttttgtatatagtcgataacatatgtacataggaccatactctctccatcgaccatactctccgtttcaaaaaaaaataaatctaatagagaatattatacaggtgtgtcatatctgtatgggacgaaagaaagtatatactattgagaagttagtagccgcgcgtggatgctttttgttgtcgtcgtcgtcgtctttcggcaatgaaaatctcgatgtaccgtacataaagatgtgtatatccgggcagatcggaaggtgacatgtcatggtcatatcaaccgagatggcattcaacaaatcaactaagttgttgacaatcttaattacgtacgtccaatgttgacagagagagggagacgtacgtccttcaccgtcccactaacaatgttcttaactaaattaaccaacagaaaagatacaaattaaaatggcaggccagcatgggcgcttgatcactttccggttcatcggaataatctccgagctgagatgaaaccggtggctgcagggaagaagacgacgggttgcttctaatgaaaaaaaggcatatagatatataagtatactttacatcgtactacgtatatccctcattcgaagccaaaaccgccatgtagtacggttggcgccaacaggtagtaagcacacactaagcacatttggtggtagaaacaagtatagaaacagtcgatcgatatattccccaatttgggaggatatgcaaaactaagctgcccaatcaggcaagcacgtacgcttataaagactactcctaccttaattagtagtagtagtagtaggagtattagtaaagtgaaagcacttaggacacacgcatcaacgcacagtggtcatagccgtagtggtagtggtggtactatagtagtagtagctagaaggctcatgcaggggaggggaggagagaagcaactcaaatgaaagactacctagagatttgaagtccttccaaatatttttaagaaaaaattataaacatgtaagagattgaacacgagatttcgaggttaaaacaacacaatcttttatctctatacttgagtgtatctcagtgtgttctactttcatcggtctctttgtttttttccaaaatggattaaaactcggtctctaaatccaaatcgaatatactcagcaaaccaaatcaaatggagtatggttgtgtttagttcacaccaaaactaaaattttggttgaaattggaacgacgtgatggaaaaattgaaaatttatgtgtataagaaagttttgatgtgatagaaaagttggaagtttgaagaattatttggaactaaacacggcgtatatatatatatatatatatatatatatatatagctcgatggctttgcgttttttgcagcggtccccgaggcgcgggtggccgtggtgcggagcgcgtcaccgtcatccgtttgcgcggatcgaattaattcccccgcgaaaccggcctgtctgatcggaaactgggaagccgcggcggcggcggatatatcgtctggtggtgggacgccgacgttggattctactactagctagagtatatcgatcaatcgatggatcgattcatgggtgattagtggcactacatggatagaacgatagaaacgacatgactttgtagtagtagcaagcagcaagcgcgtggagagatggagacggagatggagatggatggtatggtggtggccggagcaatcatgggatgcggcggcaacgaatcggagagcgacagggagcagccaccagggctgcaggacgagacgagacgagacgccggcttaggcttgtggacagcgtgtgccctgcgcccctgcctaccggtagatcgtctcctgcggcgtgtgcgtacgtgctctagtttcaaattttgcgactccgcgcattcatcgatgggatggatcgatctgcacggccaactccactattgcgcgcccaagcgtcaggttcgccgcacttccacatgtacagtgtacaggcgcctacctatagaacctgagactgattggaccaacgactccatcggcgccgtgaccactatcgtgtgttgtacacccaactgatttatctaccattgagttgtatacaccaactaatttatttgttcggagaatttaatatgataaaaaggaatgaacgattcacgtttattcttaacactgctctcgaaattgagatataagtaaagtgagcgtttaatttgtcctactccctcggt

SEQ ID NO: 64504 - DNA, 4763 bp, Oryza sativa
aagaatattcgggatgcaaaaacttgtatagaaatataccgtcggtgtcgcacaaccattgcgcgaaaatgacgcaggaatgacgtcgcgggtggtctcccgcggcaataccgcgagcccgcgcggtttcgcggactgaaagagcgagaccgttcaagcaatcagcgacactgtccaatgggctccttttgattagtaattaattatttgattaacaattaattaataattagtaattagttatcctgattagggattaattaattattaaaatccttaatcaggataattaaattgggaaggaacggtttcgctgtttgcttgagcgatagcgctgattgtttgagcgagaccgcgtgatctcgcacttgtgcgataccggttgcgacgtcattttcacgtgcgtaatggttgtgcgagaccgatggtatatttgtgcaaaagattttgaatcccgaatattttttaaaaaaattgaatgaacaataaattttcaaatttaattccctgagagacgggcatgcacctgcaccgtggtcaaggtcggcaataataccgcagggaagcatggacggcgcactcggatggttaggctcgcagctgcagtggaaaccatcagatcacaggacattactctcgcacagttgcacgtttggtactcaaaataatgtttgaccgttcgtcttatttaaaaaaaattatgaaaaaaataaaaaaaaattagtcacacataaagtgctatttatgttttatcatctaatagcaataaaaatactaatcataaaaatttttaaataagacgaacaatcaaacgttgaacgtgaatagtttaaaactgcacttattttgagacggagggagtagctcatatccgatatccgaggggagaggatggatggatggagacagacacagacccagaaagcaaaaattactggctggacaaccaccacgccgcttcccgtggtaaaacaatcatgataccctctttttggaacgctcaaattccaccaaagtgatgaggagatagcacaaatgtggtgggtatttatagttgcaacctgcaaatgacaactagatagatacggccgcaagtattgacagcatcgtaagacggcaacaataggatcgcggtggaatctcagcaagtctgcatactgcaaggaaacggtaatggtttgcacaattgaatctaacaatagcatcagttataaccaggcaaactgacgtggttgcaccttgcaaatgaagcctgcataccgcacaacttattactgtcaaaatgaacaagcacgaactagacaatagcaaacaatagcaaaagagagcattttttctttctacgaaagttgttttccttaaaatgtagtagtaggcttttaagtcggcagacacttccatctcaacgtcatcactacacaatataccttctagctagcgtactcagtcagtacaacagcctctaccacaggccagcaaccgagaacatagttcaacgaacaaagttgatcaaacttagtgcagatatataaggatagcagaatcaagactcaggggggctggatctggaagatatatcacaccatacatcggttaagactacgttcgtaccatctatcaaaaaacacagaccgagaacattcaggattgcggacatagtagctcccagtcaccatgtcaaggcagcaagcctgcgaggtggagtccgagatcgccgatgtaatggcctgtcagggagacaaactagtcagcaggttaaacagagtaagagtataaaatttctagccagaagtggtcagcaccatatctgaattcctgttacacaatacaaatctgcactcaattaatccagaggattattaagacagaagttccacgtctagagaatggggcattgcactagctgcagtttagatcaggctcagataacgcttcctcaacgctactgtctaatactgtacgtagtaggagttcacaagaaataggtcagagtttggactcactttgtttcttctcagatatcattacctcagactggttattgaaacagtgaattatcatttgcggtttactcataatcacggaactaagagaacaaaaacacttctgctcccacaaatataaactacttgtttccaccatcaatttatcgaagtagttggaatttggaaatacagcaatagagctagaggtgatggactatttagtactccctccgtatttaaatatatgatattgttgactttattcggtcaaacttttgaaactttgaccatcatctctaaaaatatatagtttgaaagcgtagaaaacatataggtatactttactactttataagtacttttacaatattataattttattagatattatcattatattataatagaaaaatagtggttgaagttgcacaccaaagatcgaataaagttaacactcaacctagatcagatgtgatagtctgagttcacaaacactggaccttctgcagaaaaaaacttactacctccgtcccaaaatagttgtcattttgagtttttgcttgtaacttttgaccattcgtcttattcaaaagattatgaaattattatttattttgtttttgacttgctttattatcaaaagtactttaaatatgacttatccttttttatatttacaataatttttaaaataaaacgaatggtcaaacgttgcaagcaaaaagtcaaaacgacatctaatttaggacggagggagtatgaaacataggtaatgtcttccaggttaacaggtttacacgagtctaattatgtcaaaattccacaagtctggatgaactgcttatgcaaatcccagatcaaaccaaaccaaataaacaggccactaggatagggaaaaaatagccactgaatatgaaacaatatgttacagttacagatcttgcatgcaagatttcacgaaagggcaattgccaggaaatttagatttagaattttagattcagaacaaacagaaaaaagaacaagacattgtttggtgatgagattgtggagtaaatgaaaccctatgccagtgtaacacaacaaatcacctatcccagcaaatgcaaaagataaaagcatggttaataacacaccttgtactggtgagtttctgtataggacctctgctgaatgcccagtcaacatagacagtccttgttaacagctgagtcccattcattgctttgattgcagtttgtgcttcctcaaaactttcatattcaactaatgcatatccctgttagacagaagaacagatgtgaacagaaatcagatagctctgtgagaaagaaacatagatatttccatatacaactaatccaaaaacagtgtttttcacttagatctataaatgtgctaggcatacactaaatagtcttggatccacgaaattttggagataaaaacgttgataagttggatcgtgtatcaggagatggacaccagttggatgcaaagtatttgggaaatgaaactagtatcagggcatcatgaaagccatcaaatcatttcaaacagtaaacaatacgaaataattggaagtcccaacacccctcttaacccttaccatgtaaacacaccgtggtgcataaaccatttattttctgtaagaatgttaaatgatgtgtactctggggtaaactagccatattgtaccagaatatagcattctggcagaaccaaactagtgcatattcttgacttaatatgaaaatagacatttctctaaattatcacagtagaaggaaaatctaatttcacatcaggtacatgacttctaacaccatgtgctccaagattgcccccattattagattctcttatataagtcatccagagaccttagattagtatgggtgcagttttatcagaataaactaatatcttcttgatgtaatcaagtaaaatgacttgagcaatacactcatgttggtcaattacaaaatgtgtaatccaacttttaccatgctaaatcaaagttgagaattatatcacataaaaaataggagaaacaagatgaataatcaatccaaacaagctaagcaatgtggttgaagaaagtgagtggccatttatgaaactcagagaacatcatttgatatgatttcgattaagaaggtttctaaacagcataaatcaaattttcaactattctcatagcagtccctcaagaaatattcctgcaaataaaaaaggaaaatgatgatgcagagacaggatataaatagtcacccaaactccaaggaatactgacagagtcgttagcgaaagagaatatggttgaaagtaaatttaaggtggttgtgctaagttgaattaacacagaagctttattattcaaggaattacattcagcatatcaaacacaccatgcccttcagattaattaactgaatatgggaagccctcactgccagaagctgcatggaaaagaaactacaatgcacataggtcccaaacagaccttaagaagcctatataggccagtagtaaatactcctataatgttatgtataaccacagtggttgctgcgcattagcagtttgtattgaattgctgcctgttggaataaatatcaattttaccttggcatatccagtgcggcgttccagatttaaatgtaggtccttaacatgaccaaaatcactgaaagtgttgtacagatcatcttcttccgcgtcttctttgactccagagaccagtagtatccatccttcaatagctacaattcagca

SEQ ID NO: 64505 - DNA, 3992 bp, Oryza sativa
  unsure (1)..(3992): unsure at all n locations
tcattgcgaatcatcccgcagtttttatactaccttttaactgcatctcatggtgctgctcaaactaattgatgtcatgcattcgctgcaatgaattttttttgtcccaagtaactttcaatacaatggtctaatttcctccaacgccatcaaggacattggggagaaaaggcatgcctgccaaaggcacacaactacgaaacctacagaagaacgaaagatcacagcgtgcaaaattatacaatcattctactgatggtagtagttgtcacttgtcagcatggaaactcactcaatcagcgtagaacctgatgtggttctcagcattcaggaccacaaaatcagtatcaattgcaattatacatttgtttttttttcccacaaccatatcagcatataactgtccaccggcagcgatttagtttggatcgttagcttaagcatcacatggctccaattcccctgaataaaatcaaaagcctgcaccacaaacaggagtgcgcacgcaatcgagtggcaatcggcaagccgcaagcgcagccgtaccaaaaaccctaaaccctagccaaatatcaccaaacaaatcctagctcaccaaatccctcgcggattatgcgcgacactaactggtaaatcacacgcaaaccgaccaaaaatagcgcacaaaaccctaccgagaagttcaaactcgagctcacgcccaaaaaaaaatagaagtacaaagggggatctcacagcgctgtggcccgtggccggggttgccggcatcggcgagggagtcgaagcggtcgcggttggaggcgagcacggaggtgctgcggccgaggaggcggccgcgcgagcgcatcacgccctgggagacgatgtggggtacgggtagcgcgcgcccgccgcggccaccgccccgatcgtcctcgtccatggcgtcctcctcctcctcctcgtcgcggtcgtagtcgacgaactccacgtcctccgccgccgccgccattgggatgggagtgggagacagcgaggaggaggaggagagcgtgtactgtttgcgccgcggaggtggcgacgtccgacgtggtggttttataggcggtaacgacggattagcgcgtgattacgagggcggagagtcggtaattaaggagggagatttgcgtaatgatcccttgagatttcgttaattaactcgaagcgaactagtgctaggctgctggcttagatgtgggcccactggtcggatcagcccatccgtctgatctctgatcggtaacggacggtccagatcgcatctagttcgcacccggggggcttctccggacagagatggcggcggcggcgacctctccctccgccgcatcctcctccggtggtagcggcggcaacacggcggagggggagatggcggcggcgagcgctgcttgtgcttgccccatctgcctcgattccttctagacgaggcgtacctcgacacctgcttccgttagtctctcctctcagaatctctctaattatcctttatttcggatcttaagattgctccgcatagggtctttaataattaattatgtgtaagctcttcaattctgtaagaattcttatcttggatagaatctttgaacgactcttaagtagagggcaaaagatgtgaagtttctgcgaaattgcttgatggcctctaactaatttgcttcagttttgttcatcaagagaaacattgctggaatcaggacagaaatctactgtattttgaaatcaccacttgcctttcatctgttcaagttcattttcttagagtcataatgtttgtgcagattctttttgttacaagtgcatatgccagtgggtaaagattgtatcgaccaagcatgccgaacctttatcatcagtgcaatgtcccctttgcaaggtgaactcattttctctggttccaatagttattccaaaaaggaacaggacattctgtttgtctgataccattctcaccacatttctcttagcttgatagattatcatcttcaagtgaattctgacagaaaccatatgaacctatgccccattcatatgttgattgaaaaaaacgcttttgaacgtgatgaaacgccactattgaatattgtttaatttgctagctttgggtgtttttctaggaaagcttaaatgtggagaacacaccataccagccattactttttggtgctgctacatttatctattgatgatgcagtcaactatatctataaatttgaccccttttttgttcaccgcccggcaaattttttgttcacctgagactgtgccctgaggtcctgaatcctgattatatgtcccttgtgacatttgcagaccgtgaatgtgtctattatacatggttttaatggtgaatcatttgagcggcactacataaatcaggaccccagaaaaaggtccagttatctccttccctccatctggttgtgcagtgctgcgctttttgtagttaatgttaacgagcagacatttttcttttatttctgcgatggagaccatttgcatgccactcttctcattgtacattaaatattgttgttacatgtttcaataagtatattaagctcattttcctcctcgtgcagacatctttcagatgcacacgacttgattacccaattctatagtatacgaggtatagtgttggttnttagttatgtccgtgctcacacttttagaacctgttccagatatctatctatgaatctagtgttatatgactgacgtgtgctcaactgaacagatattataggcaatacttccagcgttcagcaattctggaagcaacgcaagtatcttcgcaagaacatttggcttcaaacctggctaagacaggaaatacaggctcttacacgggtacatacatacagtactgcatattgtcacacggttattccatagcttaaaagggtcgcacttgcattatcttcttatctgtgtgtaattagggcttctcttcttatctgcattatctgacaatctcattttacccattactcatggatcatagctgaaacacacacttgggaataatacctactcttatagtttagtacaaattggatttgatttacgcactcaagtgcacatgacttgggagcatgatgatggtttctattattctttcaagtgtcgtagagagttgagaatttgtgattattctacgatgttatataatcgtcgtgctgctatcgtgttgcttgctgcaatgtattgtaatactgggttttgcaggatgaaaatgttgacgctattatctaccacatccatggtgtgatcgagtctttcatgaaaaggcaagagaaggggcatgcctcgaagatggctccaccagagaagaggagggaagaattcaagagcttgctcatggaagctgccaggccgttcctccttggccaaacggagcggtttgtcgctgaggtagagctcttcttggtctcacatctgaacattgacgcatatagcaggctgcgtgttcagagacttaaggagtccacttcgcatgtgtcaagagagcaagatgtgctgccacaggatcggtctctggaggaccactacttgtactttctaggtgatgaaacagattgcaatgacgagatatggtgaattgtcaagcaatatcagtgatctcctgtaggtgatggcacagattgtaatgctgagctctgtatctcgagtaccaattgttgtatgtgtaggtgatgaggacagattgcagatttgcaacggatatatatcatagtgatgtacaagttttgccaaaacagtgtccatgttccctgtaaattttgccactcattcggaacctgtaaactgagcacaatctacaatggtatatatagataggagatgcagtcttgctattctggttttggctgcatgcgatttggtatttctgcatattacacaggataagctcaaaagagattcttttcctgaccaaccatgtgatggaactccagaatttaaag

SEQ ID NO: 64506 - DNA, 3556 bp, Oryza sativa
attactgatgtgttgtccttggttcgcaatttcctagcttcacttaacacatgatgtgctactttatctgctgaagttttctgctcgctgtacttctgcttaccctgaaaaatgagataaaagatcagcacaccacgacttaataaccatgaggttgaagccgatcgatgagttacctcaaggacaagctgcgctgccctgttagcgctaataacatcccatagcccgtcgctgcaaaggagcaaacaagcgcacgttatgaaatgtatgagtaatgcattacattagcaagcatgaccatcatagatggggagttttgatacctagcaataagggcagaggctaagcatgcttttgtcatgcgaactgcctggctcacatatggttcagagctgaaccgtgaatcttgttcctttaaaaacttgtccccaagcatcctgccaagatttagtcctgtggaaataaacagcgagatcgtgtcatcattattgttcaagtctgcagctgatgtaagatagcaatatagcatataccacatatacggctttcaccgtctttcaggggttgtcctgaatttgccatccgggctcgttctgttgtactgactactcgatgatcctcggtcattgtaattatttccccgttgacactggcaacaatttataaattattgctgtattacaaagcttgatgaaagaggaccttataaatcattttttattgctattgtatagcagtttaatatacaatagggtggcaatatttaaatttcaattatggtgtatttcacattatactagcaagtgactgctagtgggtttttttttctttgcgaggaagcaagtgctacagaaaaccaaatagtacagtgtcttcgagaacagaaaagatgctaattacctcataatacaagctgagtcaccaagattagcacattgggcgaagcaatcttcgttctggtcgaaccaaatcagaaggatagttgctgtgcagccctggaaaagatagaaaaacatggtaagcctactgaaaaggtggcaattcaagaaacagaggattccaaggacccactagacttcatgtacagcatatagccttagaaagactatctggagtctaggagttttaatgggagactcaactcataatttcggtaaatatttcctggcaatcatgggaaccttaaattgcaagagacttcgcttcatgtatacatttcagaaaccaaattaagaatcagagctaaacttttaaatctagaaaaccagcaagtgatgaattttacacatccaggggcaagtaaaggacaagaaattgcagtagcacatcatttgatcaaaaaagttaacaaacatacaatgtagcaacattcgtccaacaaattctataccaaccaaatgtatagataaaccttgtaacaaacatatgatatttatttaatcaagttattaaactaccagacaagaaattaagcaacatagttcaaaaaatatagtacacgagaaatccagataaaaggaaaacctcatactgatgatggagtgcagcttcagtcaatgcaaaggcatgtctaagaacatctgaagcactatggcatgaaagaactctttcttttgtttcctgttgagacaaaatgtttgcaatgttctgtggaagaatcctaggcaacaaagggggtcatcagttcaacacgtatataatcatatcaaactcaaaatcaagaacggttatagtaattaatacacgaatgtccaaattctaggataacattatgatttgcacttgatcaaacaaataggcagaaatagcttacctgctggcagctattgcagcaccatcccctccatggccatcgaatatgccaaatagcccaaactgtgtaaaaatcaatatcagaaaccactcaagtatttgcacaaaaactaatcattcacataccttttccacaccgataagaggatactggcagcagctgacatcctccatgtgaagtttcttcccagttcgacgggctgtcattggatcagatgctataccaactcctacaggttgttggttttgtagctcaatttggacctagcacggtagcgctatcagggaattgctttcttcaaagatagatacaaccaaatttcaaacatatgttgaagagtttttttttcttttttatatatgctccagtttctatggcatggcagacatgtggaaccaaataggccagcatatgaactgaaatgtcaacagctagcaagaaaacagaaaagccgagtgtggtaacatgtttgccaatttgaattaggtatagttggattatatgaaaaaaaaatgcataggggtttcatttcaagcagaatgatatgtgaacataaaagcattaaccatcagatgaataataatgctggaccataagcaataaaagaccaattctactataaattagttataaaaatcttcagtacacttgaaaggacacactgaaaaacaaaagcggttataacttacagatacttttgatgaactcccaagtgttataatatcaccatctgcaagttcagcaggctcaccccaacgcctagatccaacatcaggatgattaactgaccgggaattcaaaaatgttccatttagactacccatatccacaatttcccatttgagtttctgcaataaaagagtaataataattttattggatgggaatgtaagaaggcttaagatatttgcaggtatgtacataggtcatatgaattttttttttagatacagcttagatcttcacaacttacatttgcattccagtcaatctgtgcatgctttcctgacacctctgagtcctttaacaccaaatgacttggaggaacccttccaagagtcacgggtagcatggacttgttacctgactgcatatagtggtttattccatgagatgggccagctatgacctccaaagctaggttgcttcctgcacttctagcaaatgattataaacatgagcatatgcatgttaacaacaatatttgcagcataaggaccactcgaatatttaaatattttcagggattttttaccaactataatgtcaggaatggtgccattgtgattactctctccagaatcccttcttatgtgcttcacatcaggtgttggcccatttgccacagctggacgcttaagcgtatttcccaaatagagctcttccgttttactgtttgtaacatcaattacatgagtttctcctacacaaaccaaagaattgattatttttgtaattttatgacgattgttagtaaataagatgaatattactaaaagaggaaatgaaaacaagactgatgctgtataacataatgatgaaagtttgggtgtaaatgtatacgcaccttcaataacatgagattcagtgggataggttgccccttttccaacaatgccatgagtcttaggtgaagtgataatcctatcaatccgaattcctgattcatcgacagtactactattgctcgagactgaatagtcatccaaattgtcagatatgagaggcatgggctgcaggaat

SEQ ID NO: 64507 - DNA, 11833 bp, Oryza sativa
tattaattacagtttgtgataacattcgtatgtgaatgaattacgacagaaaaatcttgtatatcttctaaaaacaaattaagtgcgcttagattaaacatagcattccgtgctcttagcagaaaagtaagacagtgggggcttcattggcttagtgccagttgttccagtggaccaggaagcttaatagaggaaaaggaaaagtggttgctacccatatccaaccatatgggacgcaacgtatcttgccgggccggccaaagattaggccgaccaaatttccttaagattgagagtactatgggacacaatgtatcatttaacacaaaacagcaaagtataatataagtaaaagatcatgaaaaatgattgaagtacaaaaatggaaaaacattgactaaagtaaagaaaatcacatccatttcatcgggctgtatttactgtttatgcttttgacaaaccaagagtcggaaatgaagcttaaagaagcaaagataacaatcttatgtccagtaatccagttgcatctaagaacattgcagcttgggcaatacgacaataatccccccctcctcctatcaagctgcaatttgccttgtcgatgaccaaattaacaaacgcaccaaattcatcaatcaaatatgcatgctggattaaatatcagaacagaaaacaaaagctaccgccgaatctccaccaatgcaacattcactgcaaggcagcagctacaatctagggctgggagcaggccacggtattcccctcgctcatggttctgtgttggtgtagtatattctaacgagagaacgccatggacgaatccaaggacctcaaaaatcaaatcgctcgtgaaacagtaccctcgtaacgaacatcaccaagatccaccaccaccacaagaaagtacaaatcaccactcgacaatgtttccatttcatacggcgatcaaataaattggtgaaaaaaaaataatcgagggattccggggggtccgacctgggaggaagcgggaggtgggggcgcgggggacgcgccccgccgccaccgccggcaggcgaagacggcgaggccgaggacggcgagggtggcgacggcgaccccgctgacggcgaggggagggatggccatggtcgcttcgcggggtgccgaatggcgaatgcttcgcgacgcacacgggctcctgttttaatttcttttcgctctttttttcccttttttttgacttgtttgtttgtttttcctctccggaggacgctatttttgtgctatgaattcccgagtttgtgtggtttttttttccctctgtttatacatgttacacgtgactattcacgtttactattttcccttttatcgattattaataataccattgcatttatttttgtaggtttgtgttggaaagcatttagtttctacaagttgttgttatcttcaggctttatccccaaaaccgggatgtactaaatatctttgttttgctagtggtagttttatctattactcacaaattattgttttgtcaacaattgcactgccgtacactctcctcgtaatcctattaccctgtttgaaacatattgtccgctaaattattaccatcgattatctcggataaaccaactattttaagaaataaactaaacaaatatctgtttcacaatgcaagactttctagcattgcccacacttataaggatgagtgtggccttatgagtgtgggcaatactagaaagtcttgcattgtgaaacggaaggaatattttagaaaaagtgctctaactagtttcatagaagacaattttgaaaaaaaaaatatgttctttaaaaatggtgcaaaaaatctacgataacaatatagttaggtaatcaaatattgttcttttaaggtaatttaccctagacttgctagacgcatgagttttgtttttccctgtattgttgacatcatcttaatgatgaaaatcattttagagataaatactgtataaggatacacatgtactccgtaatcgctatgcacaaaagcagcaatagtataagtcacaccctagcaaataaagcctggtccgaatctttaccgggtctttttttcagactgatcacttgggacagtttccctacctgaattttattaaaatggagaaatagtacaatgctttagtttgttacattggaccgtgagtaattattagctgagtaatacaattccctttccctgtaagaaaaaaaaacgcctgtattggtgtggtgtattcccagtgttaccgcaccatcgagaaaaaaaaaatgtagtgctcccctaaaatatttgcttctccctcccttcagaaatatctatcatttatgataaaatttggtgagctttttaaaagttcgacaactaactttatattagaataactaggaaggtagcccgcgtattcgcgcgggcatatattgtacattgcgtttgaatatatataaacagaatatcaataggctgacacctcccatgtttaaaagtactattttttaataagacacatcaggtgaggcctccgctgttcatcggtattttgctttgataattttttcaagatatttgttaggttttaaaatatataatatttaatacatctatataaataattatctatgatcgctttattatatagaatgaagttcgatttaatttgtttggaaagtgtgtctaataaatcaagtgtaaattagaagtaaggtgttttgtccctttttaatagaatctttactcgcttttttttaacaaattctaaagaactatattgttaataaatatggtttatttgtagcatcaagtagttctccttctagttggtttaagttgatgcaagtttttacatacttatatataaattaataaagacatgtcatatacctcgcttcactgtgatttgtgtgatatgtattatatttttcaaaagaaaatacctagttaacatgaatccaaaattttaaatttaatagtaacaaatataacttttcaatgaactatatagtgcgaaccttattgcggtttgtatgtgtaataatatgtggagaaactcataatgctatgatataggatagatgtaaggacattaatgtctaagcattttaaaattgttacgaaaaaggaacatgcaatggttggtccaattttagtgaaatgtgagaaccaattttttaataacttattatgttttctctaaatagtttaatttagtctctattgacattttctattacttgctttattttatattttataccagctcaaaatataagctttatggatctttaaatcaatgttttaattataaatacaacaatatctaaattagaaatcggatgtgtagcttgaaatttatgcaagttttaaaatttttgattattttcggctatataaacaggaaggggtagagtggagagctcaagacgagaagggatggggcgaatagtgccgtgttgtgcgtatgtgtgggggatggcgaagtggaggggtattttttttctattttatctaaatgatttaagtgaaaccaatgatatatttttttctcacattttatgttatttttttctaattcttaagacgtaacacatggttgcttaagattttcttaaaagaatatctattggttgaaaataatggatctacctatttaagtggaaactgatgctaagatggtttttcttccaatttgtaaagttatatttttatttaaggcgtaacacatgacgccttgagtgtgctcagaggatgtccagtgatttacggtaatataatacttattttcattttgtattatggtccgtgttttttctatttggttaccatgcaaaggaacagtgtctatgcttaaatgacatattttcattttttatagagtgaaatatgggtaatatggatcttaaatattttatttaattgtaaaaaaacaaaaattcaaataagttaaaattatgatttaatttaagaattataatcatttagctttctaattattgatatttctttacttagttaaaaattaggagataaaggaattaaatgagtgagtagaggaagagagcgttgaaggatagagattatgcgtgcatataattgcaataattctttttatccgattatgcgtgcatataattgcaataattctttttatctgtcgtaggctctccgaatcttccattataattaagagatgaaataaataattcaagtcatcaaacaagcataatgaaatatccgacgcctcgagagagtaatattggagatattgttgggcctttagcctgccagtcaacttcagcctgagatgtgcccgttaaaccactcgaaggcggtgaccagatatgttacacatttaggagacttgacaaaaatggcttaagatctacaacatctcaaatattcttaactcatactcatgtgaatctaattcccaggatgtgcactagattcacactttcatctcaagcatgattatacatagcaaacacaaataagatgaaagtgattataaactacatctactttagttacattggccgaccgaccaaataaataatagaacagcggaagcttgtctttccaatccacaagcacaccgactaggggtttaccccattaagttcaagtcctagaagaagcagtcgatcacccgcatcactcaaaggctaagtctaaaacctgcaagcaaaagttaattcaacagcaagagtcaataatgtactggcaagcatcaagacaagcctaacaccctacttgcaaggcatataatcaaggaaggcatagtatggttctttttagcataaagcaagttttatttgcataaaacgcattcaaaacggatttgctttcaaataaaatttcagcaagctagtacttaacatatgggcatcaaagtaggcattaatcatgtataaatatccacctcattgccatccatggcagcaaggagatcattctcaaatctcatcacaatttgaaggtaaatttcagcattcaggagaataaacacaagtctatactcaatacatatccacacgccgctcatgaccgtgagcacggctaatcgattagttttaactttgcagagtttgtacactttacccacatgatacgaaataataatcatgcaaaagcatggcacgcgatacataagtacccgatttattacccgcaacaaagcttttccaaaattcatgatttagccttacaccagcacgatacgtgttactccatcctaagccatactcgatatatggcctagaaccgttaagtggtgggcccacgccttaaacttaacgccgtggtgacggacacaacgggaacccaccacgtggcacaataccgttgtattggacacacttagtcacctaaactaccacgtcggggtaaataggaagctcctctgaattatatgaactcatacacaccggcctaccagaatgtaaggctaaaccataaacaacttactaagcttgggctatcccatactagcatatgtggttgtactgtatacggaatgaactgacattgagtgaagtccttaagtcggtttgggcgcacactccccctatcggtacataactaatcaccatatgtgcaccacttgaggcccaaacctaaaattcatattttccaccattttatttatcaaaatcacaagtattaaagttctgctcagattatttaaaaatcaattttcatgtttgtaatgagcccataatgacaaggaagaccattctaagcatggctaagcattatagtaacctagtgtcaccaaaactcgtatataaatggtatagtcatattgttcctaaggttaggtatgagggatatggatatatgtggggttaaggtgataatgcaaataataggagtttgtctaacaagtttaacaaaattttaattgattagtgtacaaatcgacatgcaagatttacaaacattttcaataacctccaaaacataggttcaaagtgatcaaagagagggaggtaggacttgccttgtaactggaaaaagtcagcacctaaatcacttcttcaccgtttaagcaatcatctatacaatgtacacgttatgcaattaaaacaccgaaatatgtgaaaaatccaaaatgctctaaaatgcatgatttgtgcacagtggataggtactggtctaaaatgaatttatgtgaaagaatttctattttatctcatttcatttgagagttataaattttagaagtttcgtcggtatagtgtaggatttacttaggtactattgtgaattattgtgaattgctgttgtaaggtgattcttattaagtttatgtttgctggggtgaagatatgtgtttttaagatgaacacatttggtttcataatttttagagttaatatgaattctttatgtattttacaagttataacgtgttataggtgtatagtgttctataggttcatggctttagaggtttaggtccagaacttgcctcatctagctagtgatgtataaaaatgagtattttagttaactaatctaaccttagttcataggcttatggtctttattatcatggttcatattttataaactaggggagctctagtccatgctagcaatttattatatcaacctagaaattattatatgagctaagtgccttaagttttggtggatggggatggatctatgtattcactggtctaacaagttttatttgggtttctttatagctagagtgtatttctatatacatttatatatatacatattgctcaatcaatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatattggttattacttacataagtatttagaggcttttatcatacaataagtatgtaattttattttataacttggaaggacatgttttggtgattctacagaacttgggtttattcaaaaaggatctaagatgaattttatatgaacttctaaaattcagcttatctaaaactagtcatttaaaggtaatagttttagaggcatttgatgtatagtatgtatactatttcattttgctttataggagaacataagttggtggatctgtagaaactgagtttgctccaaaatgagttgagatgtactttgtatgtattttataagtttgtgtatgctttatgtatgatttatcttagacccattttagagacaaggtctgtgctgagggtgccaagcttattgttatcacattaaagttcatagttttgttaacctatagaaatttgaatcatctcaaaataagttatatttgattttatatggattttacaagtttaggtgttttgctgttaaaaagtaaaggcttttagtattatcttttacattttcagattttaaacttatggggtccacctgtcggtctcatgccaatatgcaaaaaggcccctagggtttcaggaaatcaaaccgcagtcctatgcctgttctgtgtgtcatgagcttttgcataaaggaccctacattaacctaaattcttgtgaggaggtccctggttcgagctgaagcagatcaagccatggctgagctcgatttcaagtttgccagcggcaaacggtggctcgtttgagggtgcgaccaaaagacaaaatgaagatcatgctattgcgattccattcctctacttttatcggtcagtggacatcggagtaacgccggcggcgagtccgagcggcggctgtgcttaggctgctattgcttgttgagttggtgctcgattctaagtgaatgaaatgcatgaatgcaatcctatgggctcaagggtgctcaccgaaccttgaacgagacgcgggaaagtctggactgcggcaacggtgaagaagatggtccggcgacggtgtagagctccgggaagacggcaacggctcgatccactcatcgaattgacatgcatgtgttttcatggggttagtgaggtcccagggatggtgtatacgcgaagaatcggacaatggttcaccggaggaggcgaaatcgacaatggcgacggcgaccggaggtgaagaagacggtagccgatctccgcactcgtagtaccatccttctagattcttgaaggaaaatggagaggaggtcgaggcgaaaacgctggcgcgacagcttggcccggcttggtccagataagcgggaacggcaatgatgtcgctgcggcggtgcacagagcgcgctctagagcgaccatgacatggcagcgttcccgctgctgtagaagatgaaatggaatgggataaaaaccaaagttgttcggcatggtgagatgagaatggaacgagtatgagttagagatggagagggctcgacgacggttggcgatgtccctcttcttggcggccggcgacgaaagagaggtggagagggagagctggagcttcctccctcggttggatcggcactgggatggtgggtgaagagtggcgacgcagctgggtggaggtgaagctttggttcggcactgccacgtcgaggccacgcgtcgacgccgtccagtgccggtcggcgccctcagtctctctctctcggctgtcactgtgttggatggaggagaaatagaatatggacagagaagaagtgactcagagaggcttccaggtgggtccagggcgaagggaacaaggctggagtgagagaggtgggtagaagatggggtgttaattgattttggacgaattttcaggattatttctctccatctcactctgtagttctatagtttcatttgtgagtgtgataaattctcgtggatttttctagaggtagatgaagttacctagtttccattttctttggttgcacttaaaaattatggatagattactctcaaaaattaggggaagaggggctctttggaaactagtttggatttttaggagacctaaacagagaagataaattctggaaaaattatatttattcatgataattaacctagtatttgaataaattatttccctatacacccagaaattcccgaaccagaatttctaagctgaatgtgtattaaacccttgtccaggaccagccagggtacacaaacgacaattgttgacatacagatccacgtcttacaaaaatataaaagattacaaatgcagcggaaaagataaaagcgagctaagcctaaagacttgactcctgcagcgggcgactccattccacaggcatccttgacggcaacgacgaaaccaacttctttgagacatcttcagctgagaaggacttcaactctggtgtgggggaaaagagagcaagactgagtactacccattgtactcagcaagtcataccgaaagaggaggtatgatgcaggatatacccaagggaggctaaagggctcatttgcataaagctagcatttaaaagcagtagttgaaagcagtaaaacagttgtagtaattaatcagtattaaccaatcactgtccaatgctacaccatgttgcaacaggctcaaccaaccacctgaactacgctagttcattagctaactaggggtgagactaatcacggtgaatctggtcgaccgcccataaccgcgggcacgactattcgaatagttttactctgatcagaagtgtacaactgtacccacaagacacagccccacgacacgtttctgtgcgccgacatgccaccacgacataccggaaagaggccgtgacaggacctttcgcataaccctctctaaccaagcacaccacacctcaggtttcacccccactcctcgcaaggcagcgggcagtcccctctcgtgcctaggtgaatccggaagcgacagaggtcgtcgcaaggcccgccccgctccatcacgcccacccttgcctggatgcgtcagctagaggaaagctacactacaagcccagccgttgctcacgttggcttgtggtaagtacgaggaattcttccagggtttcccgcgaaccggtccttaatcgccatgggcacgactaacaaaaccatgcacccatagcccaccatgtagtgtattttaattaaccaacatcattacggtggcactaaaccaaagctatgccaataatcaaagtctatgcattaatgtgattccccttttgtgtactagttgaactaagcatggttaagcatttcctaaaccaatatctagtcatttcaatacccaagttatcaatggcataagggaaacaacatatagctaagtaataggacccatcccacatgatattgtaaaataatgcaatatttaatagaaatgcgggacatttgtaaattgggtacaatatgatcaattgtaatgcatgacttgccttgctctcgcactgatgagaccacagcaacgccttcgaggaaccgcagatcgacgaaacggccgaaatctacgcgacaaacaaagcacacaagcaaaataggctataagactactgaaaacaggaaacaaaaccatttttaatggattctatgcatttttatgaatttactgagacttgaatggacttaatcggagctcggatgaattagttatgatttttagaagattctctgtgtttttactattaaagaaaagccttaatgtatttattgcgcaatattgccccagggctgacgtcagcaatgggggcggcgccgataggcgggacccacgggtcagaggcacaagggagagggaggggggtactggcaggcggggcccaccgggcggcggctcattgggaggaggtggtaccggccgggctcggctcggctccaaagccggccagccggccatggctagcggcggcggcatgcggtcgccggcgatggcaatcggcggcgcgggaggcggcggcagccgaaggcgacggcgcacggccgaagcggcggctcggctcggctcagcgctaggagggagaggaaggggaaaagaggggaggagtgcctcaccgcgagttggccggtgtgggggaagacgacggcgagcgaccggagaacggcgacgatgggcggacgagctccgagacctcctagggaacaagatgggagggattagagggagaggggtggtccacggcgggcggaaaccatggccgaaggcggcagtagtggtggtgctcaccggagtgcgaggagatgcgggctccggcgacgggtttggccgggcggatagcggacgcggcggctcgccggatggcgaacgcggcggcgtcgacggtgaggctcggtgcggcggctagcggcggccggagggcggcggcgatgggtgttgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccactgagaagtgtaataccctactcctgtgttctggtggatctgtgtatgaaggagttacaaagagctggagagcaagagagttcaaactctagaaaccctcttcctctttctctcctctacgagctcaggtcttctcccccctctttccccagctcctcccttcttaagtgggcaaggtcctccttttatatctcaaggggatcccacatgcaccacttctacctactcttcttttgggtggggactcaccctatcttcccaaaaaagaaaaaactcgcttgcgcct

SEQ ID NO: 64508 - DNA, 5278 bp, Oryza sativa
tgctaactccaggagtcagcaggccgggtccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgttgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctatagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaaccgaccgataataatgagcggctttcttcaagaccgctacattacttgagtagcgcgcgaattgggacgagccggttcgtttcgcctggagatgtgatgatggtgcatcggtcggcgagcgtagttaacgcgcgcacgatatgtgccatctcgactaccacggccgcacatccgcctcgtgcgccgcaaacgggcgagcgggattagtggaggagtgggcgcgagaaacgagggggcgagatagtgggcgagggaagcgaggagccgggcatagcgttggtaagggtataaagacgccgaggaagagattcgtttccttcctctcgccattattccccttgccttcgccgcttgcgttctaacttctcgtttcctgtgccctaccttcgccgcactcactcgctctcaagcccctcctccgccggcgtcatggcacggggctccgcaccgctcgatggtagcgtgctgccgccttctcgcatcgtgagcgagaggcaggccgggctgccgcgccgattcatgccggaatctgccactggccgggaggtggtcgcgctgggtgagggacgcccggcaccacactacccggggcggtccgtattcttcctttccttcgcaatggcagggctggtcccgccattctcttctttcttcatggatgttctggagctttataatctccagatggcgcacctcacccctaacgcggtaatgacgttggccatcttcgcgcacctatgcgagatgttcatcggggtacgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtttgcgatcccaggggctcacgggggccatggtgtacggcgattaccttcgtcgccggatcgcgccgctccagcggcgcgcccggggcgcctgggagtacaccgggtccgaggactacatgaggatccaccagggggtcaaatgggattgggtccctgaagacttcaagatggtgatccaacgggtgctgaatctcagctccttggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttcccgccattccaagtctggccggtctgaggccgaggagacggcgaccgcggaggcccggaggcggggagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgtgtacgccgggcggcctgccgagcccccgacccgactccgcccgaggcgacgacgacttctgaggccgcccacgacgaggccgcgggcgcgccgctcgggcccgacccctcgggcaatgcttggggcgagccagcttcggggaacgcccccgagtcggcatgtccatcggcgggccgagccgcgcggcgcccacaccgaggcggctctcccctctgccttccgctgccccactgagcgcagaacccctcctgcaggccttggccgctgcgaacaccacggtgttggacgggttaagcgcccagatggaggtcctgcaggcagagcgggcggaggtcgatgcggcgtgggcgcgcgtcgaagaggggcggcgctcggtggaagccatggtggaggcgggccgcaaggcacaccgccggcatgcctcagagctcgaggcccgtcgtagggacctggcggagatcgccagggaggtggaggaggagcgggagactgcctcatcgcacccgccgtgttcaacgcggcgcgggacgacctctgcctcccatacgggagccgggcggcggagctagagaagaagctcgacgcgtcccggcagcgcgaagaggcccttgaggctcgcgccacggtgctggaggagcgcgcccgcgccttggacacgaaggagagggaactggcgggtcgcgaggccgccatcgccatccgggaggcaacgctggcggcgcacgaggccgcctgcgccgaagaggagtccgcactccgcctccgcgaggacgagctcactgagcgggagcgagctctcgaggaggccgaggccgcggcgcagcggcgggaggagcaggcgcgcctcaatctggaaggcgcccgcgccgagagggccgcactggatcagcgggccgctgaattcgaggcacgggcgaaggagctggacgcgagagcgcgcagcggcggggcgaccgcgggcgacggcgacctagccgcccgccttgcagccgccgaacacaccatcaccgagctgcagggcgcgctggactcgtccgccggggaggtcgaagccctccgcttggcgggcgaggtagggcctggcatgcttcgggacgccgtctcccgtctagaccgtgccgggcggcaggtgggcctctggggcgggcggtccgcgaaatacgccgccaaccaggggggcctcgcccagcgcctctcagagatggccgggaccctccagcggctccccgaggagcttgaggaggcgatcaagtcatcctcgagggacctcgcccggggggcggcggagctcgtactggcaagctaccaggccagggaccctgacttctccccgtgggcagcgctggaagagttccctcccagaaccgaggatggcgcacgtgcgagggtccgggacgccgccgaccacatcgtccacagcttcgagggtacggcccctcgactcgcgttcgcgctcgactccgacgaggagggcggtgacgacggcgcggacgacagcgacgacgaggccgacggcccgggggcgtcggagtgagcccccaggcccccgccaatcttaataacttttccttcttcttccgaggccttcgggcccccttcttgtatagactgatttaatctgtaatcaagtaaagaggaaatttctgcgtcagttaagtttgttgtgtgtatgagacgaggatggtccgtgccgcggtccttctgtgtcttggcttaaacgagggctcgtgcccaggtcccaacctcaagtggcgcgggtcggggctagtgcctggggagatccgcgtgtcgagactggccaggccgggagcgtggtgaccgagggttatggatgacccgattgtgggcctatgccgattcccccccggagttcaccacgccccggggcacggctcggttctgggccccgtttggcgattttagccggcccgggccaccgagggcagggtcgggcacgagcgtgctaattcaagccaagattcttcaaaaggaaacgatggcacagacacaatcctcaggaaatcgaaaatgcttttactgaaatacggaagagaaaaaagataaggatatgcatgtggtagcccccggccaaccctgcacgcccgggggggcgcggggttggcccgagcccgagacctgacacccgacccccactaggggtagaagcgacgaaggtgttcgatgttccacggattaggcagctctgtgccgtcgcccgtggccagccgaacggagcccggccgggggacgccgatcactcgatacggaccctcccacattggtgagagcttgctcagtccagcacgcgtttagacgcggcgtaggacgaggtcgtcgacgcagagtgacgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcagcttggcgtggttcggttcgcccaaagcaccgctggcaacttctcgatcca

SEQ ID NO: 64509 - DNA, 16240 bp, Oryza sativa
gccattgcatctggggtggccgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaatggacccaggatatcgagcccccagacagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggagtgggaggcggagtgggctccgcactcgccttcatggatatcggcaagaagctcgacaccttgttcccgaggaatgcacttcagaaggactccgttagccgcgcgccgatagagggtcccttccaccagcacgtagcgcttggagatgcgctggacgcgttcactccattcgcggtcctcgggtagagtcttatctgcgaggtatgcctggatttcagtgatccaagcaatcaatctaggggaactgggagcgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagcattgagagttcgtcggcgaccgcgttatcccgtctgggcacgtgccgaagctctatcccgtcgaaatggcgctccatacgccgcacctggcgcacgtaagcgttcatctgcgggtcagagcaccggtactccttacagacctggttaacgaccaattgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgcttggcgaggtcaacgtgacccccgcaccggcgccctgaagagatagggagccgtcgaactgcatcacccagtaggcagtgtgaggcagctgcgaggggcccgagctagcctcggggatggagatgggctcaggggctggggtccactccgccacaaagtcggcgagggcctggctcttgattgcgtggcgtggttcaaagcgcaaatcgaattcagagagttcgattgcccatttcaccacccgtccagtaccctctcggttatgcaagatttgaccgagggggtaagacgtgaccaccgtgacccgatgcgcctggaaataatggcgcaacttcctcgaagccatcagaatagcgtaaagcatcttctgggcctgagggtatcgggtcttggcgtcccggagggcctcactaacgaagtagacgggccgctgcacctttcggcggggccgatccttttcgccaggggccgcatctccagggcgctcttcgtccgagaggccatgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccatgtaaagtagcaacggctcatctggctccggggcgaccaggactgggggagaactaaggtacgccttcaactgagtgagggcccgctcagcctcctccgtccaggtaaacggcccggagcgtttgaggagcttaaataggggcagtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgcgaagcttgcccgcaggcacgccgaacacgcacttatcggggtttagctttatgcgggcggagcggagactttcgaaagtttccgctagatccgagagtaaggtctcttggttgcgcgtcttcacaaccaagtcatcaacataggcctcaacattgcgtcctatctggctacctaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggataacctctcggatgaatccggcctccagaagtcgcgccacctcctcgcggatgaaggcttgacgttccggggcctgccgccgcactttctgccggaccggccttgcgcccggccgcacggcgagacggtgctcaatcacctccctagggaccccgggcatgtccgccggtctccaggcgaagacatcggcgtttgcccgcaggaaggagacaagcgcgtcttcctatttgccgtccagaagaccaccgattcgtgtagtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggttcgcgcactgctccatacatgcaagcgcgactttgaggttgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcagctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcacttcgccggttgccggagggagccgccggggccttgccctcacggcgttcctgcctcctctcctcctcccacttccttgtccgctcagccaaacttttgaccgcgcggcagtccgcgaggtcgtggagggaggtgttgtgcacggcgcaccacttgccggtcgggcgccccctgctgggagcgccggcctccttctttttgtcgctcgcaggcctcccctttcgggtggcccgcgaagcgccctcgacggcgaggacgtgaccctcgtcgtcggaatgggccgacctctttttcctcctcctatcccgccgccctgaccgagcggcggatccgggggcggccgaagctgccacaccagaaccggtggagttccaggtccaggcctcctccttgcgagccacacggtccgcgagctgaaaaagctctgcggtggtctggggctccttggaggcgatctttttgagcatgcggttgtgccgcacgccccccctgaacgcgtagattaccgcgtgtgcggggatgcatggtatggtgttgcggacttgacaaaaccgctgaatgtacgagcgaagagactcatcgtcccttcgctgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatcccggtcgtgtagacctggagaaactcggcggggttgacgcttccgtcatatttttcggtgatggtgggccggaaccttgggggccaacggacgttccgaaggctcgccacaaaggctcgacagccgacaccaccaagcgggggcacggggggctggcccccgcgcccgtaccgaagtggcgctccggacgaggaagcgccttccgttgcgtgggcagcacgacgaccattgcgccggcgctcgatactgaggcgggcatccggccccctacgaacatcttcttgggtcggaggcgttgacgagggaatggcagacgaacggcgggtaacggccgccgctcgccgcgccctccgcctcgacgacacagagccggtggtagcagcgccagaggccttggcggcggaggactgcccaccggctcctaggcgctactgcgccgtcatgaccaagtcggccacgtcatccagccaacatcgggctggagtctctggatcggggacgacgggcgggtgacgcaagagcgcgcccgcagcttggagcgcgccctggggcgtgctgccatcgccgtagacgaggaggcgacgctccccgtctctccgtccttctccatcgctcgtgggtggcgaagtcgcggatctttcgaccccctcgagcacctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacaaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcctcccttcttaagtgggcaaggtcctccttttatatctcaaggggatcccacatgcaccacttctacctactcttcttttgggtggggactcaccctatcttcccaaaaaagaaaaaactggcttgcgccttcgcctggaagctaaatcacagcttgtttttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcaaaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgttgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacaggtgtagcggcgcgggagtgatggagggcacgggagcgagcggcggaaagaggaaaaaggtggaggggagtgcgggggagctttattggggctcgggagagacggacatggcaggtgtaacaccctgaaaattcgacgacaaaaatctaaactctaaaaatacggattttcaaaaactttttaaattaattgcatcatgccgatcttattcgcctattttatttgaatttgatctcgaagtttattaatcgtgagtaaagattagttgtggataggaataaataaagtattatcgtgaccatatttggatcaattaaatttaaatatgatggaataagaattaaccctaattaaaaattcaaataaattatataaaaataaaatatgagtaatattaatctagggtgaaatcattagttgagataacacaaatattgagtaaaatgcatatatccaaaaattaggaattgtggaatcaaatttatatgggaaatacactaaaatcgggataaataggaaaagccactattcattgccccctaggtgttcggtcgcgttccctagccctagcccctcctctgccgcgttgccctcgcgccccgcgcgccgcgcgccgctccgcctcccctctgccgtcgccgtcgccatcaccgcgcgtgccgccgtcgcctcgccgcccgcccgtcgccatcgccgcctgccgccgcgccgacgtcaccgagtcgccccgagcccgcgccgacatcgccacccccgtgccacgcgtgctgtcgtcccgttgccgcgtcgcctcgagccccgcgccgccgtcccttcgccgcgtcgccgcccgtcgccgtcaagcccgcgccgcgccatgccgcgccgtcctatcgttgctgtcgcgccgtgccgtcgtgtcgccgcccatcgcatcccgccccgagccgcgcgccaccgctgtcgccgtcgccatcgacgtcccgtcgccgcgcgcgtcccatcgccgctgccgcgccgcgcgcagtctcgtcgcctcgcgccgcgagcccgccgcctcgcgccccgcgccgccgcgccgccgtcgtttcacccctccccctccttcccctctcccctataaagaccccggcccaatcccccccttctccaccccactccattccctcctcttctccctcttccccttctccacgcgccgccgtcgtcgcgccgccgcgccgccgttgtcgtgccgccgcgccgccaccttcgaagccgtcgccccggagccgccgcgccgtgcgtcgccgccttgcgccgccttcgccgtcgtcgccgccaccgccgccgccggtgagccgtctcccccccccctcacctcgcgcccaccgccgtcgccgcccggggaagcaaagagctgagagagagagaaagaaaagaaaagagaaaagagagaaaaagaaagagaggagagaaaaagagggaaaatagaaaagaagaaaaggagaaaatagaagggaaattgggggagaaattaggaggatttaggaaataaaaatggtcggggttaatcgtagattatttttggaaattcctcgagcgtaatagtatttcagtcgaaattccgagttaattataaaaatatgtttcttgatcagattagattaaaattggtagtaaattagatataattaataactaaacaattagatgaattcttatagatcattatagattatttttggtaatctctaaaagtcatcggttcacggtagaaattcggatttaattactagggattttagccgtgtattatatttaattatttagtcatagactaaattaaatcatataatatttctaggatttcgaccgatatttagcttgcgatagaaatctctaacctattatatggatataatgctcgggtagattaaattaaaaacttatgacaacaaatatttatacccgcaaaatagtttaagtcgaaattgggtttgccgtagttcgcaaatagtaaagttaataaaaaggaatcgactttcacattcgactttcatttggatttatttggatttttatttgaattctaaccgaattcaaatcaatttttgcacgtaactatagagcccgagggagttgcggatccaaccgaaggccaagacccgcaagactctgagcaaggaaagtcatcactattccttgaacatgttgatcccaattgcgaaattgttttgtttacaaataaaattgcatgcaatgatgaatatcctacttgtgattataccatgccttgattattgtttacccttaaacctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgaggacatgatttgtgaaaggagaaataaaattaaacaactgttttcgactggggtggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctacggtgggacagccgttgaggtagggtcgagaggcgtgccctacatcggtgtcgccattggtaggactgccatgagtatgtgagagagagaacttaacttgaaccctaatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgtgtctcatgtgttgggacgaggctcatgtgttgggcagtcgcggagtgcgggtaaagtgtacatccactgcaatgtgagtaaaccaaatctattcgaatagccgtgctcacggttattgagcaccgggacatgtattacacttggctagactctaaattctttaacttgtgtgggatgggatattgcatgatgatttttatgctgatggagccacttcctgagaggcgggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgcttagtaggtcttagtacggtcgttgcctgtggcaatggcatgccgctgcctgaattctgctgccttatctatttctgcttttggatgtattccggaccgctcggtccgatgatttaagactacgcctgcggggttatgatgtaataattcgtattagacactcgtgtatatgcacttggtatttcagctatgaattcgtgtataccagactacttgatccagagaaatggtactgtttacacgattgattcctgttataaaaacgggggtccacagccggggtgctcctgatttcgccggcgacgtgggaggtggagagagagtgggaggggattcaaaacttgaatccaccccttgtgggctcgcggcgcgggtgggaaggcgagggcgtgggcggcgtcgtggcgacgtgggcacggggcgcggagtgggcgcgggagcagcgggatacgcggcggcgtgggtggtggtttcggcggtggttggcgcgggcgtgggcggccggaggttagggaaagggctgacaggtgggccccacctgtcagcgcccgagagggagagggaggccgggtgaacttcgggagtgggagggaggagcgggccggcgcgggaagaaatgggccggcggcccaagaaaaggaaaaaggagggaaaagaaaagataaaaaggaaaaaggattttctcagggatttaatattgcactgtgcttattttaattggttaaaattatttccaaggctctgaaaattccactaaaattcctgttagcatattttgacatgtagaacccaagaaaaattccacatgctgatttcgattattattgcatttattaatttgaggaattagctctaggttaaattgaataattttttcggacgatttattttatgaatttaaaaaaagggaggggaacttcagggcgtgacacctaagagcatttgtagtagtcctacgtggcagcttgagagcgtttataggaagtttaatggacttttagtatataatagatagaagatagattttacgatattatgatactaattttttaggccaatatatgtatgtaatttctttggctttaacctaagcagaagttaatgatagtcagaattttaaattcttgataaatctttgttatagacgcaagtattttttaccgaaggaagtaacatacttactctctccgtcccagaaaaataaatatagaactgaacatgacacattctaatacaacgaatctggactgatgtattactatgttacatttagattcatattattattatgtcgcatccactactaagttggttttttatgaaacggaagaagtaatacttaagacaaagggcttatcacttatgctaactcaagaggctttacgaaaagatttatttagaaaccacataaaattgttaaaaatgaaaaaaaaatagatgcgtaatcgatttggtatttttgttgttgttgcgtacttgttagacactgtaaccatatattgctactaacagcaaacgaaatatttgcaaataaaaaataatttatgaatacaacttttatatacatgttctaaacgattttaaacgattttaaaacaaaggttgaaaaataaactacgatggaaaaaaaaatccccaaatcaactacaaattgaagcttgaaaattcaaattttagctaatactccctctgtcccaaaatataagcattttttactctgacacggtctccgatatgatattttgaccaacaatatttataaagtcatgcatgattcctctgaatgtggacatagaaaaggtgcagcatttgtccaagatgtttggttgctcagtgggcactttacctttcatctatttaggtctgcctttgggaacaactaggccaaagataattgattttgcccccttagttgatagggttgagagaagattgtctgctacttctgctcttctgtcttatggagatagattaactatggtcaattcagttttatcttccctcccaacttactatatgtactctctttcccttccaaagtcaataattgaaaacattgatagagctagaagaaattgtttatggagaggaactgatattaattctagcaggaaatctttggttctttgggaaagggtttgtcaacctaaaagtagaggaggtctaggagtcattaacctgaggctgcataataatgctcttttaatgaaaaatctgcacaaattttataataggctctcaataccttgggttagcttgatctggtccacttattatattaacaaagttcctcatgctgatcgccctagagggtctttttggtggaaagatgttctacaatttgcagacattttcaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtattatgtttggggaaatggtttgttctcttccaagaaaatatatgacattaatttcatgcatatacatgcgcctagttatctagcttggatgtggaagagtaagtgcgctatgaaggttaaagtttttggatggctcctgttaattgatcgactcaatacttatgacatgcttgacagaaggcattgccctcccaataattcagatctaacttgtgtcctttgctcaaactgtgcaagagaaaccacctttcatctatttttttaatgtccttttagtgctgattgctgggcacagtttggaattgtctgggatatttctcttgccttcacagatatgctgcatcaagcaatgaattcttataggtctacgcactttgtggagaaaattctttatgcagcctggaatatttggaaacagaggaacttcctgatttttcagaatttaacaccctcaatttcttcttggaaagctctctttaagagtgatctttcccttttagtttttagattaaatgtttctgagagacagtcccttttgaattggttatatcttttgtaatttattttctataataaagctatttaactgtgggggctttccctatagtgccttccctaaaaaaacaatatttataaaagtataatattttaaattaaaagagttgcgcattacgatagtttgtttaatgataaatatagtagcattaattttacatgattgatttttttttattaatagttaaatttaaaaaactttaacttatcactgtgctaaaaatatttatattttggaacggaggggtaagtaaatataagcataagcgaaaagataaaagcccattggtctgttgagggcataatgttgtcattacgacatttggctcttgacacatcatgctgaaaacgaccaacaaacaagccttgccacaactctttcgttcatcggttagcttgtcatgcgtcacccgggatcacgttcaacgtagggagccgtgtctatcattctcacgtacgatccatttgatccagtcttcacgttcgtcttctagattcgactcgactcaatgactcatccccaccactccaccagtcatcacacgctctcgtgtcctgatgccgcctcacatgcgattccttcaccaatcaccctcacaactctgcgttcttttcagaggttcggatggactgattattctcacgtaaaatggaaaatacgattaccatataattaaggggctgctatataacggaatcccgttttcgaacgagatgatttcgagtaggtatcaggtgtgatacctatcaggtattagacgattctataaaacaggatgattccgaataggtatcaggtgtgatacctattaggtatcagacgattctacacacgtttcaggtgatacctgcgaagtattatgtgaaacctatcaggtatcagatgatttcaaccacttatcgcgtgatactcacgaggtatatgtgatacctgtcatgtatcatacgatttctaccatgtatcacgtgatacttgcgaggtatcggatgatacttaccaggtatcaggtgattcctattagatatagctgggcatccccgacacgcgcagtcgcccactgcagccgtcccttgtaggcgaggacggcaacggcgagggcagaggacgggcgcggcgacggcggcggtagcgggggacagccgcggcggtggcgggggacagcgacggtagcggtgggggatgggcgcggcggcggcgattgaggcgacagggggacgggtgcggcgacggcagcggtagcgggggatagacgcggcggcggcggcagcggcgtcgacgggggacgggcacacggcggcggtggaggcgacgagggacggacgcggcagcaacgggggacgcgaatcgcgtttatgaagaggagctatcccgttgggggacggtatcccgtccctagcattcccgtataattaattcagtattaatttataaaattttgatgaataaatttgttggatttttttaagcaatttaattttcacacgaaacaccgtttagcagtttaaaaaatgtgttaatgaaaaatgatgaatagctaatccaaactactccttccgtttcacaatgtaagactttctagcattgctcacatttatatagatgctaacgaatttagacattattatatatatataaattcattagcatctatataagataatgctataaagtttccattgcgaaatggatgaagtaggtacgaagaacgcagccttcggcccgcatcaccgcggtgaaggcgaagcatgggcttttatcggcctttccaaccgtttcgtcttggaccgtcgtctgcaagccgcgagaccggcccggaaaggtggagggggccacgcacgcgccacgcgcggttcacttcacagttcacacgtcgctcgcgccgtctcagcgtggcagtttcggcgcggcgcggcgcagcgcagcgcggggagagcagcgagcacgggaaaaaaaatggtgggaaaagcagtacagtacagtaggagcgcgaaaccgaggggaaaactcgaaacgtctcccgcgctgctgctcttggatttcatcctcatcttcttcatctccttccttcctcttcccccatcgcgcgctctcgaatccggtgttccgctctccgctcctcggctcgcggcgtctcgattcggagtttggtggaagggggagagagagagagagagagagagaaccctaggcggcggcggcggcggcggcggcgacgacgtcatggagacggagcccttcgatgaggcggagctcctcgcgctcccggcttcccccgtcgcatcgcctccccgccggctcaagcggctgaagaagtcgtcccagatcgccaccgccgcccaccccgtcgtcggatccccacctccaccatctccgccgccgccgccgccgttggacgaggaaaccctagctcagttcccttccccgcccactaacccctccccacctccgccgccgccgctggatgcggatgcggctgcggaagctgctccctcccctgcactgacctctcctcctcccaacccgagctcctcgccgctgccaccgacagataccaccgaggaggaggaggaggaggaggaggatgacgggctggacccgctgttctcggagaccttcggcgccgcggggtgggacccgctggggatgccgaggatggaaggggagggcgacgaggaggagatgctgggtggagggctcatcgaggagctgcgcagggagaagtcggcgaagaagcggctcgacatggacgagggcgaagaaggcggcggcgaaatcg

SEQ ID NO: 64510 - DNA, 57508 bp, Oryza sativa
  unsure (1)..(57508): unsure at all n locations
atcatttatgccgagtgcgcagccagtgtacaagcccatctcatcagtccttgagaagatccgccttcggaaactagagattctaaagaagtcggtttccctgttgtttttgtgaggttacactgagaatttcatctgcaaatatttgttaactgacactattttcttcactatgtttttcaggtcagctactcctaatgatgatgatgacgaagaagaagatgatgtctcttcagatcctgtgagtggtaccgctggcgatttaggtgcacctcaggttaaggaggtggatgcagaaggcaaagatccgaagattgtgagtctttattgtagtatctttgttcacgggtgtcatagcacttgtgaaactaaaatctgtcttctgattgtaggacgatatcgagaatgagggtggaatgaatagcggtgacgtgaaccagtgtgacagtgtacctgagaacaaggtgagcattgctttcaaccttttcacttgatttacatgcagatgctgttttgtgctgtaatgatactgttgcttgtttgcaggatgctttgaattgtgataaggatcttgataattgtggtagcaaagatctagataaggtctgtgcccttccaaattctgtagtcaacttgtcatttgtagcagaatttctgtaatagtctaattgggtgatgctttattcataaccagtagttgcttctactttgttctgctaatataaaaacaaattaattttcaacttaagcataatcatgaatgctagtaaaggtagtgggtcatttgcccatattaggaagtttacgtacagctgatgacatggttggcatttctcgttgtatagaaaacattaaatgggtttctactttctatggttataaaatttaaaatctcattcatatttgtgtgcaaggtttggcctgttaactattgaatgcttgatgctaccaggaactcttggaaaattctcaagataatcttgaggacaaggcccaatcaagtgacaatcccaataatgctgcagatgaaattcaatcacccccctcttcaagccctactgagagtaccgatgacatgtaagtacagcagtctcataaattttccatctcttaccatttacctgacctattttatccctttaaacaatattctatctgtaccaaatttatagctattgcacatataacatacagacaaatgtagaaatcttatggcatttatggtgtaaattaaaacttgtcatggctgcgccaacagtacatattcatttttctttagcctcaccatcattaaactgcctatatagcgcaaatgcaaatttatttgagatcactctaccatgaaggtgccattatttcttattattgttttactgacaacacattacccaattttctggagtaagtattggtccttcacatctgtgttctgtgagatttggcagttctttccccccttgcttatgttgatgttctgtaacttaaaattgtgttatttgacccagttcatcagaagatgaagaatacaatgataaggagaacattgctcctagcactccgaaagatgatgtgaatgttcatgaaccactccaaagagctttagcaggggattcatgcccagatgatgctatcttgaaagattttctggatgttgaagctgaggaagaggatgacagtgacgatgacatgatgaggtttaaggacaatgaagaagatgatggaagtgatgaaaatgaagtattcaatgatcttatagaagctgggtatgaagaaggagaaatagatcatgagaaacgcaatgcgctccaccaaaagtggcttcagcagcaagatgctgctgaaacaaataaatttatgcaaaagctgaaatttggtcaccaggagcaaaaaaaagtaatggatcaagatgaggatgatgctgaagactgtgaagatgaatcagaaaatgaaatgtcatatgatttgactccaactaatgtcgtgcgccagaattctgaaaaagcaaaacaaatgattgcgagaatgttcacagatgataatgatacttatgagcactctgatgatgaggaaatagaagaacatttggctcgccaacgtatctcaaagcgagaagtaagtgctaacttgttcagataatcaccaactattacacatcactatatttactttcaggggcacaatatgtacctgttttaggatgtctcatgtttgattgtctggcatggtttatatagcactgaaattgaaaattattgatgatatttgtagtccttgctatgctagtgtagaattagcttttcaccttctatgctttaccaaagtaatttaagaatgttgcaccatatcttcttgcaggttcataatagttcattcatatctccactggagaatgacagctcaagggaagtatttagtctgataaagaagctcaatattgctcctcaacccaagaggaggggaaagcaagtcacatgtaagggtgttttcttctgaatccatgcctacctttattgagaccttttttcttgattacaatcttttgtttcaatatttcttcagcaaatcatgaattgcttacggttgggagagacaacagcgcttcttcaaaggtgcattattgattcccgtttgctgttctacttcttacacatgaatgcacctgctgaaagtttttaaagtgtcgtgctgcttcacatggcaaaattgcaaaatactgaatacctgagtaacttacatgtcatcactagtcataagtcactactgtataaacgagctcttataccttttctgttgccattgctctggtatttcggacaaacagtttttcttgtgtttgctcatgaaatgacgttattgtatgttcctttcagtcatcttttctcggtcgaacagccagtggttcattggcatcttcccacagatcggcctatagaacctatgtatttggtcgtgacgacagcaatagtagcaacaagagttgcttgtctacttccgagagtaatgcagatacggtaagtttgaagggcaaggtgaccgtacatccacatgctctgagacattcttttcgctgggccggcgaaagccggccggggtatatattaagaaagagagagtttaagcaaactgtacatacaagaaaacatgctctgagacattcatttcttatcttagcattctcatgtgcttttgcattcattttgcagtatcagacgaattccagccaaccaaagaaagcaaagttcagtagttcacagtcaaaacaagcggcaacaaaaacaaattccaagggagataacagttcaggtgtttctctgattgaggtcctgcgcagatcatcctctacttcagacaaacaagagtatactcgtcaggaaagctgcgctgttatcacagaaagccaggctgcgcaccagttctcggcattcaaattatcaaggaggttttccagggtgggagcaagaaactgatatgatccctcatcctcgcttcctttctcacctgctattaccagaaagtgaaatccatcactgcgttttttttccttgagtgcctttcttcttagagtaactgttcttgtttgtgctctgtaaaatttgtatatctgattttccatatggtcttgacttcggagataacgtttacattctgtttaaagtgcatcagttcacacaaataattgtttgtgttggtatactaagggcccttttggtgcagattttcagaccttacttttacgagaaccattagaatcccagcaaaacggacaatatagccacatgttacagactatttataacttgctgttgaatgtgctcgtaaacaaatcgaaatttactgttcggcttttgatacaccttgactctcaatttattgggcttaggcgacatgaaagaaaagatctattgggcccagattgatttaagaaagcccatttaggccactggtccgcgtcaacttgcccccaaatctgggcatccgcgtcagcgctgcgcctgcgccgctgccctcctagcccgaaacagcgcagccacgcacgcgtggaatttctagggttcaaatcaaatccaacctcaccttgtcctcctctcctagtctcctcccctccccgttccccaacaagcaaccctaatccatccatggcggttaatacttcgcgcgcatagatactaatcccatccgcgcgcggcctcaacatctcaacctccggccagcctcgcaatcctgctgctatctcgggtaagaggattttattattatttttttgggggggattcaatcgatccggcattgcgttctgcgagtttttccccatttctgggtgggggaatcccgaaattgttgcggtctgaggctgaggatttttttttttggcggtggcagcggcggggaggaggtgatgagatcttcgggagcgcgtctcgcccggtcctaagatgcttgccggcggaggaagcagagttagcggcggcggcggcggcttcaacctcgcctcctacaagtacaaggaccccctcctcggacgcggcggccggagcttcctgttcggcaacacctggttcctcctctccacctacccggcgcgcctcctccacacagcggaccgccgcgcccccgccgccttcttcgcagccatcaaccggactccctgcgtgcgcacgcactgcacggggcagagcttgctgcagaggggcattgttatggctgcctgcggctatgcgtttcgacgagctgagctgggcgccgccaagcgccaacctgagaaggattcatctgtagggacccgaatctcatgcgtcgtggccatggggtcggctggcagcacgccgaggccagaggtctcgtttaggcatagaggggtggagtactgcaagaaggtcggcgtgagcttgaagtgccgcgagccgtggggacctagcagagcattttggaccaatgcgattgggccaagttacaagttgagcttctcggttgaaccatggcttcgggatttcagcacgtcttgtgtggcgccatactctgctggagccacagagcatcagttgtcacttgatgaggcagtacaggataagcagatggacaactccacagtcgggcctgatgggtatgtgtcgtaacccctgttgcaaatgccattctaaattccttatgactgtttcctcctagaatgtttgttaacttgatgttgaacaaatatcagaacgcatgtttgaaccggaatgaaatgtttcctagaggtgtttttcgggggctgaatcctgggcacgtccatgggatgggctggggttttgggtcttccaaggggccctaagtgtgataaaaagtggatttctatgatacagatcataattccatccaagtctgcactacttgctttgattgtttgcaaaacatgctcttgtataagtatatatgcatgtatcctattgcatgaatgtctcagactggatatatatgggtttgtttgccacatgctgattatactgttctccattttaatctacaatgggttcatattatacacgaatgccaccttcagtcacatattgtgtcttatcttcaccagcatctataactctacgtttaagcacagaaccaagaggtgacaatataattaaacggacttgctaaaaatatgtcgacaattttttgggctgatctcagtcggcttctctgtgcgtccgattgctctgcacgagtctttggttgtgcttgccggaccgttcgatttcttctcaaaatcatctcctataaagtaaggactgcatatgcttttgctttttaacttttccaatgtaagatttaaatttacaccccacttacatctcacttacacaccacttacatatgtaattactatgtaattttaggacttacatatgtaattttagaatttacattgtaaatacattaaatttatatatgtaatttagtaacttacaatgtaaatacatgctgactattttttggtaaaaaatatggcaccataaatatagctactccctaattaaatgaggctaatgtagggttttttataaacctttattagttgttgcttttctactatgtggttgatgtcaagcatgttagataatccaaataaatgcgaagaaaaaggaagttgagatgctgtgaaatggatcatgatagatgttggtgggagaggaaaagaactatcatgttcttaatggccatgtttccattttcctttgcatatttttactgtatctgactgaaatagaaacactgttagttacattgctgttcttcatgttaggtgttactgagtagactcaggcacgtgtattcttttcatatacgaagtagtacttatttttctggtggtttctttgcctcttctggtggttgactgtctttcccatctgcagaaaaccacgtgctcctggaccgctgaagctggtctcaggttcttgctatctgcctcaccctgctaaggaggcaactggcggtgaagatggccattttatttgcgtcgatgaacaggcaattggcgtggcagatggtgttggtggctgggcagatcatggtgttgatgctggactatatgctaaggagctaatgagtaactcaatgagtgccatcaaggatgaaccacaagggaccattgatccatcaagggttttagagaaggcttatacatgcaccaaagctaggggatcgtcaactgcatgcatcgtcgctcttaaagagcaggttaaccagctttcctttgtctgatgcttagtgtagtccccttccattgccatttttatgacttggtgaacagtagtgcacacaaaattgcaactgagttcttcactaaaatcacgttgaagttattcttgaatgtacatcttgagtctatgattctatgaatatgattctagagaacatctcatccacggaaaccacaataactggataattctttcatgtatctttctgtctagtgtagcacaatgtttcaacagaactagaagttcacagttctgatttctggaaaataacgaagcagatgtatttaaacatgcagggtatccatgctgtaaaccttggagatagtggcttcatcatagtcagagatggtcgaactgttctcagatcacctgtacaacagcatgattttaatttcacttatcagctagagagtgggggtggcagtgatcttcctagttctgctcaggtgagtaatcacccttcttgaaattttgaactgtctggtttgagcaaacatctttgaatcttcgttgaatgactcctacgttctttatcatcaataatattattgatgtctcatatttggttatgtagacattccactttccagttgctcctggcgacgttattattgctggcacagatgggcttttcgacaatttgtacagcaatgagatcagtgctatagttgttgaggctctcaggactgggctagaacctgaagccacagcaaagaaaatcgctgcccttgcccagcaaaaggcaatggataggaacaggcaatcaccctttgcagctgctgctcaagaagctgggtaccgatactttggtgggaagctggacgatatcacagttatcgtatcatacgtgacaagcgcctcagctacatgatgcgagagcctttcctttttgatgtaatgtacataaccttgtcccagattaatggagctcgtatgcaccaggagtggatggctagagtgagctggcttgctggatggtgggcaatctcctgataccagactacttcctgtaactagatgagtaccaatccagagtaccgttgcattttagattctgaattggtggtggaaaaccatgcatatttttttcctcatgtagtactacaagtaaaagataattcttcgagaccatggtggttttctttggtaagaagaatcaccacttggtcgaaaacgagttttgttgtaagcactatgcaatgttgaatcctagttaacgtcgttcttgtcttcttgttctgcttgctgtgatgtcattctatcctttagccgtgaaacatattataataaacttacttgaattgagttttcagcatctctctttagcttggtacgactcaggattcttatccacatattacaaaccatgcctagataacttatttaaaagaaaacatattaaaaactaaagccaaagaacttatttacgtttgagttttcagcatctctcgtgaacttgatatgagcatattcttgccagtagcagaaaaatgtcgtgtaatacagcgagatattaaaatgatgtttgtatttccataatattattgatcactgaaccatcaggactcaaaaactgtccattatcgcaagaagtccgcaactataataaggctcaggtattacagaaataatatcaattggagtacacacttctcggtggcttagccacttaactaatactaactagctgtaccgcttgacaatttacaggtccctcacgaaagcatgaggtgacgaaaactcgatatcacacacgatggtagctccagaaagcaatgaccaacaagctgatggtgatgggggtaacaataagcggctaaagcacatcgtctcatggtctcagtagagtagagttaacctccagttcatgttctcaatcaatcaaactaccctttgctgtcatcatttgtgtgcttatttagctggctactgctaccatggcggtcttttgacgtgtcaatcttgacgctcaaagtggctataacactagagccctcggactgcaccatctcatcctgccaaagccccaaaggttcatagtgagaaactgagaagtgagatgctagctattacaaggataactttggaacatagggtagaattcttctgatatgatcacatggcaaaatacgagtaaagaggggattggtgttcaccattagctgcgaattttccgcttccatgtcttcacagtccttcttaagcttgtcgagttctgtcatgagtgtgctgtttacggctgtcagttcagttaccttctgggacaactcctcacattcttgctggcagtgtaacaagaatacataatcaataagaaagctttgttagtcaaaaaaagaagaagaaagctttgttttccataagaaaatgtggaatttgataaatctaaacttgttctataccactaactagtcatgaaaaatggctctctcattgacctagaaaatcaaataaattgtgtcccaaggtgccagagtggatgaccgaatgtgtttgtgaaatttcagatttgtaatttatcagttcttaaaatgttataggggcagcctggacagcaaggttaacagctcaaccttccaaatataatcaagccaagagtcccggcaacagtagaaagcatctcaaaaataaaatatatctccttacccaaggtttatagatggttggtaactttccctgagcaagtattttcttacgtttgtcaggccataaaaagtaacaggatagtttggcgggtgacagaaagatgtgggtctttcctggatcataaatccaacagtggccatttgagatgtcgcaaacaggataacatactaccaagatgcagcattctcatgtggcaagaaactagtcttatctatcagagaccctacctgcttccgtagtctcgatctcctcgcagactctctgttagattgttttctcctctccctcttcagttctcgttcatcctgcaaaacaatgatatttgcttacgaagatcgtggtaagcaggaacactttgcactacttaatggtgactacaaaacgttcatgataattaactgccagcatatgctcccagtttatgggataaacataccatctgagacaaagccttgtctcgccgcaaatgcgtcccagcattcacctccacctgtcctgagggcatggcggccattgtagaattgctccaaatatccatcccgatattcaaattcggtgccgccttcacaggattctgctcagacatggcagcagcctgagatgtttcacctgaaaattgccaaaccatctcattctcacacacctcaactgacgaactaatccttgtataccaaagagcattacgactgcgaaccttctatgtctggatgacccaattttctccactttgcaggtgacaaaccctgaaaaaaaaggtcatcagaatcaactaaaataaccatctgaatacttctgaaaatagctccatatgttttgattttggcaatgctcaagaacgcaccttctcgtcagcatcatctctcctctccgatgaatcctcgctcccaccgtcgccactgtaaacaccactattaattgagagctctattcaccaaccaaacagacacgcaaatgcaaacccaagagacgtacctcccggaggagtcctcgccggaggggccaccggaagtcttcctcttgctcttcccttccgccgccgcagatggcacggcgcaaccagccatgggaggcacgctctgcacagatcccagcaaaccattctcaagaaccgtacgtcgcatggtcaccactggatagtcgaatccgcgaatcccatatcactacagcgaacaacccgaatttaaacagagagcggggtgctcggcattcaccgcggccatggacgcgtgcgcgtagtaagctccagggtggtacaacgggaacggcaccggcgcgccgtacgccgccatgagatgctgctgctgctgctgctgctagaaccctaatcaaacactcgacgaaaaccacaacgcgccgagcgcgaaatcccaaaaaaaaagggtgcgcacgtcaattcacgtacctgcggcgggggccaggcgtaagggtggccaccggcggcggcggcggcggccgcgtagtacgcctgcatcgacgccgcccactccgcgtgcgtctgcgccgcggccgcggccgccgacgatgatgccgctgggtcccgggtgtccctgtccccgtcctgccgcgctcgtcgtcggacttggacgaggacggggaggcggccgaggatgccatggcgcgcgggagacagtggggtctgcgaggcgaggctcccggcggcggcggcggcggagcagcgagacgagagcggcgggtgtgtcgtcgcgtggcggcgcgtcggtttggtttgggtgtattgccccccacgcagcgcgcgcgagccagaggggatgacacgtggacgggcgcgcggtggggggtccacgtgtccgtgtaggtggcgcacgcgcggtgcgcgagtcgggtcgcctcgcgtcgggcccacctgtctgttcggtgcgtgaggtgatgtgtcggacactgctggtttcgtgctgacctggggggagttgcacgaattgcgaggcatgaagtgggccgttcataggcctgtacgtgggccctcgattagccatgttggccaggcccgttctaagttcaacgctaactcgctaaccattttttttctttttttttgatttgttatttcacttgcgccagatttttggctattgtctttcactttttcgtccgttggattttgcatcattatttgtgttcttatatattcaacttgcgtcaaaattagatccttacaattctctctagatttacaatttttgacatgttttttttattttaaatgggttatatctattggttaaaagttctgcaagatttgaagatataaatctatcgaaagattaatagttagttttttttcactttgtacaagcattttttactcatagaaatgactactaccctcttgattttcagataagtttgaccattcatcttattaaaaaatatataattattatttattttattatgacatgatatattattaaatattttttaagcctgacttattttttatattaaaaaattaaataagataaatagttaaatatttataaaaaaattaatgacataatatattaaaaaacggaggtagtgtatgcaagaattttccgtcatacttcctgttcggataagaccacaaccatttctcaccctgaaagtaagggaagaagaaatcaacgccgaaaatcactgtcataattaatttgagaactagaatatctttatgaaaaaaagagagagttaagcaccgaaagattcaacagaaaaaaatcaagtcaaaggcgaagcggaggaaacttgcaaacaaaacacatggcacccttgcatccgtcgcgctcgtgaacgccatcacccatcagtttcctcgtccttgcctcgcatagtcgcagctcttctctctctcgctcgctcgctcgatccgagcaaggtaaccgcagctgcaagcgtgcggttcttgcggatctcgcgcgggctcggctctgcgaggaggagctcatcccccactgtcccaatatgaggtcagttcttgattctgtcttgtaaaggtgatttcctgttggatttcaggtccactcctatagtgcgggggccaattggttggtatcgctcgttcgccgcatctgaaaaatgcgtggttggcgctccaggagtaaattagtaggctgtctggatgagttgatggtgttgattccccctcctaattagaccaatggacagttttcgttgttgtttgtttctggttttaggcgttttttcgctgaatgagttggtcctagataagatgggggttggggttcttctctgaccactgcctctgagtggatcagaatcttttgctgatgaaagcaaatgcagatgtgtccttgaacaatgcgtttaggtgtccaatattcagggaatattcttgctcatgcttgggagtccggcttggatttggaaagatcaaatcgtgtagtattcaaggcaagaaaggagcgcaggataatggctcagtgatttttaaggtggttttactgattttgattcagatgcacaagtgtgggagtgccatattgctgtatggatgttaggcttgaatatgaaacattccaaccagattcaggaacgttgactgtattatgaattcttcctttctccaccaaatgaaaatcaaatatatatcttatcatggcacctgtgagcctgtaatcgccaaggagtttgtgcagatctgctcctatgatacctcgtgccagatattttatgtaattctctgcgaaacataaaagcattgtccagtactttttcatgaaagatggggaagaagacttccgattcttccattgttccctttttcttctggatgcttaaagtgcttaaagagttaaagtgaagcatgtcttttcacagtgaccaacaggttaaccaccatccaattggcttggtcctaagtttcagttccatgagagacgtcgagttaaaagctagctaatgtcacttggagccctatatactcttttactgtttcatctataaagctttaagtttttttccttattatgcgccttttcattttcttgtcatattatcatatttagagccaaaacatgcaaaaagagcaaaaaggaaatccttttgggtcatatgactactttttatatgcggagtaaatgtgattacattgacggtgattaatgttcattaactatgcagtacttttgcaaaaccctgctatataacttaagatccatgctaaggagtgaaaattagctgaataggattgaaccaaaactatctctctgtttgaaaaatatccccaggattacatgaaattcatcaataaattatccttggtttgttttttgtaaccattctctaacatatgttcttctttcagggcaaagaagatgttttttggtttttccgtttctcttatcctcatcaacctagcttccataatggagcgggctgatgagaatctccttccggcagtttacaaggaagtcagtgctgctttcaacgctggtcctactgatctggggtatcttacgtttctaatgaactttctcaagtcaatagcatctcccttggcaggtgtccttgcacttcaatatgatcgccctgcagttcttgctatagggacagtcttctgggctgtatcaacaggggctgttggtgtcagccagtattttcagcaggttgcattctggagagctgtgaatggtcttggactagccattgtaataccggcacttcaatccttcattgctgatagctacaaagatggtacacgcggagcagggtttggcttgttaagcctcattggttcaataggtggtataggtggaagtattttagcaacaatcatggctggtagggattactggggattgccaggatggaggtttgcatttctaatggttgcatttcttagcttgttaattgggcttcttgtctacttttacacggttgatcctagaaaagtgtctccaagccattttggtgatgacgaggaccaccatgagaggtacggttctcttcacgttttacaaggaactcatcaatttccttttaatggcctgaatgataatgcttaagtagttttatcatgaaggcatacgtagtaatgtagtatacttgattgtcaaatgttgatttccccccatattccaaattttgaacgttatacttgaggcttcctcagatgcgcctcctgttagctgtaaaattcctgagctaagctaacgtcctcggtgacattgacaatttgatccgacattagcttccatttagttatgtggtaatggtagtatgtgtgcattacctatgtagatataacatttcaacgtaatgtaaatgacaggtcgcatttgatcggtaatggtatttttcctccacagtccatctggaaggattcctggatagcagcaagatctgtcatgaaagtgcgaacatttcaaatcattgtcttgcagggcatagttggctcattgccatggactgctgtagttttcttcacaatgtggtttgagctcattggtatgcaaatatatagacatttatacaatatttgaaattatttccttcccgtcataagacattgacactcttgaactttatcaggttttgacaatagcagttcagcagcgctaaacagcatgtttgctatcggttgtgccagtggatcatttctaggcggagtaattgcagaccgtctgtcaaaatactatcctgattcagctcgcatcatgtgtgctcagtttagcgccttcatgggtatccctttctcttggatcctccttacagtcattcctcagtcagtcgactactggtctgcttttgctgtcactctcttcttgatggggattaccatcagctggtgcgctacttgcgcaaacaaccccatgtttgcggaggtagtccctcccaagcaccgcacgatgatctatgccttcgaccgcgcgttcgagggttcatttgcctccctggctgctcctgctgttggcatggtcactgagaagatctatggctacaacgcaaagaccgtcaatctggaaaatggatcggtagcaggggcgtatgcactctcgagggggctattgacaatgatgattgttccttttggcctgtgcttcttgttctacagcccactgtactttgtgttcaagcgcgatcgagaaaatgttagaagattgcctagtgtcaaggagcaggagctaatatgattatcaaatgcttgctcgtaaggggtgataggggtttagtgaccaacagttactacaagtatctgattttcggcaccaactgaaaatttatgttcagagttgaaatgttgcagttgagtaatacagtttccactttcttcaggcagataagaaaaccacagaaacacacgatgaattgttgtataattattatatcaagagtcaagagggaagcaaaacattgtctgtcattttcttctaacttttttgtagataaacggaaagcttttaatctttctgcttacttggctagggaattttcttgtaaacctgaactttacaaagataatcatccgttctagacattgctgacattactttctggcacacaggttatatacattcattatctacaaacaagttacattcattcatcagtactagaaccaatttgacattgtttattgtttatatttttttttgtttattgtttatacttttctagtgctgtatgtgcaaagactgagcagaaggcattcagccattttgcatgaaatagctccagcaagctgttctaatttccatgtctgttatctggaatattccgtcatctgcagttctatattcagtccaacctcagtatcaaccttttcaaactatactaatttgtgtagccgtgtaagagaagaaataaaggaaaggaataagaaaaaaaatctattaacttattaaagtaatagaaaaaaagccttcacgttcgctctcacagtttagaaattctcattttaatcggagaaaaataaaaacaaagtccatatagaaatacaattttaaaatagctaaaatttgaaattaaaaataagaaatattgaaacagaagactagagtccataccggtataaaatttagaaccaataaaaattcggaattaaaaaataagaaaaaaaataaaagtagaggttagagtccatataaaaataaaatttaaaaataatgaaagttcagaattaaaaaaataaaaaatattggaagaaaagcctagagtttgtatagaaatacaatttacaaataaagaaaattccgaattttaaaaataaaatattggaaaagaagtctagagtaaaaaaaagaaattcagatattcatatgtacacaacacaccagggtttcccttaccgccggtaaccgcggttaccgagtttaccgcgggggtacggtaatataaataccgcggtaacctccttgaattcaaataaatttaaaaaataatttaaatttttgataaattttgcacggtttttcacggttactgcgcggtaaccgtgcttaccgccggggcgcgataaccccggcctggcggtttgggaaaccctgacacacacacactaccttataggttatagaagccggtatatatgtcgatcaactgggaataataatccatgtggatatgcatatggccgtaatgatcagttgatatgatccgttggaaataatccacgtggacgtgcatatactatatgatgatcagttgaccatatgatcggttaggaataatccatgtggatatgcatactttaataatcagtttaccatactatcttggaatatataatatatacatggatatgcatattcctacgtaccttagagcacgcgcaaattgttgatcattgagaaaagttcaacttaatttctatatatactactaacatgatgccttaatataattggcactgatcgtttgattggcactagcttttgccaacctgtgatgctcatgttctcttggtccgttgatatctcggagaactaccgagagaccgagtcatgtcggcgacaggtctattccattcttcgcgcatgcctatttttcctatatagtttatacctattgaaaatattaataattcctataaagtaacacatacacaaagccacatcatcaatatttttcttatcattagattggattagtatgaagatagcagttatgtcatcaagaactacttaggatatgtttgacaggatagaaaaatagaggatcgagaagatacgtaatacaaaataagccattagcacgtgattaattgattattaactacttaaaattttaaaattagattaatataatttttttaaagtagttttctatatatttttttttacaaaatacatcatttagtaatttagaaagcgtgcacataatgagttttttcatcacgacaattcttcacgcatctatgatttttcagttaattattgagtactaacttaaatcaaataggtcattatcctctaaatggatcatcacagtaatgttgccaaatcacaagatcgcacacccaattgatcactcattatggcgtattccgacaaggagaacagataaaagaagaaataaggaaacaaaatgtgcactaacacaagaacttgggcaatgttcttgtgttgtttatcttggaatcaaaagctacaactcgctatgactcactcaccaattaccattcttaactactgttattttagggagagtgtttaacacccctcgatctctaacattccctatgcggaaacacacacattcatgcacaccactaatggctgacaattactacttctgaccactcatacttaggtgtacatgcaacgaggataatgctcagccattgcaaacatcgattggtttggcaagtaattcctttcctttgcatctggtaccagtaaaaatggccacaaattattcccatatatatataccaaaaggatatgcacccatttggctataaaaacacaaccaaatcactcccccatctctgtaccaaactcaattttagaattcagagatccaataaccaaaagcaagaacaccatgagagccccatccttcttcttcctctccctcctcctcctcctcctcctcatccacatctccatccattgcaatgctgcagattcccagctaggttcagagaaggtcaccaacctcctcttctacctgcacgacaccctcagtgggaaggatccaactgctgtcccagttgctcgtgctgagaacgcgtacccaagcctgataatccggtacccttcagcacgatctatgtggtcgatgatctgctgacagaggggcctcagagagaatccaaggtggttgggaatgcgcaggggatgtacatttcgacagccaagaaagggctcacgcttgttcttgggatcgatttcgagctcactgatggcccctacaaaggcagctcgttcgtcgtgtactcgcggaacccggtcatgcaggggaatggcagggagctcgccattgttggtggccgtggtttgttcaggatggctcgaggtttcgccttgcttcagactgtttatctggacaacgtgaacggcgatgcgatcatagagtataatgtgactctcttgcaccattgagttgtttttttttttttggaataagagttgagttgttttagttattatgcccgtgctttccgttgtttggagcacaataagtgtgatctgtggttgggtttgtcaggttatgttttccatttcttttcttttgtttgtctactctccaggagatggatatgtcatggaaattcgtagaaatgtttgcctggttgaatctccattttggatgtgtggaactgtgaataaacattatgtttgctgttttcattaaggcgcaattgtgcatctgaccctattttgaaggctaactttcaatttgatcatgttttctcaactttgctcatttgaccatgcgtttcaaaaacagagacatccattttcagtcccccccccccccccttgaaacaccgataaattctcatgttgtgcttgcgcacgaagttctctctgatcaaggccttactttactgctaacacatagcactctagtctccttttccttttggatgcagatacctgttcttccttacaagcatgccgagtaaaaaaaaacataataataatcaatggtaagctgatcttgttcttccctgattattgtgatatttgttttgctccatctcccgtatatgaaatttaacatttttcttgagaatccaatcactcccatggtagtaaacctcattgcaaattgcaaacacacttaacacaactataatttacaattgaaccagtgattcagtctagaacagagtatagcatcatcatacagagtagtaatttattattgcttatgcaaactgttcagtggtacatatagggtttattcaggcagagggcacagcattatatgttttccattcctctcacacagaatcacaggaatcaggctcctcctagacctggatctccacggtccatttgtacaactcatgtgccggcacggggacgtcgagcgcgacgagccccgtgtcggcgtcgtagctgaactccacctccacggcgtccagcgcgcaccgcgccggccgccgggaggagtaggcgccgaaccggccgcagccacgggccctaaggcgcacgacggcggcctcggcctcggcctcggcctcgcctgcggcgtcgagggcacggacgacgtcgcattcctccaccgctccgccggagttgaacatgtcgagcaggccgatcggcgcgaacgtaacgccgccgccgccgccgcccggcgccaccgtcatgacggggcagacatggaacagctcgaactccagcaccttgagcgtcaccggcagcgtcgctcccttgggcaacctgatcagctcacctgaagcaaaaatcatggcagtatggcacgtcgtcagagctcgacgatggcggcgaggacatgttctgtggctggcagagggcactgacctgatctgtgggcgtacacgacggcgtcgccggtccagcccgtgccggcgacgtcggcgatggcgtcgacgtcgtcggcgcggactgacccggtgagcgtccccggcgccgcgtcgtggacgcgcgtcttcttggtgatccggcaccagccggcgccctggcagttgaacacgcccaccacgccggtgcacttgttcacgttccatatcttgagcaagctgcaccaaattccccaatggccacatcacatcaaatcctcacctcacccggcttgaatgctcgatcgccatggcagaacggatgctgctcgcgagcttaccttgcgccgtcgcgggccgggtcgacaaagaggcagtcgcgggtggggcggccggggagccgtgcccggagcacggagccgtcggggaggacgagcttcttgagcagctcgaagttgtggttacccggcttgtcactgaaatttcagcgagacgaacagatcagatgagatcggcgtcaaaattcagaagtcacacgacgcaattctggctcaagattgcctctgcttcaggcaagccggcgtatgcgcgtgtgccgatggtgatgaccagtcaggatggcggcgatgagccaatgtttgtcacatcggtgacagactgcgcgctggttggcatgccatgaagcaccggcaatcattccagatttccgtccatggagggatcatccaccggcgacggcgaatgaatgcgagttttgagcctcacctgacgtagatcgggcagccgccgatcgcccgcgccgcgccgtggtactccgccgccgggtgcaagctctgcaagttcatgacatcaccaccaccaccatcatcatcatcttggattcaggaacagagcagtagattgagcagcaatggcgacgaagcgtatacgtggaacatgtcccagtcgggctgcatgaactcgccgaggaagagggtgttgtaggcgacggaggagatgtggatggtgtgcgacgccgggtcgagagggtagaagtcgtcggaggcgcgcacgacggcggtctgcctggcgctgtagagcatgtcggtgttgtggcacatgcaggagatgcagccgttgtcggggaagctgcgcgccacggacgcctccagcgcgcggtggaacgcgcgcgtgagcgacacgcggccgccgtgcccggcgccgagcgtctcgatgatgttctgcgcgtccaccttgacgccgtcgacgccgcacgacgccaggtaggcgtggagctcgccgtagaaggcgagcgccatgcgcgggtggacgaggccgaggccgagcacggagagggagtccatgacgatgtccggctggttccccatcacccccggcgactgcaccgggaacgccaccgcgctctcgtagtgctccatcccctccgccgccggcttcacgccgccccagtaccccgccatggcgtgccacacgtacacgtacttcaccccgtgctccttcttcgcctcctccaccaacgccttcagccccgccgccgacgccgccgtctcgccgccatccgccattgccgtcgtcgtcgtcttctggaacttggtgttctccttgatcccgatcaacctgctcgcgaacctgcaacccatcgatccacacttgttactgcacattgcaaacaggaaacagcatttgctgccaaaatcacgtactgggcgccttcttggacgacggcattgccggcatcctccttgttctcgctgccgatctgctgccacccgtcgtcgatgatcaagaaccgcggcggcgtgccgccttccgccaagctgcacaccaaacacatcccaaattcagaccaaaaccaattcaaatttcatcaaatgaaccgaagcgaacctttggaggccttgcttgacgccatcggcggtgacgtcggtgtagaaggcgtcccatgtgcaccacccgaaccagtccaagaacgacggcaactgcatgcgtagcgcacacaccaatcaatcaatcaatcaatcaatcaatcaaattcattcacatcccgccgcgcgacgcaaccgcaacgcaacggaaagcgaaagacagcgccggcgccggcgccggcgcgccgccgcaatggtgtcgctgtcgcgtcaatcaacaccggaagaattagaaaaatatctcacctttttcttctcccggtggtggaacgtctgcagatgcctctccaccaccctgcaatttctcaccgtcgtcgtcagagaaacaatcaaatttcacctggatctcaaccaaattttactactccctccatttcaaattataatttgtttaaacttttttctaagtcaaacttttataaatatgtccgagtctacagaaagatttaccagcacttacaataccaaattaatttcattaaatctaacatcgaataaaattttgattatatgcttgttttgagtttaaaatgctaagatatttttctctaaactttatcaaagcttaatactccctccatttcatgttataagacgttttgattttggttaaagtcaaacgatttcaggtttgactaagtttatagacaaatataataatatttataatgctaaataagtttcattaaatcaataattgaatatattttcataataaatttatcttggattgaaaatgttactactttcttctacaaatttaatcaaatttaaagcagtttgactttgaccaaagtcaaaacgtatttgttctaaacaaagggagtagtatatttgattagaaaaagaattcagtgaaggtgagacacgcacttgacggcttgggtgatggtgtcgaagggattggccccggcgtgcacgtacaccatgtacgtcccctgcgccgtctgcaccgccttgtcacctgctcgccgcggcgtcgcgtcgcagccacacgcatcacatcagaacggagacggagacgacgagaccgtctcgtgcgcaagcaaaagcagcacaggatttgggcagtatggcttaccgctctcgatgcagatctcgagctcgtcgcggtcgttgccctgcagcgccgcccggaactgcccctccagcagcggcagcatcacgacgtacaccgcctcgccgccgccgccgccgtcgcggctctcgaggagcatgaactgtgtctccagcgggacgtcgcggccggacgtgcccatccgctgggtcatccaccatagcttgaaccggaagcagcacatgaacctcaaatccctggtaaaaaaaaattcagccaattcaatcaattttttcttgaaaattttgttaaccccaacagtaaaaaaagagagaagagagcagcataacacaaaacactttgttattaatgaacaaataaaacagtaaacaaatgtctaatcaattttacgaaattgatattcaaattattcttttacgaaatagaaattcgaaatggagcttgaaacgggagtggcctggaagctcttagaaagctggagaagattgttgctgctactgttgcctttccgaaaaggacagaaatttctactactgtttctcagttgctgcactgcattattcttgttcttgatgtgttcttgatttttttttctttcactcaccggagggtgccgaaggtgaagacgtgaaggctcttgggctcgtcggcggtggcgccgacgaaggcgccgtcgacgagcccggcgccggaggcgtgcgtcagcgcgatgttgtccgccacgccggtgaggatggtccggccatgcgccaccagcctcccctccgccaccgttatcctcggcgtcaccgtcatcttcctccctaccctgcttctcctttgagacaccaacaaattcacactcaattaacaaactaatctttcaaaaataatcaccctgctaataactcatcatggttcatggttgagttgctaatcaagaaaatgttacctggtttatttcacgctaattagtaattagcgtggcaatatacactatactagtagtattagttgccctctcaaccaagattggggggagaggtagtgtggctgggaggtgcttatatagctggagctgtgggtgtgaggtgctctgctggggtgccacgtggcatgctcgaaatggtaaaaacttagtagagatgtttctactctggtcattttactaccaatagattcagcggtgtaaagttttagcatgtcacatcggatattatatagggaatcacatatggtgttcgggtactaataaaaaaataattacagaatacgtcggtaaaccgcgagacgaatatattaagtctaattaatccgtcattagcacatgtttactgtagcactacattgtcacttatagattcgtctcgcaaattagttgtgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaatagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgtcgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgtgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccaagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacatggtggggccggtctaaaaatcgggacaagccggttcgtttttcctggagatatggtgatggcgctttggtcggcgagcgtaattaacgcgcgcacgagatgttccatctcgactgccacagccgcatatccacctcatgcaccgcaaacgggggaatgagattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggctggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctggggctcacaggggccatggtgtacggcgactatcttcgtcgccggatcgcgccactccagcggcgcgcccggggtgcctgggagtacaccgggtccgaggactgtatgaggacccatcggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgaccatcatgcaggcggtcggggcgtcggaggagcgggctcctcgagaccacgatggctcgggcgggagccgcaggggggaacaatctaccccgagagggggtcgtgcttctgggccccgtgatgggggctcggggggcagccgccctgccgacgcccaagggaagagaaagcaagagggtacttcctccccatctcctccccgagggggcggggcggcgcgtgtcagcagcaggcgcccggagggggccgcgccgacgccgcagcccgagggggagaggaagaagaaacggctccgcaagatggggggacagaaccatcccggggaaacctcatttcccctccaaggtggtcgtttaaccgaccccctcgcaggttcgtcccacgcccattgtggctgtattcattcttccaacacaagttttcattcacccatcttgtttgtcttctggcttttcttctgcttcagcgagatcccgtcgcgtccctcccgccattccaagtccggccagtctgaggccgaggacccagcgaccacagaggcccggaggcgggaatctgaccggcgagaagccgcggatcgccttcgggaagccgaggaggccgctcgggaggccgcccgggctcgccagaccgaggaagccgctcgggaggaggccggactccgccgggccgaggcgacgacatcctccgaggcgacccgtgaaactgaccggcaagaggccgtggatcgccttcgagaagccgaggaagctgcccaggtggccgtccgagctcgccaagctgaagaagccgctcgggaggaggctagacttcgccaggccgaggcgacaacgacttccgaggcaactcgcggcgaggccgcgggtgcatcgcttgggcccactcccttgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcgggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagtggggggctgccctcatcgccaccaccgtgatgaacgaggcgcaggacaccctccgccttcaatacgggagctgggaggcggagctagggaagaagctcaacgccgcccagggggtccttgacgctgccgctgcccgagaacggcgggcggcggagaccgaggtggcatcccggtggcgcgaagaagcccttgaggcccgtgccatggcgctggaagagcgtgcctgtgccgtggagagggacctggcggatcgcgaggccgccgttgccatccgggaggcaacgctgactgcgcacgaggcgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgccgtaatctagaaggtgcccgcgccgagagggccgtgctgaatcagcgggccgctgagctcgaggcgcgggagagggagctggacgcgagggcgcacagcggcgaggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggcttcccgaggagctcgagaggacgattaagtcatcctcgagggacctcgcccgaggagcggtggagctcgtactggcaagttaccaagccagggatcccgacttctccccatggacggcgctggacgagttccctcccgggaccgaggacggcgcgcgcgcgcaggtccgggacgccgccgaccatatcgtccacagcttcgagggttcggccccttggctcgcgttcgccctcaattccgacgaggaggacgatgacggcggagtgggcgacaatggcgacgaggctggcgacccgggtgcatcggagtgagcccctaggcccccgccaatctttaaatagtttcttcttttcttcttccgaggccttcgggcccccttcttgtatagactaatttaatctgcaatcaaataaagaggaaaattttttgtgtcaattctatttgttgtgtgtatgagacgaggatggtctgtgccgcggtccttttgtgtcttggcttgaacaagggctcgtgcccaggtcctagtcctcaaatggctcgggtcggggctagtgcctggggagatccacatgtcgagactggccaggccgggagcgtgatgaccgagggttatgggtgacccgattgtgggtttttgccgattcccccccggagttcaccacgccccggggcacggctcggttctgggccccgtttggcgattttagccgacccgagcccccgaggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagtccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaatctgatcttgatcagcctcgcagtacatggtggcccgaggggacctcagggtgagctcggatgggagaaccgcttccgcgccgtagacgaggaagaaaggcgtttccccggttgctcggtttggcgtggttcggttcgcccagagcaccgctggcaactcctcgatccacgaatcgccgtgcttcttgaggatgttgaaggtcttggttttaaggcctctgaggatttccacattggcgcgctccacttggccgttgcttctggggtgggcaggtgaggcgaagcagagcttgatgcccatgtcttcgcagtagtcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcggcaagaagctcgacgccttgttcccgaggaatgcacttcaggaggattccgttagccgcgcgccgatagagggtcccttctaccagcacgtagcgtttggagatgcgttggacgcgttcactcccttcgcggtcctcgggtagagtcttatctgtgaggtatgcttggatctcagcgatccaagcaatcaatctaagggagctgggagcgctccccttgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcatactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgcgaggggcccgagctggcctcggggactgagacgggctcaggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccagagggcctcactaacaaagtagacgggccgctgcacctttcggtgaggccgatcctcttcgctaggggccacatccctggggcgctctttgtccaagcggcctcgcggggtgcactcatcttctgtgccgacgacctcggggtcggaggacgacaggggcagccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcatagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaactggtgacgcattgcacatccctaagcttgctggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgcttgatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggaggtaggcgtagtggactgccgccatgaatttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatagcgtcaaaggctgcgggggaaaggatgttgagggctgctcccccatcaatgaggacacgccccagcttcacgttgcaaacggtgggggaaaccaccattgcgatctgtcctccccgggcaacgcacggtgggtggtcggtctggtcgaaggtgagggcaacctccgaccaccgcgcccggcacgtcgcctcatgagtaggggccgcggccagaagctctcgcttcatggccttgaggctccggcgagaaacgtgagcacacgctcccccatcgacagtggcaatggtggccccaggctcttggaagcctaggtcatcatcgccgtcatcgatgtcctcggcgggggccttctgcttggcctcacttcgccgattgccggaaggaaccgccgaggacttgccctctcggcgctcctgcctcctctcctcctcccacttcctcgtccgctcagccaaacttttgactgcgcggcagtccgcgaggtcgtgaagggaggtgttgtggacgatgcaccacttgccggttgggcgctcccagtagggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttcctttcgagccactcggtccgcgagctgaaaaagctccgcggtagtctggggctctttggaggcgattttttcgagcatgcggttgtgccgcactccccccctgaacgcgtagatcaccgcgtgtgcagggatgcatggtatggtgttgcggacttgacagaaccgctgaatgtatgagcgaagtgactcatcatcccttcgctggactgcatgtaagtctgcttcttcacctgggcgcggatatgtgccttgaaagttcatggtgaactgttggcacaaatcctcccaagagtggatggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttggggaccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtagcggccgaatggcgagcaacagccgccgctcgccgcgccctccgccttgacgacacggagccggtggtagcagcgccagaggtcttggtggcggaggaccacccaccagcacctaggcgctgccgtgccgtcatgaccaagttggccacgtcgtccagccaacgttgggctggagactccgggtcagggacaatgggcggatgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcttcccgcctaggactttggcgtggagggggcggtggagtacgagctcgacggcgtgggtttggctccccgtcgtcaccgctaacactcggagagaggttgtgcgcctttgcttgttcagccattgggctgaacaggaaaagcttggcgcacacgaaagagtgcgagagcttagaagaacacacgcagaagcccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaagagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgccgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccccccgagggggttaggccacgtgggtgatcgtgtctgcctcaagtctctaagtcatgatactcccggtcccatgtcaccgacaagttgcaatctatacaattagttatttttgagactatatttaatacttcatacaggtgttcaaatatttgatgggataatgtgtaaagttttgggtgggatttaaacagggcctaaagtgctcactagtcactccagctttgaggtttctggacgaaaaatatcttcatttctgatctgatcagccttgattgatgatgaagaaaatgggggatttcaggagatggttggagagtaggagattgtgtgtggatgacttgtgggcccggagaggagtaggttcacgtgtaggtgatcatctaggatactggtagactagttgttggtgtctcttgaaggatccagattccagaggtgaatgttccagcattccagggtgtgatctgttccagatttttgagaattctaggtctcttgtctgtgtttgttgatttgcttctgtgtttttgctttatgtattttgtcacctatggcactaattattgatttattgtgtgttaaaaagtagtgggagtgttatctgaatttctggagtgtgaagcatgggggattttacatgaaacaagatgaacggacaacttaaacagattaacagactagcatatttagaagtcaaattactagtacatagtagaagaaatctgtattgatcaccagtaagactaatatcattcttttcccggagggatattactcaatcatgcatctttcaactatcaactcaatttctcaaggctcttatattatagcacctgaagaactcagcaatcaatcatctttcagttcaacaagtcaaaagctccgtttgcaatgcacgaatatcactcaaattggtaagagttctcgtagaaatggaagaaaaatataacttgtattactgacgtatagtgtacttctaagatcttaaacatcatgttcggagtgttacagttcattgatcctctaatttcagctaattaactttagttacaaaccgatcctttaatttgtttcctggaaagctggaatcgaattccatccatgcataacagtccgtcgcacctttaatttcaagaatatctttagacaaatactttgaagaatatgatactttatgtctgtatttcctcatatatcaaaattaattgcctttttgtttgttagcttatctcgaagtgcttatcttatgcttccaggagtgagaattggcagcttctagaatgctgcaatcatacatttgctcgtgaaaagaattcaacttttcttcacctattgagggtctgtttagatccttgacaaaatttttcaccatctcacattgaatgtttggacatatgcatggagtatttaatataggaaaaaaataattatgtagattgcgtgtaaattgcgagacgaatattttaagcctaattgttacatgatctgacaatgtgatactatagtaaacatttgctaatgataattaggctttataaatttatgtcgcagtttacaagcggaatctgtaatttattttgttattagtctatatttaatattttaaatgtacccgtatatctgagatgacacatcaaaactttttacccctggtctaaacacagtctgagttgtatgcaagtgccaagagcttaaaccggcctatcgattttacagttgaagatacgctagcacatccaactcataactggtatacaaaagcaaattcgatctattcatctagacaagagttatgtcagacaccactgaagtgcatggttatgctatgtcagacaaacgatgaaacaagacaagctaaatggacacatgcaaataggttagtggacgttaccagtagcactccatgattggcttcaaggtttgagctttgctaagttaaatcattgtccatctctgattctctgtcagctcaacaccatgaatccatgattgagggcaatgttgcagataagtaatgttgctgtttactgcaactgaagaaatactactgctattgagctgtggttaaaaaaaaatccttccaaaacaaagccatttataccccctccgttttaaaatgtttgataccgttgactttttagtacgtgtttgaccattcgtcttattcaaaaaatttaagtaattatttgttcttttcatatcatttgattcattgttaaatatattgtcatgtacacatatagttttacatatttcacattcttttttaaataagacgaacggtcaaacatgtactaaaaagtcaatggtataaaacattttgaaacggaacgagtattatttttgcatgtgagcatagcaaagttagcaacacgtggaaactggaaagtgaggttggattaaccaagcgtgaccgggccaggcacgagttgggcccgtgttcaagaatccaacggtgtgccggatccacgtcaggctgggcacaggatgggcctgaatcggttccatcccagcaaaagtagttgtgatgaaacacacagctgatcagctgaacactttgggttttttttttatataagggtgttttttacccgatctcgttcttacgaagatttaaactcaggtcaggactagcttatcaaaaatgacctaatctaaaattcactcatataaagatttgaattcagaactagtagtactactcaggacatctacagatcttgctcgtgtcgtgcacgccatggttgattgcttcatagctgcgtgattattcagggccaacttataattaagatgccgttaattgatagaaatactgaatttacttataatgtcaataacggtaatgcagtgtattattcgtccggtgttaattttcgcagttgaacatattagcattaccatctctatgttaaggagtgtagtagagtatcattgcacatgttctagtaggatgattagtgaagaaaaagacgagcaaactgtacatgctctctgctcgtgctgcttcgagaaatctaccaacctaattaagctcgtctaaattactactctagtgtacttaacttgaaagcttgttgcgctgtgatttacctttttggcatgatatatccctaccccgacattaatggaacaacgtagacgtgtctagattcgggccacattcagttgtctcctagctagtccagggccaaatcccgggtcctgttgctaacaaggggtctacctgttgtttgatctttggattagagctgaattgaaccagcccattttaaatcaaatagattaatatgaaactagtttataatgtttttatgccaacgctagcttatggtttcatttcggccccgatgctcccgcgggcatggggggagatggatgaggaagacgggagaggagagaaataattagtttaaatcatatccctccatcgtaataccgaaaatcttaatcccaacctaagttagatctcatagcagtatggagagctatttttgctgatgtggcatattagtcaaaaatatttttagaaaacttgtgaagcccacatgtcactagccacaccacagcacaccttcttcctctgttccaatctcctttcttctgtggaataagttcatcggaggtccctcaacttaacagcgatatttttttagtcccttaaccacaaaaccagaaatcttcacccctaaactataaaaaaaaccgtttaatttgggtcccaaaaataaataaaaaagtaggtggggcccacatgtcagtttcgttgccgcacgccgccgcggcctcccctgctccaaccgcgcgctgacgcctctaccgctcccgccgtcgcggcggcggccgccactcctgccacgcgccgccacgaccaccgctgctcccgccgcacgccgccgctgctcccgccgcgggccgactcctcccccgctcctaccgtcacccatgttccccgtcgtcgcctaggccactgcttctcccaccgcacgttgccacggccgccgttcccctccccccctggagccgccgctcccaccacgcgccgccacgaccgccgatgctcctaccgcatgccgatgccatcgccgccgctcccacttttgcccattctccctgctgttacagaggcaaaaaaggtaagagtacagtgagaaatttgtgtcggcgagatcctccaacgcggcgcttattgccgggttgctcaagatgttctccgtttcctgcagcagcgacagtatactcactctcatcactcgtcttctgatctggaggcagtcctccttgtttctctggaccgtctccaccgcatgcttgatcttcagagccatctccgtgatatgcttcatgctactcactggatccgccatcttaattctcaaacacaacataatcaatcgtttagacaagtagttatatatatgcttgaaattgtgaggcagtagctacgttggattagaactccgacgaggagctctccgtctccggaggcggcggctagtgaagcttattgaagtattcttctccgtcaccgactacctcgtcggccgctcgcccgccgcactgctccggccgcgcccggagtcggtgctcgctcgccgctgcagccgcgcttgaccgctgacgccgccgctccgcctactccggccgcgcgccgcctgcgcccagagccgttgctcgcccaccgccgcggccgcgctcgcccgctaacgccgcgcgctgacgccgatgctccgcctgctccgcccgcgcgccgcccgcctgctccacccgctcccgcctccgaatggggagaggcggcgccggccgccgctcctgccgttgcggcctcatgggcgatcgggccgggcgcctctctccccttctctggcgccggccgcctcctctccccctctcccgcttcttcccagcgcgccgcagctcccgctccgccgtcggccgccatttgctcgcctgcgcgtgcgaactgagaagttgagaagagcagagaaaaagaaaagaaaaaagagatgtggggcccacatcattttctctcagtgagatatgggccctcacatatttattttattatttttgctgactaggatgccacgtcatcaaaaccagccatctatactgtcttgggacccaaattagacggttttgtatagtttaggggtgaagatttctggttttgtggttaagggaacttagaaaatctcgctgttaagttgagggacctctggtgaacttattccttcttctgttcctcagttcccaacctcctccatgccgggccgcaccctaggactcctctcggagtctccacttccgactggcccaaatcaagcccatcttcacttgactcatgtcagccgaaatgatgagaaagaggagccaattttcttgggactacgggcagatttggattcgagccaaattttatccagcaaagttttgatatactccctccatctagtttgatagtcatatttcatcttggcacatggaccaaggataagtaattctacttatcatctatttaaacatgctactagtcattcctcgtaaacaaacgattcattaatatttacatttctcgatgtccatgtagccaatcttgtgtggaagaatggagtcacgcattaaatccgagaaattcattaagatgataggttattggattgaaatatgcctatcaaaaataaatttttcagatttggaaatatgactatcaaaagtagatggagggagtatttacttaaacagcatagtaccatcttgatgtttggattggtgtctgattttttccccattaataccattagtggtgttaaattttgctcacattagttctaaatagttgtaccagtagttgatataccctattaaatttgatactccctccattttaaaatataataacttctagcatttaaattttatcttaaaatataaaaacgtctccatctacattcttttatcaactaatcatagacttccatcattcaaattccatacatatttccttttcttaatcaatcacaatattccctcatttaatccaatcatttgtttcttaatatcaatgtacagccctaaaacttcttacattttgaaatggagttagtagacctgttttggtatatactggtaaggtatcaaaccaaacaaaattttctaagacattttgttgttttggtatatattggtatcaaaccaaacaagttcaatgcaagctactaccgtaacaggtcacaacttccagagttcagattcagatacacagaatttcagattcagatacactggatgacaacaggatgaacgagttgagaatttcacgccgcttgtattatggtacgtacaaaactacaaacaattgtaccaataattctggtctagtaaactgtaagcacaccatctgcttccccatcccgccctcttttgggtacatacatatctgccgcctgactgacaaatataatcgctgctggtaagcacaaaaccacaaatgctatctatacaaagccactaagttactgtgtgaaaaaataatgtaacagccagcacacagcaaagaaaaaacgtaagcgtagtttttttctctgtccagtctattgcgtgtcgtcactgatggatccgtccttttgaagcttcagactgaggttactgaacctttgtcttgagtactgcctagatgccttcctccagtcagtgccggccttcatcatgacggcaaactcgtcgtagcttattttcccatcctgagaaaagaataaatgaaaagaaaacattgcattgttgttaggatgaccatatcgacaagttcaatcacacggaatttgaacaggtcatactttgctaatgttactttcaactaacaattgcactagaatcatctccagtaagcctaccccagttgtttgtttgttatgtcatttgttttatgtcgtctaattagactatccttgtccatccggttacaacttattatatgatagtataggtcaatgataacattcaccaaccctttaattaaataaaccctgccttgcagccaaaggtagaaacatttgaaccctggctaccaggtaatcaagtatgtggcactattcagcttctagcaaatgatattcatagatttcactagctgtgggcttataacttttatataattgaagtcattgcatagataccaagaacaatgtcatgcaatataatggcctgctaaggaaagattaagctgaccttgtctgtatctacatcacggatgatgctattaataatgtcttcatcattgccatctatttcatcaaccaaggcctctctaagctcttcaatttctatgtaaccactcttattttggtcaaaatatgagaaagccttctggatatgttcatcattgcctattttcctcacatggatagacacagcaacaaattcttgatagtccaggatcccatttttgtcaatatcagcctgcaaagcaatgagcgaacatcaatatgtatcgccaagaaccagaaccagtcctttttattctagtttagaccatttttaatgataactcacagcatccatcaatatcttaagatctgaatcaggcatctgattcccaagtttacgtatgccagccttgaaatcctcaaaggtcagctggccattcttgctcacatccattttatcaaacatgtcctttatgtcagctgcttcctctgcagacaaatgctcagcaatgacctgcaattaagcacaaataagctaactacaagaaaaggagaaaaatccttatgcacatctcgtgtttagaatttaggaagcaaattatatgtgatctctatgtagaagtttttattcaataagaataataatctattttggtgctaacatattataaatgctaccttaagggctttcttctttaacttgttcatcgcagcaaattgctgcagtctagctcggacagcatcaccaagaggaatgtcaggcatctttttagaatcatgtaaccatggatgttctgtacatgcaacgaaaatcagagaaaaacaatgagaaaaaaatgtctgagccatgaaaaatgttaatcatggtgccattaaaaaacattctggataaaaacacagtaaaaaaaagggtacagctagccatttttcggagaacttttctgagattagccctgcatgatggtccctgaataataaatagccctgggctaattttatatcttcttataataatgtgagttcattactcatcaatcacatcatagataatatatagtacagacatatccttcatatattccactaaagtaggagtgagatagcattatgtatgctgctacgcgttaggacaggtgattggcgatgcttaccaagtacttgttctgcagtaagccttgtcatgggatttgggtccaacatccgcttaacaagatctttagctggctcagataccctgggccatggttctcttttgaaatctaccacagagcgtataattgcctgcgctactccctgctcggtttctgcatggcaccacaataatatgataagaatggtgttctataacttccccgcaacacatgcagtctagtcaagagaaagaacacacctgcccaaaatggtggtacaccgcaaagaagtatgtaaagtatcactcctgcactccagacatcaacttcagggccatagtgtcgctttaaaacctctggagccatgtaatatggactgcctacaatttcagtgaaccgctcacctgcatattgaatccatcattagaaatcaacaagcattcagttttgctgaaaagaatgctgcatgtgcctatgaagtaagctccatttgcagtgaattgaagcaaagtacaatggggcaatcccatttgctcttcttctacttgttttgtccaagtacaatagattcagttccatttattctaaagttatgtacttgagcatcagtctgcagagcataccaggcctgaagaacacagatagcccaaaatcaattgccttcagaggagaactatccttcttgttagcatataggaagttttctggtttaaggtcgcggtgcatgacaccatgcctgtggcacatctgttcagtagagaggacaacaatacatgtcagatgtcacaaaagcaagtccaatatagcaagaacttaatatgaaaagcacatgatgaagaactgctagcatacattctagaatcagcgtgattatacgtttacaaatagaactgctgccaaaatataccatactcgcagtacaaaatgcgcttcactagtacatggactcctttgtcaatacattatcactctggctaaacaatgatgggtgactctaacaagcaccaaggtttaacagactgttgaaccctagcaaattcaacaattaaattttgctcagaatcttaccagatacccagttggatgctaccatgatttctaattcctcactacataaaagaccagatcatggccaattcatgaacataacagctagtagtagcaattatcctatttgaggcataaccaccaatttctctcatctgaaccaaatttatttacgaacataacaacagatgctagaaattaattaagcaaataacaaggtaaaaaaaaatagaacaggactctgtccagtccacagtccacacggagacacgcgttcacctgaaccacctcgacgatggtgcgcgtgacggcggcggcggcgcgctcggtgtagtggccccgcgcgacgatcctgtcgaagagctcgccgccctcgcagagctccatgacgaggtgcacgttgtcctcgtcctcgtaggcggcgcggaggctgacgatgttcggatgcgacggcatgtggcgcatgatctccacctcgcgccgcacgtcctccacgtccaccggcgtccgcagcttccgcttcgatatcgacttgcacgcgtacctgtcccccgtctccgcctccgtgcacaggtacgtgatcccgaactcgccgcgccccagctcgccgccgagctcgtaccgcgcgccgaggtcccgccccgtcgggtcccgcagcaccatcagcccgggcctccccgccgccgcccccgccgacgacggcgcgcggttgtacgcgacggtgaaggggttcgccttcttctgcttccccctcctcctcctcttcccgccctcctccgccgtcgccggcgtgccgcagcagttgcccatggcggcgtgcggcggcggcgaatcgagcttggattcaattcaacaaaggaggcgaggcgattcgattcgattcgagagagagaagagaggaaaataaatggatttgggaaaaaaaattctgtgtgcttcgccgtgtgagttgggtcgcagagtccacgaattctggatgcgttctagaagaggggggcaaataacctagtaaaacctttgcaaaccaaaaggatatatagttttttctatcttgagaaaaaagttttagtaaaaaattttggggaaattttgtgggaatacaagagattttagcggagtttagtaaacgcgattaggataatccggtacagatagatggaggagtagttggtgtttgtttgcttcttctagagatgagtgagtcagtgagagcagatgccgttggacagttattgtctaaggagtatggtgtccggtcttttttcacataatactataatttcagattatataattttcacaaatatcaatttctactttttaaggagtacatgccaagttgccaatttgattttagtgtttgggtattagcggaacagcttattaacgattaaataattagttatattttcttagtgatacaaaagcaaatacttaaaaataaacatgagaaaaaacctaaaattaactctaagtttaaatttaattttaaagtttagcttatgttggtaatgtaaaggctaaacggtggggctgaacagggttttagaagtaaagaattaaaggttttctttccccgaaaaagataaaggggttttaaaattcggttcttgattgagtttagatttcttggaatataaaagatatatgcaggacaatgtgaagaggactttgacgtttgaaacctcgcacggacgacttgtggagctcaaatgcgacggcgacaagcggcaaagaaaaaaaaaacacaccagcttggaaagttggtttggtaagcaggacaatgacaccccagtaaattacaaatggagagaaaaaaattacagtttaggccgagtttagttccaaattttttcttcaaactttcaactttttcattacatcaaaactttcctacacataaacttctaatcttttcatcacatcgttccaatttcaaccaaacttccaattttaacgtcaactaaacacaccctaagcgtcctgtattgagaatttggaattcagtagagaattgattggtacagtactggaacctagtcatcgattattctaatccctggccattgattgactagctcgtggcgttgcttgacaggatcagcaacctggggaagaagaggatgatagaaactgaagcttcggttcagacttgacctgtcaggatcaactaactagaaggaaattgcatgttcagttcagacttcagggtttactctttcaatgagaagacttgagaactgaagagtttattactgtattttctttttttttcgtttctgtggggtttaagccttcatagttcagaccagtccagaacttcaaatttcatcaggttcagtagcaaatccgcagagaaaaaaagaggagagaatgtattcatcttatgtttgtacgagtagtagtatagatcaaggatgagtttattcataatattttttgtgttttggaatctaccataaatcgtaagcacgtgcatggaatccatggaatgtttcttttttattttctatcagcagcactggaacctcttttcttttcttttttgttggcgctattgctattctatttttctgacaggaaactgaaaccaattgcgtatccctcttccagaagagaggtgcaggctcaggcctatcaacacatgctgctttcaatcctctacaccacaaccacaagacgtcaagattgaagaacgaaggcgatcaaatagttcagggtttactcttacaatgagaagacttgaaaactctaagagttcactgtggggtttaaggctttaagccttcagaattcagaccaaaacttcaattttcagattcagtagcaagtcctcatcaagaaaaaagaaagaatttatccagctttaaaatgtttatagggtaaaattagtatctactagtaggatttggatcagctgcagtagtagtactgactgcaacttatgcagtcatagcagctaccgtttgatctgaatcagatggcactgattaggtagagcactgtagcaaaagtactgtagaataaaatattactatgattatgtagtttgataactgtagcggcaaaactggaccgttgatcatcaaaatgaacggctgaagatacgtgcagtcctaagttgcagtcgtagttaccactgcagcaggttatccagtaggatgattctcgatgcaagagattgcactatttaggtacttcactagcaggaactattcttttgcaaagagcttattgaactccaaacatgatctcaatccctactagtagtagtgtacttcctactctcccaaaaaaactcaatttaggattgggataggacataatacgatgaatctggacatgcttctgactagattcgttatattagactatggttgcgattctctcggttgggaactcattcccttagcacaaaaaaggtccattagcgcgtgattaattaagtattagctttttttctaaaaatagatcaatataatttttaagcaactttcgtataaaaacttttttaaaaaacgtaccatttagcaatttgaaaagcgtgcacgcagaaaaagagggaagtgagttgggaaccatgagtaccgaactcagcctatgtatcatcctaatcctaggttaggtttttttagacgaagagagtactactcaaggatcaatttattcatctaattctgtgtttttgggttctaccataaatcaaaagcacgtgcataaaatccatggaatgtttctttttcttttctatcaccactgaaatttccacttttcttttctttgtcttggcgctattgctacttcctccatttcacaatgtaagttattctagtatttcccacattcatattgatgttaatgaatctaatgtgagaaatgctagaatgacttacattgtgaaacggagagagtattatattttatgactggaaactgaaaccaattgcgtatccctcttccagaagaaaagagtaggcgcaggtataaagcatgcgactttcagttattctagaccacaaagacgtcaagattgaagaacaaattaaggcgatcaaataatatatgttctttttcaagctgctgaagatgcatgtacccaatgggttcatggaattgtttgccttcttggctcttgccctgttctttccatcttgcggattatgttgtaagcttctaaacgtttgcaaaaccctttctatgtgtatataagattcttagaacactttctaaaaacaactaataaaatttgtaacaatgaactcgttcttttgcaccgtccgatattatcacaacaacaacaacaacaacaacaacaacaacaacaacaacaacaacaataataataattcataaatatgttctgatattcagttgaaaagaaggggacttcgttttcctttaattaattagtatttgcttgacaacaactaaagaagtaaagagggtcaagaacaattaaatgtggccggccggcgagcgggcatgagcatgtagacgatctcaaccttacgaggcggatctagaggtggtattgggaccacccaaaaaagcattagcccaatacagatatacatatgtgaaaagattttttttggaaaaaataactcccttattagtatattaagatgtaaatttgaacaatttatacttatatttagaatatttaaaaaaacatataagttggatcacccattttgaaaattctagatatgccacttacgttttttttttcgaacggtcaggccgttgccgatgttttatattaagaagaagatatcctattttaaagagaaaacgagatcaaacctcacagtgctcagttaattagggacaactgagcgaaaaccacaactacaacatcacaccaacaactaacctatcctaagctaccacgacggagcccgacacaaggcatcggccaagcttgccatttgagacaacacaacagcctacatatgttatcgttatcaagcttgccacccaagtgacacagcagcttcgacgccacttacgtcctaaaccttgtggagaataagataaccatgcagattgagcagaaagcgagcaaaaacgaaatcaaaggggttaatttccgaccccttctgcatctgacaacggctcggctgctctctgtcttcgccttcagaaaaacgatgtttgcctcgcaagcattgcatgtttttttacgcttcgtcggcagaaaaatgttgacatttcagggaatcaaggactgcatttttcttcttaaggtcctgaagctcaactgttgatcgatcgagtagttcaccgtgtgtgcatcaaagcatgcacgacaaaggagaagagacagagagaggtgtgtgggtgtggctgagcgagagacatgcaccgaaatttaactctccgaacccctctctgaagtttactttttcttttttgtatgctgggttctactgccataaaggaataaataaatcataagaatgttatataaaattcatacaaatgttccttttatcctttctactagcacttaaaagtctgaaactattgtttttccttttgttggcggtgtcattgttatgttttctgtcggcaaactgaaaactgattcatatattcctctttcagaagaaaagcagtaaagcacaggcgcaggcattaccaacatgctgcattttaagcttctagatcacaggagcgtgagaaagaaagaggtcgaaggggatcggagttcaaaactccgaccccctttggatatgaccagagctctgctctccggcttcggcttcagaaatgaatgtttgcacgcatgcatggtaatcctaattatgcttgattggaaagaaaatgttgagatctccgagaatgaacaaggaaaaaggactgaacttttgtttctaaggtggttatcgatcaaattatccccccaaaagaagaggtgccgatcggaaagagaagtacctagcagctaaaactggaacttccattttatatttttcttggaggtgtcaccgttctatcttttgacggcaaaactgaaaccggcataccagcatgctgcatttcaatcttctaaaccgaaaaatggtggtgctgcatgtaccaaatggctcataaactgtttgcacttcgttagcagaaacatgttgagatttcagagaatgaacatggaaaatgaaaaggactgttctgaacaatcaatcgattagttcagcatgtgtgcccatgttaggttcgttgtgaatgcatgagaatgagaagagagatgtgtggatgtggctgagagagaaacatgcactgaagtagtgaaggaaaaaaacaggtgaagggggtcggaattttaatctcctaatccctccttttatttttttttaaaaaaaattgggttctaccataaatcataagacacatcgcataaaattcataagaatctttttttccctcttttctactacgagcaagtttaatagtacagcccactactagctccaattcatctatagccgatctaatagccaattcatacaatagttgcttactatactattaatatatggtcccacctgttatacacacattgcgtcttagagtccgtgttgcagcccgctgctcttctctctcatcttttatctcattaaaatatatttatagttggctaatagtctgctattgtaccagctctactagcactgaaaccagtttttctttcttttctttttttttgttgttggcggtgtcaccattatattctctgacggcaaactgaaaccggcgtgcaggttgcatattcttctcccaggagaaaattgaagggcgcaggaatacaaacatgttagctgcattttcaatcttctagaccacaggatggtgaaactatacaaattaagatgctgatgcatgcatgcatccattggttcatgaactgttcactctagaagaagacgatatactagctcagagccacaggagtctcaggtgaggtcagatctctgacctctgaagagaacaaaccaagaaatttccactgctgatgcgcctccttggctttggctttgtcttgtcctgaattcctgatgatgacctatatatatggtggttgctatcgattctcattcgctgttctagatgaaatatctgaaccagtttatctccaagatgtgcaaaatgatcagataaattgctatctgggccgcgcattgatgatccaaccgtgaaatgttcgagcggcccatgaaggcccaagtttgcgatccaaacttgcatcagctctgctcagtggatgttatgtatgtaggagtaactctgtaacagttaaacagtggctaagaaaatctcaaatctgagatctcatctgagtgatatttagctcatgagttattacaagcatgtctagtacttattcatgcacggattagatcagatcagattacaccatgcgcaaaagccaaatcactcttctcccgcgtcaacaccatgcatgttcgatcatgcaccgatcgcgacgaactcacgccatgtagcggcgtcgtcgtcgccgccgctgccacttaggatatcctgcaatggatcgaaccgagatgaacaaacaattcagtaaatgcaaactaatgcgccatgagaccaatctaatcaacttttttttaattattacttgctgcagtcggtggcggcgccgacggggatggcgagtccgagcttgcagagcgccgggaggcgccgcgcgcggtcggggagcacgccgaacgacggcccggactgctccaggcacctgcacagcgcgcgccgcgcctccgccgtgcccgccatcccgcgcagcgccctcgcgccgccgcagcaccgatcgccggccgcgccgcgccgcccagcaggaacggcccgcacggcgccagcgcgctcaccgcgtcgccgcacgacaccgtcgccgcgcccccggcgcccgccgccaccaccacgacagccacaaacaccgcgatccccaccgccgtcacgccgcggctgcgacgagcgctcgccatcgtgcgctcgcggtgacggccgatcgattgaacaaacgcgttgcgtgtgagtgtgtgtgtgagtgctgagctcgaggttggcaatggcggccatttttgtaggtgggggaggtcaaggaggttggtgatgcgcctgaatgctttcccgcgactttaccatgctcgtcgccatttccggcaagctgaacaactctgcaggcgcgtattgaatcgaccggatggcgagcggctaaacgccatgcgtcgcctgcgaggtccatgtgattgtgcattcagttcacttgatctttatgttgcattcaatccgtatatccaaaagggaatatcaaaccataatgccccttgccacaattttttgtcatctgcattttttttccaacaactatactagtccgcatgccctttttgaatgatctccaactattttaaacattataaattcctgcccatagtttgtgaatctatagttgtacaacctagagaataatttgagagtcaaaagctcaaaaacacaactttatcatatgagaaaatccagaaaataccaccgataaacatccaaattcaagaaatgccatcgatgaacatatattcctaaaaatgtcattgtacaatcgtctttgttccataaatatcatcgtcattagattttcattaacagcactccgttcagtgctataaaaagatcattttaaccctacgaattgttgaaagctgattaaaacttttgttcttttccattgggttgcacaggccatccctgggccaggccaggttctgacattgcccacaagcagcccattagctgtctcggcccagatcttccaacgcctgaactgcatggacagttgggtacacaggtcagcgctccgaagaagaaaatactttccttcacgttggcgcccaaaggtcgtcatcatcatcgatccaaaccgctttattccctctcgtagccatcgtgcatgcatgccattgccatgccagccaatcccttcttcttcgcgctagatctccattatttttctcatctcaacctaacaacttcttcctcttcctcgctatcttttctcgcacgggaatccggatgagacctgtcgcctgagctgagggtgagctcggtgtgtacgttgtcggggacgatgaggatcatggtgcgcacgctgcgcggggaccgggtggcgctcgacgtggacggcgccacgacgacggtggcgcaggtcaagggcatggtcatggcccgggagcgcatcgcggtggccatgcagcggctgttcttcgccggccggtgcctcgacgacgaccaccgcacgctcgcggactacggcgtgcgtcacgactccgtcgtcttcctcagcctccgcctcgccaccgacgcctatcagtacgtgcaaatttcacaacgacgacggcgagcattcttacgattttgttttgacgaaccgatcgatcgatcgatctatggcaggacggagatgcataatgtgcggttgatgcagccggagacggcgacggcgaagcaagaaatgcatcagcagcagcagcagcagttgcatgtccatgtcgccgccgacgacgaggagaaggcgatcaagaggaagccggtgtcgcggcgcgcgctccgcaagatcctgtcgcggctgcaggtggacgcgtggacgagccagcacgacgccaagttcctcgacctgctgctgcgccacacgggcggcggcggcggcgcgaggaacgtgggcgagctcaccggcgaggactggtcatccatccgcgccgagctgaacgccgccaccgggtccggcttccccgtggaggagctccagcggcggctgggcgagttccggcgggagttcgaggcggcgagccggatcaagaaccacccccggttcagctacgaccctcgccgccgcgtggtcgtcgccaagcaggccgactggaagaactacatactggtgcgccgccattgctgcatccttccgaatcgcgaatgtcttcttctcggtgagctgttcttacctcgatcgtttgttttggcggtttcaggagaatccggaggcggcggcgtacgaggggaggagcccgcggcatctgggccggctccgagcaatcttctccggcgacggcggcggcggcggcggaggaggagccaagtgccgcgagacgaaggcgaggagttgcctgaggaagctgctgcggaattttaggctgcgattcaagctgtagatagtttaaatttctgcaatatttgtctcaatttgatcgaggcgcacgaaattgttggttagttttagagcattcaattgagatcttacagtagttggagacacgactctctgagctgaagcaacgcatcttcagtcgcttgtaaagggtgctctgctgtttttgaattggctaaatgctactaatcggactgacattagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64511 - DNA, 709 bp, Oryza sativa
ttcctgcagcccgtcagagggcgacaggcgcggccttcccgcagtggccccggggccatcctgggggtcgggggcgccgggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccatgtaaagtagcaacggctcatctggctccggggcgaccaggactgggggagaactaaggtacgccttcaactgagtgagggcccgctcagcctcctccgtccaggtaaagggggtcaaatgggattgggtccctgaagacttcaagatggtgatccaacgggtgctgaatctcagctccttggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctcc

SEQ ID NO: 64512 - DNA, 12990 bp, Oryza sativa
  unsure (1)..(12990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagtacccgcgtggtacggcgacaagggctgggggcgaaagtgagttaagtccaagttggggggctacgaagccgcccaagcctctggacacctttcgccacatgccacgcccttcgccatagtaccaataaggcacggcgtcaagggctgctggcgaacaggtttcgccaacccacgcccttcgccatagtgccaatatagcacggcgtcaagggctgcgggcgaacaggtttcgccacacgccacacccttcgccatagtaccaataatgtatggcgtcaagggttgggggcgaatataagttgcttccaagctggggggctacgaggccaccctagcctctggagcctttcgccacacccacacccttcgccacagtacccgcgcggtacggcgacaagggctgggggcgaaagtgggttaagtccaagctggagggctacgaagccgcccaagcctctgtcgcgaccgagaaaaatacattttcccaaatgctagtgtattaatccccgtcccaggaaaagccgaggtacaccacacaaacatgatacaaaaggcacatctttattatatcgataatatttacattattacaaaggcacttaaggcctgacaatcaaaaataaacagcagcggactagcgggcctacggctccatcttcacaggtgctcaactggggtataatccaggactccacctaagacttcttctccaaagcttctcttactgaagggggggaaagattgagcaagaatgagtacaaccacagtactcagcaagccacaccggcggatgcatgattaatacaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgaacccctagcagcaggacaccagccctgtgccatgacatctcgactaccgagccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcctgagcttaatccttatagtacccgaggtacgactaacaaaacccaaccacgcacctcgagcccagcctaaaaccattttgggggttttgaatagagggggaggtgtgtgtccaattccatcataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaagataaataggcatgactaaataaaacaatgataacgcgggaatttaaataaagcgataatgcattaatttaaatcaaaataattttataaactgggattcaatatgttcaaggatgatgtgacttgccttgctcagagagaacggccttccgaaccttcggcgacgaccacaaagcacgcttcgggaacctccggaacgacagaagctacgcgaagcacacaagcaaagctacaagcctataaagaagcaataacaatatataaaaagaaagcacacggttctttaggttataacaaacattaagagacttgaacgggtcgattcggagctcgtatgaccaagatatgatcatccgaagtttaatgctgttatatggagatttgcggattattataattaagctttgcaactataaaacatatggaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacatggaaaccacgcggctactgagcggacacactaacacggacactacacggtcaccacccgcacacgtgaacgactaccgacaccggtacacaggtaccggggtcgacaaccgcacaacgggtacggggcgacaccgaaaggacgaggacggggcagcgagaggagagatccttaccaccacgcgacaaggcgtgggaaagacaacgacgaacgggtgcggcggagacggacggcgagggaacgacttcggcggcgatccttgaacgaaggcgagacacggccggcacgaggcttgacgacgcggaggcgaggacgaagacgatgatggggctgcggcacttgacgaagcgaggacgacgaacgagaacggctggacggagggacgaacgccacgacgaccaggaacgacgagagggcgacgacgacgacgaccggggccggcgagaaagcgacgagggcagccggcagcggctgcacggagacgaggacggcgcggaacacgccgctgcgatgccgacgacggaggcggcgccgcgagacgacgagccggcgaggaggaacgatgacgacgacgacgaacaccggcggggttcggtcgaaggggagacgaggccgagggtgaccttgccgctgcgatgccggaggtggtggtggcgcagcgagccgatgagccggggaggagggaggggcggccgaagggacgccggcgacgaagaggatggagaggccggcgcgggcgacggcggtctccgaacgaatcagagggtaggccggggtggaggtcgacgcggcgacgccgagggaggagacggcgcggccggcccgcacttgagcggtgcggcaggggcggctggaggcagtgggtggcggcaatgccacccgttgccggtggggacgcgcctccggcggtcaccgcgcgaaacggagggcaggccggggagaggaggcggctgcgacgccggggaaggcggcggcacggccggccggcgcacgggtgaggagggagaggcggctggaggcggttgacgtgggggaaagagaagggcgacgacggggaggggtgatacgaccacggggaggctcgggatgaggctaaaacgagagaacggagcgagggggttccgttttataggcgtggggagggagctggccacgggaggagcggggaacggtggcagaaaaggcgcccggcggccatggaaggcggccatgaatggcgcagccgttccggtcaaaatagtgcacgattaaaggggagattagggggaaaagggagaggaaggaaaggggattaattccccccaattaattttggaatccaatgcttaaatcgtgcggtttcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggcttggctcggcctggcttgggccgggctgctgggccgaggcaggccgagaggaaggaggaggagggagtgagctgcccgggaggaaagagagaaaaacaaagagaggggagagggatttggactgtgggccgagggggagagagggagactttgggccagacttggcccaaagggaggagggggattatttttagctttttctttttaataaactttgttaattgttgttgtttaataaatattttcggtgctctgaaaattcaagtaaaatttgagggctccttttagaccaaggagaatttaacaaaaattctccggaccacattcgaatttttctagcaggtattttagtgtttgtcaatttctttttgaattttaattaattctattattccttttagaaaataatttttatttcgggatgaatttatcagggcgtgacagcctctgcacacctttcgccacacgccacgcccttccccatagtaccaataaggcacggcatcaagggctgcgggcgaacaggtttcgccaacccacgcccttcgccatagtgccaatatggcacggcgtcaagggctgcgggcgaagaggtttcgccacacgccatacccttcgccatagtaccaatgaggtacggcctcaagggttgcgggcgaggaggtttcgcccacccacgcccttcaccatcaaaccaatgaggtacagcgtcaagggttgcgggtaaagaggtttcgtccacccacgcccttcgccatagcgccaataaggcacggcgtcaagggctgcgggcgaacgggtatcaccaacccatgccctgcgccatagtaccaataaggtacggcgtcatgggcttgcgagcgaagaggtttcgtccacccacgcccttcgccatagtgccaataaggcacggcgtcaagggctgcgggcgaataggtttcgctaacccacgcccttcgccatagtgccaatgtggcacggcgtcaagggctacgggcgaagatgtttcgccacatgccatacccttcgccatagtaccaatgaggtacggcgtcaagggttgcaggcgaagaggtttcgtctacccacgccctttgccttagtgccaataaggcatggcgtcaagggctgcgggtgaacaggtttcgccaacccacgcccttcgccacagtgccaatatggcacggcgtcaagggctgcgggcgaagaggtttcaccacacgccatgcccttcgccatagtgccaatgaggtacggcgtcaagggttgcgggcgaacaggtttcgcccacccacgccctttgccatagtaccaataaggtatggcgtcaagtgctgggggcgaaaataagttgcttccaagctggggggctacgaggacaccctagcctctggagcctttcgccacacccacacccttcaccacagtacccgcaaggtacggcgataagagctgggaacgaaaatgagttgcttccaagcttgtcacgaccggaaataacccaacgggcgttccttacgtgcgtgtattattccttgtcctaggaggcaaggtacaccaaaagttgatacaatatagagtttaacaagcgggagcgtaactagataatttattacatgggcagcgaaggcccagcacacatgaagacaaacgaaaaacagcggaagactagggcgacgaccacaggcgcttgatggcaggcacgagctagacaccaaagccttcatcttccaggaactcctcttctgggtttgggaaaaattgagcaagactgagtacaactaccgtactcaacaagacacacccataagtgcagaataaatgcaagggagtacaagggagccataatatagggggttagggtttgcagtaaacagcattaaaagtcacttagttgctcaaagctactttgtaaacacgatcctagagctatgcaatattattaatcaaggccgtgaacccacacgaacctgccttaacccaaggcctacgatgattcagatcgaactggcaacccaaccctgggtcccagctcgtcccaagccaacccaggccaaccattccacatttagttgttaagcaggttttatgaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccagccctgtgccatgacatctcgactaccgggccgtagctcatgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgagaagaggaggaggtgtgaatccaattccacaataatccaaccattccatagtgtccaggtgataagaatattcccaaagtttagagttgtaaaaccacctaatgttgcctaattaagcagcgaagcatctacctaaattcatactagtggtaccatggatagagtatccactagttggggttttatttattctagggtgaacaaggtaataataacaataacaaaaataataaggtcataacaaaggtaaaaaggcatggctaaataaaacagtgataacgcgggaatataaataaagcgataatgcaataatttaaatcaaaataattttataaactgggattcaatatgttcaaggatgatgtgacttgccttgctcgctttcccaaacgtcggcttcaacctccacgtagagcggatcttccgaagctgtagcgtctgcacgatcaacggaaagaaaaaaggcttttactctaataaactccatataacaagcaggaacaaagcacaaaaatgggttcttaacttcttaaggaaaaattagagacttgaacggtccaattccgagttcaaatggccaagttatggccatttgaagttcatatgctctttaaatgaatatttacgaatttcttcatttaaattttaatttaaaaatggtttattgcgtcagccgaggggagagggcgcgcggaccgggtccatgggagtggggcccacgcggcagcctcacggtccacggtccacggtggcccactcggcgcgcccgagtgcggctaagccggcgcggtcggcgggaggcggcgcccccgtgccccgttggtcgccgccggcgaccaccagcgcggcggagcggcggccgagagaggggagggaagggggaaaggaggcgacggtccacggctcaccccggggcgacggcggcgatgagggaggcggccggagcggagggaggcggtggcgcggctcgggttgatggggtcggcggcgctccggcggtcggcgaccgaaacggagaggtggacgaggtcggcgaggatgcggcgaagccaaaggaggcggcgccgaggtgggaggcggtccggggcgacgatggcggcgtacaagagctcggcggcgacggcggagagagaaagcgacgtcgcgagctcgaatccggcgaggaggaagggcggcgagaggtggaaacggacggaggaggtgcggggagggtttaaatagggttggaagggggagagagtggccggggaggtaggaaaccggcgcgggaggtccggccgccatcaatggcgccggcgagatttgcgggggcaaatccgtccgtttgaaaccgagagagagagggaaaaatggggggaaaggaagagggaatcacggggagtatttccccccactttattgcacgcggggacggcgggatgcggtggattcgcggcggcggcggcgctagggcgcgggcgaagcggcggaagcggcgggagcggcgggaggtcagggatgacgggtgggccccacccgtcagcgagggtggcgggcaggctcgcccgtcagcggcgcgcgcgtggggagaggccgagtgggccgcggggagagaagagagagagagggggaaggagagatgggccgggccggcccaagggagggaagggggacttttagggtttttctttttataaaaccttttcaactttgtttatttcttaataattattatttgtgctctgaaaattccactaaaatttatttacacattttaggcttttagggaatatacaaaaatcctctaagccttatttgacttttaactttgcacattttaattgttggaggctttcacaaggattttaattattctagccataatttaaaggatatatttttgggtcattttgggacgtgacattgagcatcacttccagaaatgatcttttgggacttggttaggtcagcgacattcttgatagccgatttaagccttgctttttgctcttcgacagattttgggagatcggctagctttttgtgctccatatccaattcagcattgcattcttcaagctgtgccaagagatcgttcttgcgggcttcaagccaatcgatattggatttgattggaccttcggatagctgatcgagtttgactttgtcttcatgcacaagctgccgattgacttggattgtggcttcaatctctttgcgctcacggcgttcggctaatcttagcttggctttttctagtttaaattgatgctgctcaagataagcggctgcagttaggacatcggccagttcttcaggaattagagcttgtacttcgtgcaatcgtgtcctaatcgatccacagtcgaccactaagctatccagagaagaggcctctagctgacacgagatatcttcaagtgttttctttgcatcgtcagataagggagctagagctttgcttgaagtatcttcttctgcctcatcaagataatctttgatatcaaaagagaagagatcggctagaacctgcaggtataagtttagaaagtttgagagctaagtcaatatagtcgatctaaattcttgcatcaaaggaaaacttactgggatagcaggagcagccgattgttcttcttccacaatatgatgactccccacggccgatggagctcggtcactcgatgattgttgtacaggagaaaaagaaggagcaggctgtaaaaagacaagtgttagaaaaaatcggctgaaatcaactagtaaaattgagagtgtcttactggtagagctggtttgagaattggagctgccgatttcttttttatagcagttttcttcttctgtaactacaaaacctatgagtagttggttgaagaataatgattataaaagggtttgcaaggaaagatgttttactctgaagaagtgagtgggggcagaaggagttgaaggtatctgcttaggcgaagccgatggtgttttttcagtatcacttacttcggctgcagcctgatcaacatcatcctcaatatctttttcatccacagcttgttcaatggatggatccaaagcaggcatgtcgtcggttggcttggttttcttagacttggcctttttctttggagctagagtcaaggtgctcacaaccgatgatctagttttccttttcttggttacatcggttggttctctgatggcgccttggaggagggttgagaccttgggggcatgatagccgatgacagggggagacaattcgcctccattaggaatcagacctggggcatattcattgttcctaccaatattgctctgatgtggacgggaggactctgttgtctgcaaaacagggacaaaagattagtcaagtaatgaatcgactaaccgttatgaaatttagtgatgacaaagtttacctggggtatgatgtcagggaatagatctgtcatgtacattgtggccaattaataaaatagatgcaatttccattcaccccaccatctgtcaaagttcctgctcctgaatcttgctaactcaatattatagggtaatagaattcgtaggagacttggatatttcctccttggtgaataccgacaggtaggatgcatgggctgattgcagctgtaaagacttccctggacgtttgatatctttcatgattgatgtcttcaaatctgaagtctaataggagctcaaggtctgctgagtcttcataaagaaaccaaacctgggcatctttctggaagccttcaaaaaagctgcagaaccaatctttgagcagctcagccgatagttttgcaccagcatcggttggtgtggatgcatattctccatatgacatggatctgcgatgggtgcgttcttctccattgtcttctacaattgggtccaaccttgggaattcagcttctgttacagatggccgattgacaactttcatgactaccaagcttagccaggtctgcagtagcctccatggtccacctgctccaactattgagccgacggctatcttagccgatgcattgtttaacatttggtatagatagccgagaaggattttgcctaagggaaattgtttctttgatcctaaggcttcggctacaaattgccaattggttgtgggaccacagctggatccacagaagagaaacttttctagccacataagcaagaaagctacgtactcccgaggtgtgacaggccctttgcccatgtatgtcgctacataaccagaccaccctcctatgcttttggtcttgaagtcaaattggttcttggtgttcatactcgtagggttagctgatgaagttacatctaatccagtaatcatgataatgtctatcaaaattggagtcatcggcctttggttaaataagaaggcattgatggtgttggaccagaaataggtggcggtagccatcagaggttcatccttagcagaattggctatggtgagagcaagcgcttggcctatcccaatctcatcccagtgggctttcttactagccgatatgcgttggtaccaggtggtccagctcttatcaggggtaggcttttcgagagatggccaagacttccagtgacccaagttagggttggctagtctaaaggggattctgttggtttcaccaatgataaaatcagtggggtcaagattgccgattgggccaagaaaatagtagtttttgtgcgataggctgggaatcataactagattggaaagatgctgcaaatccaaaggaatcgggaagcagaaaacataataagaaaaggagaaatcgatttcatgcgaggaaaagagatctagccggtgagaacttacctcagcgtacttggccaatggcgcagtagatgggctagtagaagacgacatcgccgtaggcggagatctgatcaaaagcgaaatcgcctggggatcgcttttgtgtcggaggaatcgccggagagacaaaggacaaagtttcgcttgagcgggaaaacggaagtcacggcgtgagatttctcgagggcaatggttggcatttaaagcgatagaataacggtcgaaaaatggcagagtgcgaaacttgctcggagtcggtacaaggcaaatccggaacattatcaaatatcccggacttggggggcatgtgttaacgaccaaatttggtaatatcagcatcggaaaaggagattagatcaaggtggagtcgaaggcggagattaatccgagaacagagcaagaatcagctgaactccagatcggctacgattaggatcggctgggtctgaatcggactaggtgagccgatgcagccgattctgatagtataatttggtgtatgacattgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatagtggttgtgtccggtatggacatatcttgtaattcttgggtataaatagaccccgagccctatgtaattggtaacacacacgttcaatacaatttcggcgcatcgccacctttttgctttagttttgtttcgacgagttcttgcttttgggttgagctgcatcggtttcgatcttgaacaagaggtaaaacttgttatgacgacttgcgttctcgagattagtgcttccatctttatgacactctaatcttgtctatataattcgtcaagttatcatatatcctacataatctttggcaatatcatcatctaacctataatcggctaatatctgttaatagaaggcagccgattaggttaaatagcgacgttgtcctagattatataagatatctaccactttatgaaacacccaacggcttgattgtctagatattgttcttcttttcatacttaatgctgcatcagttgagtttgatctattaagtcgtgcttagaatatcaatctctagcctgtcctctggttgccgattagggtagcatcggagtttcagccg

SEQ ID NO: 64513 - DNA, 16583 bp, Oryza sativa
tatcggagtattagcggatacatgctagatctatctgattggctatgctataaacatatataatcatgttattaatatatatttcgatataagtgatttatactgtctcggcatggtgaccgatctatcccaatcacttgatttaagtatatattaatataagaactatatatcgttaatatctacagccgatcgaatagatttagttccttactatatatttataaccgccgatcgattcacatatgacatcggcttaaagataaatgatatgtcattggtacctagccgatcggctatcatttatagatttaaccacgaattctttgtctctatttcttgttgattacaggatcaaatcaactggcacgctcatacattcgaaggcgagttttggacctgcactggaattaagcagatctcccaggcctcgtgttttttgccaacagtattgtacctgtatataatttgcgcatagttttgaataaccgaagatgactggcgtcgcgaactagcagtttgctgaaatctctgacatatgcaaacaaagtcggaattatactggagcgagaagctccacgacaccattgaaccaaacgcactctgttcattgactcgatgagattgatctagcacttcaacctcttgtcagtgcctccaaaacctactctgatgaaatctagcaagatggtctttctccttttctgtttgaattgtcatcctcgtgtacttagacatgttgatctcattatgcaaagttaatctcgcgagttaaatgtttgcaagtccatagtccagttggagcagagttagtcattagttggagcagagttagtcattgataccctttcacttctttcaagaagtatcagggcctatgttcttggagaccatggggagttgcttcgacaaaattaaagtattagagagctaacgattcataaagaaacccaaacttatatacaaactttccggtcagttttagtcgacttacacccttgattttgactgtagggaatcaggtagataaatttgttgaaaagaaaattatggatatgtgatcttttactaatcatcattgggcatgttttcttgaattcgcaataaccgatgctcatttggtttgtctggaatgcatgttttgtttttcctcacggtcaaacccatgagctatcagagtcccagttccattgattatagagaaattaatgctagtagttctgatttcttataataaatagtacattgatgttagaacaaaatccaacattcatgacaagagcaagtccaacatgtatggcaagagcatccctccaatgagagggagcccaagtttgatcccgtgagaaccacgagagtggatcagagaggatgagaatggatggaatgggggagccagatctccctctcttgcccttgagggcttattttattcatatgtcacaggaaattatatttatgctcttgatttgctatatatgtacaatatcctcttgaaggtattttagtccttttatacaccagtttatacaacactttaagtgtggggttattccctaacaattgacacaatactcacgtaggtctctagtagaggtgtaaggtaaagatgtaccaacaaaaaaaacattcagtgattatcacagtgcactggtttgtatcaccccgcagtagcgagttcctgctgtcgtgagttgtcataccagaggaaacaattctgaagatgagtaacccatctttttagtgtatatggtgggccatttcttccagaggtttctcattcctaccattatttcctcatatattgccaatgcgattcttttgggaggagaagaaagcatagtgtatgatcaaatctatctatctattatatactaaaaatccattaaactttctacaaatactctcgagctgtcaggcacacttacaaacactccctacaaacactctcaagctgccacgtggcacacctacaaacactcatgggttgccacatggcactatctgatcttaccgtcgattttcaattaaattggtggccccgatattttcaaccattagattagatttcttattaaaaggaactgaagtatacgtacacatgatatatatccacacctacgtacgttaaaaacaaacaaagcttaccttctgttcccgaaaagaagaaaaatagtacacacgtacttacggaaagaaaaaaatataaagtaggaaatacatatgtgatatgtacctgtaacagcaatgaaaaaaaaatcaactacaaaataagattttctaccgtcaatcaaatatattactttacaaatttacgtaaatatatacagttaaactagatatataatataaatataaaatattcaatctacactgtttaaacgttcagattattttaaaattatatatccacatagcactatctattctcaccgttaatttttatctaaattagtggctctaatattatagaccattagatctattagttaaaaagtaatacatttaccatgtatccgtataaaaaatatatctgtatgtacgtatgattaaagaaaccaatatagcttacctactatttgaacaggaagaaaaaaaaaacagacgcgtacttacttaaaaaaacgatagagcaaaaaaaaattaggcacatctaatacgcgtggaaaaaatcgatggtctttaaactagaatttattttctacgattaataaaatatatttctcaaaaaatttagcaaatatacacagttaaactagatctataaatataaatataaaatatgcaatcaactctctttgcacgttgtcttagaaattattataaaattatgtatccacatagcattatatagtctatagtctcaccgttaattttcacttaaatattattaaaaaattaatattttcctcatatatacatgtacatgagaaatatatcctcataatttaattagcttacctgctgttcacgggaagaaaaaacatatgcgtacatctaacatataccagtggaaaataatcgacggtatttgaaattggattttctacaattgataaaatatattaatttacacatataaacaaatatacgtagttaaactagatctataatataaatatacaatatccaatcaacactctttaaacatcctatcttctaaattattttaaaattatctatccaaattacgatcctgttttattttttagttaaatatacatttgatgtttagggtcctaaatacgtcacaacacatgagaccaacatgtaataataataataatattatgagaagtatttaaataatttccatcatgttttagggtgtgaaatatatcatttcacaaatataaaacactaatttaaatctacatatgtaaaaccaatcaaaaaaacacaatttttttcatgtagatttgattttcaaagtttttttgttggattttttataacaatttgattgcatttgagaagtgagcaacatagacgtgtaaatattatcaaaatattttcaaccaatgaacttgctataatagagccccttaatccatcgtgagatttatggctatacatgtatgtattttctctttgccaaatagttttgataacaaataaacaatcacataacatgtgcaattaaatacttatcatgtatgtttttatagttgaggaagtcctccgtgtcagttattacccaaaacatgtctaaaatgaagtcaaagaatttttcaaaaattcaagcaaacattaaacaaggtgcccgcgtatattgcaggtccattaaacttcctacaaacgttctcaggccatcacgtggctcctacaaactctcctaagccgtcacgtggcactctgataaattagagaaatataagatattccaagaaaaaaaaacgaaaacatcctaccattgattttcacttaatatggtggacccatcattttacaccattagatctatatatgttaaacaaaaatgtcacgtacatccatacctctcccacctctcctcatacgtacgttcatccaaattaagtacgtctccccacccctctcttcttcctttccatttacagtagcaaaatttttatatataaaaacaacgtaactaaataattagaatatcttataatatattctattttaatgtgaactatatttacatatatttgcgcgtacatatataagaaatatatcatttgacataatctcctttatatcacaactaaatagtaataaaatatttaaaaaataacatatatcatgtctcctactcactttcttatccatatcttctatagccagcagctcaatacgtaaacaataaaaaatgctatatattaaaagtccattaaacttcctacaaacactctcaaactataacatggtgttctacaaatactcctaagatgccatatgacgctcaaataaactaaaaaatagaaattatgataaaaaaaatcgaaccattgattttcctttgaatagatgaacccaataattataactactacattgcacataaataaatctgttacccccacctccaccgctaccgtatgtgagcatgcacgtgtgaatgtactccctccaccgtccgactctcctataggatgcaactctcatctcctattttagctaacacataatatataaaaaataatagctaaatgatcatgactctcaagttacatgtacttttctcaatttatttgatctattgtgttatttataattaaatacataattcaagaaccataatgcctatatttactatataaaagttagacaatgctgttgttctgactacaaatatttgagcaaaatagcactttgaaaatgactaaggaattcaaatatgtgagtctaatgtccaagttcaatcactaccaagaaacttgaaactatgatgcatactctgggcctgaacccgatgaaggcggagctacaagacattattagcgaggtggacatcgacggcagcggcaacatagacttccacaagttcatgggcctaatagcacgctagatgattaggtgaagggcaaggactgagaggaggaccagagggagatgttccatgtcttcgacaagaactagaaaacagcttcatctctgccactgagcctcgccacataatgtccactacattaagagaggctcactcatgaggaggtcgacaatgatccgtgaagctaatggtgacaagcggatcactacaaagagttcgtaattaaattcagaaaaaaacaagtaattagattaaaatacatatacaaaaaaaatcattaaaaccatagaaaatataacaagattccatatagaatataaaatatgaagagtccatttatacatgcataagttataaatatttgaaatttggaataataaaataagtattaaaagaagaatccaaatacaacatgatacgagaataagtacattttaaaatccctaaaaaagacaatttataataagaatcactcaataactaaattcaaaatacaataaataattttaaaataatttttatatctttattgattcacatgtataaccaattgcatatatatgaagcaattaaagagagagctagcatgatggtaaaaaaaccagttattaccaatcaaagttggaataattaaatgtcccaatgaaagtttgttgagatttcttcacgaaaaagagatataatgaacactcaattaaaactagaaaaataccttaatttaatttcaatttgttttgttagaactatttttgaaacaaactaatgtgcatgcccgcgcgaatgcgcgggctactatcttcctagttaatataaaagagtgttggtaagagatgccgaaagaagtagtagaatatatattcaagtattcgatcgtataatcaggactctaggttaggtcaatccatcaatgctcagtggcttcccttattaaaagcaaatgactgaatgttcacttgtacttggtagttcactatactgcaaatttgtacatctattctcagtttatagattttacatatgttacatacaagacagccttacagtttataggatgtgtacaataggccagcatagacaaaaaaaaatgtgatgaatgaaataattcagggtaacatttttttttattcaccagatgtttaagtaattcagttattttcacaccgaacatcatactaactgtacagctgtattggatcttctctctgctatcataagcagaatctaggtacctttcaaattcagctctcgaccaatctgacatgtgacatctaactccccatccattttgaaacttgtttagtatttcgaatgtgtcaaaatgaacaaacaataatttgcatgactacatcttaactgaacaattaaattacacaaatatgtaagaaaaaaatatcattggcgcattgaactaatgcttgcagaggaactttatttttttttactaacggaatgtggataaccataaactaatttggggaaagatttttcattgttgtcacacattagttgcaatgccattattgatgtgaatataaaactccatataaaattcaagattcaagaacaagaagatctttcatgtgatggaatggtcacaggcaacaacaggagccgtacctcattcatctcaagagaattgcacagacgcaacaatactcagttgttcgatacaatgctcctttctttcaaatgccacacaaaagtatgttggaaacaatcttgtcatgtggatgagttgaattaatcatgtgcatttgttagtgtggttgattagccatgaatggtgtttttgtgtcattgtaaccagcttgtcaagttgcaaagataagcaacaaaattaaaatgcactagaaattgtgcgcggtgccaccaaaattatgtgtatcgggtgttctcgttccaaatgaatgtgaagctgtctccactatgttcgtgttaatccttatattcccaagaaagcaaagctagcacagcatccacaatcgcaacgcagtacaaagcaatatgtttttcaactaaagttttcaaacagagaagcaaattttccctggaattttactaattgagattcgagttccatcaaaagctgaatgcaaccgagtgtataaagatcgataatggaccaacatttttccttgaagaaatgttcttggcatgtgtgttgtgttggaacaatttctgctcaggaggaatggaggtcacaacctacagaactagggagatttaccatggcaatgatccatgattgacaccgttgactgcagcgagtcgcagctctagtgaactgctatagcagaggcatcaattccgatgaaatatagcccctcctttgtttatggtacgctatttcttccagaggcttctcattcctatcactatttcacttgatcaaagtacagagaattctactcatcacagtaaggtatactacatgcaaaagtgattcttttgggccgaagaagaaagcatagggggcatgtggggaatgatatattgatcaaagagtgtcgtgataagagagtaagagataccataagaagtataacgtatattgaactatttgatgggacaatatatcagaagtctagtcaatctattacactcaaatgcgacctccctcgttcaaaagtttggttgattcaatccatgccattataaaaaaaaggaaaaagtacgaaccatctgaacaatcttggccaaccgtattacccccctagactcaaatgccagatattttacacccctcaattattcttaccggacgaattacaccctaacactgttttgagttattttgaccggaagtttgcacgcgtggcgtcaacgtgtcaatccagtcaaaaaaaaataataacaataaatttgtagggctcacatgccatctatatcttctcttcctcaatctctcctctccccccttctctttcccactcttttcagctcgggatgggcggcggctagattgaggaagcgggaaaggtagggctcgggacggggccagcggccggtggtggaggcgggagaggcagtgctcaggacatgggtagcggccggtggcggaggcggctggaggcagggctcgggatgggggcggctgccagtggcggaggcagctggaggcaggactaggccccttctcttttcctcttcccgagtagttgggaatgggacaacgaacgcctgggagtggttgcgctcgggatgagagtggcagccggaggcgaggcaatgaacgggctcgtcggctggcggcggaggcgtctagaggttcggctcggcgccctctcttcagcggttgggaatggggccgacggccggtggcaaaggaggggctcgggatgagagcggcgtcaaggagaaggctaggaatgggggttgcggaggtggttcttcctctgaggcgaggctaggaataagtctattttgcctccgtcaactcatgctccatgttgaatcgcattcctcaacccctaaactgggtataacctgtccgccaactttcaaaaccattgcaaatcgatttcccggacggtttcagacatgaataagttcaccagccgtccctcaacttttcggcgagtttgtaggaaatgtctaatccccaatacgagacatatttacccctaaactatacgaaaccatgcaatttgggtcccgtaacaatatgtatcactggtttcgctgacgtagcatcctagtcagtaaaataaaaaaataaaaaattatgaggctcacatgcatgtaaatgaggtggctggcgggagatggggaagggaagaggcggccagcgagcctgggagaggaggcggcagcgacggcaaccacgagaatggtatatcgacagcagcatgcgaacgtcgaaagcagcgccatgggtaagcgcccgcggcagcggatcactagtcgtcaacaacgctgctccggtgggtgcaaacgcacgcacccaactacacccaggtcgtcgtcttcctcacgctcgctgtcttcggcgccgtcctcctgctcccgactgggctcccgctcgctgtctccatcatcgcgctctgcccatcgtgctgctcaccagccctatctaggtgcatgtagccatcccagtcacagacgaggcagcagcatccttccatggtcagaaaacaagcactgaaaacatcgttgccagggccatcatctgcttcaatgatcgatatgtaagcacatcactgacagttcgtattcaaacttgagcagtgattgaaacaatttcagccaaagaaaaaggaaaaaagagttccagcagaaaacggactctgtttatgatattctgcaatcttggatgcgtgcgttcttgcattggtggtcgggtgtagatctacagcggatgccaggggacagcacaggctggggtgggagggcgtgctgcgtgtgccgtcggaggcggaaggatctggcttcccgcccctcgggagtggcggtggctgaggggacgagcggcgccggcacgcggatccaataccaccgctagcagcaaccgcccgtatggcatcccgccgccatcgccacactagccccttctcccctcccccatctcccgctgcccgcctctcccatgacccaccctcttcagctggccgcgtcgggttgggacaaaaagagaagaagaggaggatagctatcatgtgggcccacacatacgttttgttattgttttgttgactaggaagccacgtcagcgagactagatatatatactgttataagaccaaaattgcacggttttatatagtttaggggtgaagatttttttatattggggattagagatgttgtacaaactagacgtaaagttgagggatgacatgtgaacttatttctctcagaggcgattccgtcctacgtgggaccaaacagcccaacaagggaagtagcggcccatgagggcacgacgggcccaaatagccccaaactcctcagacgggtgggctcacaatggttcatgggtattcaaatgaaaacccaaaattttttttaaaaaaatacacatgtgaagtatatattccatatgtatatgacatgtgaacttatttctctcggtaaaaagtacatcgaaggtccctcatgttgtcatcgggttacaaaatcatcctccaactacaaaaccaggtaaatcacatccctaatcttacaacaccgggtcactttaggtccctaggtggttttcactctggttttgtccgatgtggcagctgagtcagcgtgggatcccacgtgggtcctacacatcagcctcttcttcccctcctcctctctccacggctgacgcctgacggaggctagctgtgcgcggcatgccgatgcggcgggagcgggcgcgggcgaaggccggcagggtgcgggcgacggccggcgggcacgagcggcggcggcggcgtcaccgagctcggccaagcatcagcgcgcaaagagagagcggtggcaacaatcccgtgtctgtatcagccttcttcccgacggcggggagcagctaaactatgggatggttgacgtcacgcccgcagcctttttccaccagacgcaccaccatcaccccaacctcaccggcaacggcaatgatgaactccctccaccattccccttccttccgccatcgccctccttcgcctctccccacctcgccggcgacgacgacaacagcaacgacacgagcgcaaggtatgtgagcacctccttcctctccgccccaagtattgccaccatcgccaccacagccgctggtagcagcctcagctcctcttcgccaatgtcgctgctgcctacatcctctgcgccggccagctcctctccgcggagagctccacccgccaccgtcaccgcggcgctcaagggcctccccgagcgtcgacttgtgcttccgccgctcggcggcatgctcctgcacctccttcccggtgtgcttcgctgctccttagccacccacaacttccatgaactctttcatgcgctgctcttgttcctcaaccttccttgtcagctccgccacggcctcgccatgcgccgcatcccgtgcccccactgcagcgaagacggcgtgcatatgttgtcgcacaccccttcctctcctgcagcgcgggctctatatgcggcgaccaccggcaccgccgcctcccgtcggtcagtctcgtgcactggaaagagatggtggaagagaaaggaaagaggaagaggagctgaggctgttgtcggtggctgtggtggagatggcgacggtgctcggggtggttgaaggcgttggcggagagggcgagaaagagcgtcgggcgtcgccgtctctgttgccttcgctgagcacccctcccccccgcctcgaaggtctcacacacggacagaaaggggaggaggagaaggaggaagtgcccaggtcgtggtcggtgacgccgccgccaccgcccgccacccatctttgccagcgagcgccgccgatggccgccacttgtctttgccagggagcgtcgccgtcgcgccgcgcccttgttgtcaatcgccaagaagaggactgcaggacggaggaagagaggtagagagagtagtgcaaatagtcgctgacaggtgggcccacatggggacgacgctaactcagatgccacgtcatctaaaaccggagacaataccgtcgaggaacctagtttgcagttttgcactgttttgtaagttggaggatgtatcatgtcgggttttgtggttcaagggtgattttgtaattcaatgacaagacgagggaccttcggtgtactcatccaaaagaagcccaaacctatccctcccaccatcttcctctccccactttttaaggcccattggcccaatagcaaaaaaaaatatggcccaaactctatcaaaccctatctcctcacctccttgttcccaatcccgccgcccggcgacgcccgtcgcccccgcgccatcgcgccgtggccgtcttgccgttgccccgccgctccagtcagcccctccacgcagtcatcacagtaagatatactgcatgcaaaagtgattcttttgggccgaagaagaaagcatgggaggcatgtggggcataatatatcgatcaaagagtgtcgtgataagagagtaagagataccataagaagtataacgtatattgaactatttgatgggacaatactcccttcgtcctattataagtacagccataaatttccgtgcccaacgtttgaccgtccgtcttatttgaaaaaattatgaaaaaattgtaaaagttaagtctcacataaattactattcatattttaccatctaataacaataaaaaaactaatcataaaaatatttcaaataagatagatggtgaaagttgggcactgaaacccacaactgcgcttattatgggacggagggagtatatcagaactctagtcaatctattatacccaaatgcggcctcccttgttcaaaagtttagttgattcaatccatgccattataaaaaaaaggaaaaagtacaaactctctggacaatcgtggctgaccgaattaccccactaagctcaaataccagatattttacacactccattattcatactgaacgaattatgccctaacactgttttgagttgttttgaccaggagtttgcacacatggcgtcaacgtgtcaatccattcagaaaaaataataataattcactctaacaacaaatttgtagggccttccagtcaaaagaaaaaaattgtagggcccacttgtcatatatttcttcttttcctcgatctctcctctcctcctcttttccacactcgtcaggtcgggatgggcggcgactagatggaggaagcgggagaggcagggctcgggacgatgatagcggccggtggcggaggcgggagaggcagtgctcaggataggggtagcagccagtgacaaaggcggctggaggcagggctcgggaagagagcaacagctagtggcggaggcgggactcgggatgggggcggcggccggtggaggaggctgctggaggcaggactaggccccttgtctttccctcttcccaagtagctgggaatgggacaacgaatggctggaagtggttgggctcgggatgagattggcagccgaaggcgaggctatgaaggggctagctcgtcggctaccggcggaggcatctggaggctcgggatgagagcggcggcgtcaagggtgaggctaggaacgggggtggcggccggtggaggacactagtacagatcctctcatctgtgacggcccatcacatgcctaggcaacgtgggccgtcagaacgaagtcatctcaatcgggcctaaatttttgccgttgtagatgtactcgtcagggtgcatattccaatagctcgttaccgatgacactcatctatgacaggctcgaagttaggcccgattgagatgacctccactatctcaatcgggcccaaatactaagcccgtcacagatgagtgtcattggtgacgggctccaaagaaggcccgattgagatggccttaatgcccgttaccgatgactcttatcggtgtcgggcttctatttgtgcccgttagagattagtgtgcagccgttagagatgacatttttttggcccgattgagatatactttgcacactatatatactccagcagtccattgattgtagttatcccactgttcactattttggtgggaggttggagggggcgaatttttgtaatttttttgcaaacaaaaacaggaaaatcataaaagtaagtaaaagggtactaatcatttcctattaatttagtagtacttatgttatgagatgttaactaatattttgttcattgttcagcgatggatcaaagttggatgtacacgactggcttgaggcgtcagtacaaggagtatagagatggcgtattaagttttatgaaagccgcagaggaggataggataagaagaaacgacaagtacatgtgttgtccatgtagcgattgcaggaatgagattttatgggaagatgaaaaggaagtacacactcacttgatacgccggggattcatggagagatacacatgttgggtgaagcatggagagtaagatccgggtactgatggtgcacctgcagacggaagtggtgcagacaatcatgaagaaggagatgaagaagagcatgacatgtttgtcccatctccattgggcggtgaaatggttgatgtggaccctgatctgctgcaagacatgttacgtgacgttgatgacccagctatgaacgagagagattccatgaagttcagtaggttggtcagtgactcggagactcctctatacgcaggatgcaagccaaagcacaccaaattgttagcaacattagacctaatgaagttgaaggctagtagtggatggttagacaagagttttacagaacttttgggaatactaaaggacatgcttcctcaggagaacacattgcccgagaccacatatgaagcaaaataggttctgtgtcccctggggctagaggtccggagaattcacgcatgtccaaacgattgcatattgtaccacaagcaatgcgcggacttagatacttgtcatgtctgcaaggcttctcgatacaagcgaaagaagagcgcgggggagggaaagaagtcaaagcggggtggtccggcgaaggttgtgtggtatctagcaatcattgatcgtttcaagagaatatttgccaaccccaatgaagcaaagttagtacattggcatgccacatagagaaggaatgatggtttgctaaggcaccctgcgaattcgattcaatggaggaatatcgatcaaaaacacaaagactttgctgctgaccccagaaacatgaggatatgtttgtgtactgatggcatgaatcctttcagagacatgagcagttctcacagcacttggccagttcttattgcgaactataacctcccgccatggttgtgcttcaaaaggaaatatattatgttgtgcttgttaatccaaggtccaagacaacccggaatgatatcgatgtgttcttggagcctgttatcgatgaccgtgagattctgtggaaagagggtgtggaaacttgggatgcatatggtcgggagaacttcacgctacgagttccattgttctgcaccattaatgattatcctgcgctgggtaatctttctggacaaactgtgaaaggaagaaggcatgctctgactgtatggaacatacacgcagtaggtggctgaagaaatcaagcaagttggtttacatgggtcataggagatggctccctcaatggtaagaaagaacttgggtctgcccctgcggatttgtccggagatcaggtagacaacatggtgaaggacattactaatgagtttgggaagaaaagaaaacgtaacaaggaggacaagaagaggatgtggaagaaaaaaatccatattttggcggctaccttactgggaagatcttgaggtccgtcattgcattgatctaatgcacgtagagaagaacgtgtgcgattgcttgctggggctattgctgaatatgcctggcaagacaaaggacgggttgaatgcgcgtcttgatctacaggagatgagcattcgcagtgaacttcaacctgttacggatgagaagacaggaagagtgtacctcccaccagcttgccacacattgtcgaatgatgagaagatcgcaatgctatcatgtctggcagatattaaagttccttcgggctattgcgcgagaataagtaagtacgttaaattggaggatctaaagctggttggaatgaagtctcacgattgccacgtgctaatcacacaaatcttgccagttgctatcagaggcattctaccaccacaagtccatcacacgatccaacggctttgtgccttcttcaatgcaatcggtcagaagattatagatctagaagacctagatgggttgtaggccgatattgtcagtaccctgtgtcacttggagatgtattttccactggctttctttgatatcatggttcatctcactattcacctagtgaagcaaacaaaaatatgtgggccagcttttatgagagaaatgtggctgttcaagaggtacatgggaattctgaagtcctacgtacggaacagagcaaaaccagaggggagcatcgttgaaggttacacgactgaggaagccattgagttctgtatcgattacatggccgatactaatcctatcggagttcctacgtctcgccacgaaggaaggttggcaggtgtcaacacaactggcagaaaaagaattattccctatcaagcttcctacgcgcaggctcatttcgcagtgctgcaacatatggctgaagtaaccccatattttgaggagcatttagcgaaggtccgacgggacaatattggtcgatcagatatttggatcaatagagaacatggtgctcgcttcaacgaatggctcaaggatcgtgtagcacggtcgaccgatggcccaagtgagatattacaaaggttggcaaggggtccatcttgggatgttgacacatagcaagggtacgatatcaatggatac

SEQ ID NO: 64514 - DNA, 1277 bp, Oryza sativa
tgttccgttgcagttgggtgaatatccgcaatggtgtcaaagtcgacaaggaaggattcacattaatggacctggccaaggttggatacgcagacgaaccattcatactagcaaagcaggtcgaacagattttgtacataaaagaccccgcaaacaagaagatgcacgtcgttagggatggcaagcaaagaattgtgggtgtggacaacgttgtcgatgaagaataatacaacaagaatcttcatgtgagacctcagatcgaccctgacgatgatcccgaagacgatgtggcttacgttcgttcagaccattcggaaggcatatcactgtaaatgatgtatttaatttgtattggagccttaatgaatgaattgcatatgtttcatgccattccagttaaaactcattgaagaaatggatttgttaattatgtggttttaaaaaattatacttgttattttaaactatatgtgagaaagccaattgttaattgtatgaatttaaaaaagtaatatgaactttaaaatatatgtgagaaaggcaattgtcaattatatgattttaaaaaattaataggaattttaaactatgtaaataagacatttgttaattatatgagataaatcaaatgtaatagcaattttaaatcaggtagaagttaattataaatgatttttataacttaaaaatattttaataagtcatctatgacgggctttagtactatgcccgatagagattatttcatctctatcgggcttagtgctaatgctcgtcacggataggtatcatccgtatcgggaagagtactaacgcccgtcacggatgagtgtcatccgcatcgggcatagtagtctgcctgatagagatgaggattgactagggtttacttagtcaatcctcatccacgggtacttatccaccgccgatgccgcctctcactttctcacactctcactctctcagatccactgccgccgccgcctcctcctcctccgctgccgccgctgacgccgcctcctcctcctccaagccgtcgcctcccgaccactgccgcctccctccacgccccccggttcaagatcccccgccgcctccctccacgcccctggttcaagatccaacgccaccgcctccctccacgcctcccggttcaagatccaccgccgcctcctgctctgagcgccgccaccgcctcccggttcaagatccaccgctgcctcctccctcatcgtccacgagccctcgtggatccggccttcctgaccgccgcagcc

SEQ ID NO: 64515 - DNA, 16396 bp, Oryza sativa
tgcagtggatgaattttgcatgatttttgggggaaatgccatgttgggatgcagtgggctgtgatggaattaatttgtgatttttgggggaaatgccatgttggcatgaagtgggctgtgatggaattaatttctgatttttggggaaaatgccatgttgggatgcagtgggctgtgatggaattaatttgtcatttttgggggaaaatgccatgttgggatgttgtgggctgtgatggatgtatttgtgatgaatgtccaatgatgattgctcataaatagaccctacacacttgtgatttttggggttttttcaataagaacagaccatctacacttgttcattttatttgggggagggggagtggcagtatgggatgttttgcaaaatggatgcatttttgggctggcctcactcttgggccagcctcactcttgttcttgtttaggtttaaatgtgggtttttaatgcataagaacataccctatacacttgtgatttttgggtattttcaataagaacagaccatctacgctggttcattttatttgggggtggagtggcagtatgggatgttttgcaaaatggatgcatttttgggccggcctcactcttgttcaacatgtggacagatcctctacacttgttcttatatggctgcttgcaatattcttgggattttttgggtccaatgggatggatgaattgatgtgagctatgacggttgaattattttgggggaaatgtgagttttggtatgtgacttgtgttttttatagctgtttctttttttgcataaggacagaccctctacacttgttcttaatttcttttgggggtgggggcagttgcaaatgatggtaattaatgcataatttctgagcaaaactgaggccaaacttattatatgtcaagacttgtgtttttttaggtacaaaaataatatatatgtgacttgtgtactatgggctattttgggtgattttgagggatatgggatggatatgcatagggctgttattaaatgaagttagtgcaattatggcatttaggagaatacgaagtgttccggttgccaaatctggtttggtcgggttacttcttgcacggtaccgaccaagacaaggaataaggtcatttctagattgttatcgttactaatttcctagattgctttctaggtcatttctttctgaaaccccgttcacataaattcagtatccaaagctggttgttgtatctatggaaataagagtttcagaatgaaatgatattggatgcaatctaggagtttgctgacgataacgttaggggtctagtgcaattgtatggtaacaaggataggaagggttttggttgcctgtgtgttcaatctgcgtccgcctcgtcagcagatatgtagcatccatgttccttaaggccggagtagacgggatctcgacatcgacatccatatcccactagaacttgcaaccgctgccactatcttatggtagtgacattgatagcaagttcgagtgggatactgatatcgaggtcgagttcccggctgctccggccttattgagcatggatgctatggttccgtcgacaaggagaacacaggtaggagatagaggtacatcaaccgtgacataggacatgtcgcagcaaggcgaaccaatgtcgacgacgactactgggactacttcgagccataatcctaggacccagaataagatttctaaggaagtctacaccataacagaggtggacgatgttggatatccgatggctccgacgaaagctgtcaaaaagttccctacattatgcggagtcctagggaggcggaacttcactattctgaaggaccacatcgatctggtccctcaagaagaaaaagaagaggcctggaggcagttcaaggaaagcttccaataccctacagaggccgaggcaggactcaagcagcaggctatccgcaagatggggaattgttggaaaaatttcaagacaacactggtcacggagtacgtcctcaaccccgcccagccagaaccatttgggaaatacccattcatcacccgaaccatgtgggatgagttccatgccgccaaatcaacgaaagagtctcgggcaaaaagccaggcctaccgtgatctgcaggcaaggaaccttcacccgcaccggcttggcaccggaggctacgcggggaaacaggcaaaatgggacaagaaggatgaagctgcagcagaatctaacaccccgctagtgcttgctgatatcccgttccagcgggcaaggaactgggcaagggtaagggggaagaagaatagtgacggaactctttcgttctcaaatcccgaagatcaagcggtgtaccagaaaatcgtaagttgaacacatagaataaggttcattatgttgtatcgtattcttcgtctaatgcgtcctaactatacccaggtcgaactgaatgctgagagacaggtctcccaagaggtctgctcacaaagacgcgaggatggcatcctcacgaaagcgttgggaaacgaagaacaccgtggacgaacaagtggcattggctccaatgttccatgaaagtttgggtttccccaatacgtgtggcagtacaagaaacacaagctttccaaggcgcagaaagctgcacgccttaaggcccaacttcgggtggagcttaaagaagagcttagagaagagctcactgccgagctgttaggtatggaggctcggatggaggtatgcatcagggataggtcgaccgatgccactcccggtcccatagtacaagtgagccccacgcagaggcatagcagctgcgcatcaactgaggctccagcagaacaacctgaaggcctcgccgcggtggaccacataatggtaaaaatcaacttaataacgcatatattgtattagcaccacaaatacattgcaacatatactaaggacactaatgaatctatcacaggaacccacatcgtgtaccctagtcgttagggtgacaccaggatttgcaattcctgccgcagagggtcaagcgttcaagcctaccccggagacccgagtgcatggggcgcagctactagccggcaatgccaaagttcaggtggacttagttaagcccgattgggttggctacactatcccacacccaccgaatgagaagattctgacccttggggctgcacgtgggacctttattcaatgacccaagcacagcattgagatcaatataactccaaggccagcgccaagttctcatccgtcgccgacgcgtccccatccaacttttatatctctccctcctgccgttgaacaaagagacgaagatctccaattacagtatgatacagattttggggacgacggtatggaggtcgacagcaggccgcacctccccccctcctgccaaaaggagcaagagggcgaaatcttctccacccaagcttgatacaagtagaaaagctgctagaacggggagaggaaaaataaaggtgccattagccccaaagaagcttgatcttggcaaggcgccaatagctcctccaaatcatccagccgaattcacattgggcatggcattggtcggagacgatgccttattcaagatgggccctgcatgcaatgagttgcacgggtactacatggagaagtccaacgcaaggaggaagaacagagagacctccatgttgggccagcacgatggtcagccgttcctcgggtctactgccttcatcaccatagacttcaaagatcaatgggacctctacagggtgcgagcgatcgacaccaacctccttaagtgctactccttataagtatttctgggtacgcgatatggtagtaactgtccataaattatgcttaccctgattcttgtcttgctcgtaggttaacctggaagcatgtccatcgtaaagcaccccatgttgccttactcgatccagctgtcgtcaacgagacaacactgaaaaatgatcgagcaaacatgatgggctatatcaaggactgcttatttgcccgtcaagacaaggacttcattatttgtgcctacaatcaacagtaagcgtgtaccgtacttatactcaaatactcgacgcgtacaactgtagtatgtaactggcaatttaataatttcgcaggcaacattggattcttctggtaataacgccgaactggagtttggtacactaccttaactccaatatcaagccagaaatatacgattggtcggccatcgaatatgccttgaacaaggcatgggaccaatatgtgacaagaggcgggaggcataaggatgggcatcccaaactcggtcacaagaaagacttcccaatacatcaacaagttggcgatcagtgcgggttccatgtgtaacaccccagataaccacgtacctagagtgccacaccaaaaacactcaaaaactactaactcccaaaattattagaaatttcggcagtctcccctgcatatacggacatccacgacaggcagttgtaagataactcaataacaaaataacccacacaatccaaaccatcctaactccataaattccaagtgaaaatatggaccagaactttaaatgacctttacaagttctatgcaaaacttatgcttagcaaaaacatagtctaaaactaaatttcaatagtgtgcaataataatgtgtagtccaagggtgctactcccgccccatgccgatcaatgtcattaggtacctaaaaaccaaattaaacacaagagtgagtaaagaatactcagcaagtacaatattgaactagtaaaacatacacaagatttatgcattaagaaaccaatatgaagggttgggtttactttatttaaacaacgaagtcagaatatagtagttccctcccgggcaggtatgaatatcctcttagcattaccggtaacccgagcaagcgtgatcagcgcttctcaaggatcatgaataaagacccaaattgcactcccatgactacgcatggttcttggataatgtaaacagaacatccggaataatgaaacatgaataacatcgtgaatttgaatatggattgaaacacgaataagtagcataacatcagagccatacgatcagtaatatcaagcaattgaataataattatgcaagtaaaaccaaacaaaacaactcagtttgtccatcacataagtccgtcttgtacttgtcttaactccttcgataatctgactcaactcctccaacgttagaaccctccacacttgtggagcaaaactatacataaaccactatactcaactaatgacagttacaagggatatttactaaaatcgataacctagaacatatagacttttttaccaatttgtattaaataacctatagcagttccctttctgttttatgcataacttgcaaaccgtctaatggaatctagcaaataatataactttggacatctcaacaaaattatctacaactttcatgttgagcacaaaatcagattatgcctctgaaaatcccagattaaagaaaacgaattgctatcctgatttctggacccggtcagcagtactgttttttttttgtttctcccaaaccgtttatcagaattgagtgaaaccagcggaaagatcgggccaaacaatagccttgagtgtctcgagtggtactcagggttcagcagttcgaatcttcctaggctctgtaggcgctatagtagccccgcctgcgaaaataacctcggtgaaaaaaaaaatcctgccccccctccccagggtttcaaatcactttcacaaatctcgtccaagaaacaaaatccaatcacagacattgtaaacttgcaacataaaagcactggattcaaatccatagcaagttaacatcaataaacatgtaaacttaagaaaaaacaacatcgtcatcgccagcgaactcctctgttgcatgcggtggccgccaccgcctccctccccgctccggcaggatctaggagggcagcgagccattgatgcggccggcgctagtcgtcgccgtcctgcagtagtcttcgttgtcgcggccgacgccctccgcccgtgctaccgccgacgcccctcctctccaccggatctaggaggggaggggttgaggagaggggcagcgatgcagctggtggtagtcgtcgtcgcgtgcagtagtcgtcgtcgtcgtcgctcggtaggcgccgtcgtcatcgcttgctgtaggcgtcgtcgtcgacgcgcggtaggcgccgtcccctccgcccgtgccgccacagacgccattcgcctccgctgccaccgaccccctatgcccgcgccgccgccgatgccccctccatcggaaggaaggaaggggaggggagggaaggaatgggggagccggagggaaacgagagagagagagaggagggaatgagtggtggggagaggataagatggtagaagagatgataagatagaacttagattttttttatgtagacatgatttttgcaggcagaccacgtaaggttttgcctctaaaaatcatattttttaaggcggacctcttaagtagtcagcctaaaaaaaattgattttcgcaggcggatgataaaaatcgaccttggattatatttttgtaggcggatatttggctccgagggtcatacccgtctggaaaaataaaaggccaacatcgccaaaaatcgtttttctagtagtgcctaaatcaccaaaatttggccgaaatagaaaatgcaaaccctgggtctgtcaacaaagacattaactggcaactccatgattaataacagcaactgcatatagtaggatcacatcgtcagatatacgtaccccgtgtcattgcgtacggaaatatgcattgtctaaacaaagatgatatactcattatcttttggcatgtctttcctcttccttattgatacccattggacaattgaattttatctttgctcactgttcacattgttgtttatttggaaacaaaccacaattttcattagttatttattcaacttaatttttctacgtcattctcatgcaataattagttcattgtttgtcatgaatggctatgttcagccagccaattaaatcaatattctttcaactaggaaggtagcccgcacacatgcgcgggcatcttgtttaatgtgtttgaaattttcttacaaatgtttttgtgtagttggttttttttattggaatatcttttatactctattcaaatttatttgggatttctatgaatgttggttatgattttcttctagtttcccttgcaacataaaaatttgttaactaacattgtgtgaaagcgtgcagttctgaatttataagaaaatattgtgtcatcaccatgaagttggtttctatgaaactatctatattttgtactgtgggtatttctatactttaagtaataattgcttttatactatctatgtctttgtggattttaggataaattaatttaagattttctattaaacatatagctaatagaactatgtcatataattaaagatagattatacttcgtcgcataaatccgagaaagttaaattttgtgtcaaaatataagggattttagagtagtactacttgtcatatccaaacaactattatttattgtttaccctatcttaccctaaccttcttcccactctctacgtttcttttaattaataaggggtaccatagttccttttttttcttccttgttagctattactgtaaatatgatacgatggttctttactacttgtgaaatataacttgatgtatttttccaatttgttaacacacttggattattgtttttaatctaaatgcttatttataatgtagaaataatccgatagctacgaataacatgaccacttgactaatgataaattacacgtagaatgttgtgtcttcataaggaaaattttcaagaatttcttttattgattatatgctttaggagaccaataaatatatagattatatgccacatagattagtcatttttttaattatatgtagggtgtatattattgatgtcttttaatttatgttttttcatattgcagtatacatatttttttatttacagaaaagtcatgaggatgtagtttttattttgttccatgagattatagacctaatttagttatttgtgtttatgaatgacttattatacagctaggaaagtctgtaggagtcccacgtgacagcttgagagcgtttttagtaagtttaatagacgtttagtatataataatagatagatagatttttaggatttgtctgatttttatagcgcctcacgtgatggtgtaggagtgttttacttctagtacataatataatagatatattataatcagctagttatctaatgtttgattttattttcgtatgaaattttgctaggtagaaaattaaaagatgaaaagagtgatataagatatgcaaatgtacgtacgtacattacgtatacgtacatgagggggagagatgcctgggaggtggtggggtatgggtgggatatttttagatctaacggtgaaaaataatgggtccaccttattaactgaaaatgaaggggtaggatgttttgctttttttctcagaatttctttgatttctctaatttattagagcgccaagtagaggcttaggagcgtttgtagaaagtttcacggagttttagtatataataactaggaagatagcccacgtattcgcgcgggcatgcgtaatagtttgttttgaaaatagttctaaaaaataaattgaaattaaagtaagatgttttctatttttaattgagtgttcattgtatctttcgtctgaagaaatatcgacaaactataattaatgtatttttcccaccctgacaaccctctctttaattgcttcatatatatgcaattcgttatgcatgtgaatcagcaaagatgtaaaagttctttaaaaaatatttcatgtatttcaaatttagtgattcagtctaattttgaatttgtattcaaatcaaattattgttttattctaaattttatttatagggatttttaattgtacttaatctcgtattgtgttctgtttggacttttcttttaatacttattttattattccaaattttagctattttctataactcatacttttatcttactcttgaaattttatattttacctggaatcaaactgtattttttatagttttaatattttcttattttttaatgtatattttaaacaaattgcttgttttattttttttatgaatttagttgcgaactccttgtagttgatccgcttgccaacatcggtctcgttgatcatctcgtcgacctgctcattagtgagtctctcatgatgcattgaacatgatgtggcggggcttggcgttagagatgaagccattttctactccttgacgaagacgcgaaacatcttcctctgcccctcctctcggtacttgtcctttagcatgccattaggcccgagaactcgtggaagttaatgctaccattgcgtgtccacctgactaataatgtcttgtagctccgctttcattgggttcagagtatgtatcatggttccaagctctttggttccaagctctttggtggttattgaacctatactttaaactcacatatttgaattcattcattgttttcaaagtgctattttgctcaaatatttgtagtcagaacaaccaaattatctaacttttatatagtaaatatgggcaatatggatcttggattttgtatttaattatcaataacacaagaaatcaaataaattgagaaaagtgcatgtagcttgagagtcatgatcatttagctattgttatcttttatatattttgtgttagctagaaaataagaaaggttagctagaaaataggagatgagagtgggaaccaagaggagagtaggacggtggaggagtacgtagaaaataggagatgagagtgggaaccaagaggagagtaggacggtggaggagtacgtacgtgcgtggccacatatggtgggggtggaggtgggggtaccggattttttttgatataatagttaaaattattgggttacctatttaaagaaaaatcaatgtttttagattatttttttctttttaattataatttgcatgatttatttttaaatttattagagccccacatgacatcttagaagcgtttgtaaaacgccacgtgacagtttaagaacgtttgtagggagtttaatatacttttagtatataatctaatataatgttcccgcaaaattatttttttatgatttaaaatatactcaaaactgagtttttaattgttgatttaattgtaaagaatatgatgtttcaaacggatcagaaatcaaatgtataacttaatacttagtataagcgtgtaaaagcagggaggcacatacgtagaattagaaagaggtagtgcacgcgcgcttaaaaaccacctgataacccaaatgcctaaaattaattaatttatattccaaaagctttgtgaaatttatatgaaatcaaagatagccttgctgcactactacgtggaatcaaagtgataagccagctgtaaggtgacagatcaaacaaagagatggaagttgcttgcattgcttatattgatacagcagtcggtagaactgctccatatatcgatgaaggattttctttatctgattgtttgcttacaaaatatattaaaaactatagtaattattttgaactcatcgaaccgttgatttcttgataaaaaaatgattgcttagaaataggaaagagaataggaggggaggggcagcaaaagagaggagaggaggtgtgcgtacggaaataggcgaggtgtacagatcaacctaatctaagtagatctaatctaagtatcttacgctggaaataggtggtttttgttgttttcttattgagataaatttaatggtgcaaaataatgggtccaccaatttaaataaaaattaacggtcggatgttttacttttttctagaatttctagtattttctctattttattagaatgccacgtggcggtatgagagcgtttgtagaaagtttcatgcacttttagtatataatagacagaagatagatagatatatgccctttatcgctgaaccagcatatatatatgcatcctttgtgaacctggtgaccagagctggccacaataaacgcacatcttcatcgttagctatttactgtatgtatctttccagttgctgcacgcaccaacactatatgaacaaaccaggactcttttctaaaaacaaaaaaaacattaagtcgagtagcaagctgtagaactaaaatatgggtgcagtatgctatctatataggtataaggggcatctggaaaataggtttggatttgagggatcagaaacgtggattgagaatgcgggcagccactggtgaagaaaccgtttgtagtcccggttcgtaactaaagatcgctatctttagtcccgggtgaaataacttggactaaagatcaatctttagtcccggttggtgttaccaaccgggactaaagatcgagctgatctttttttatttgcatggccctgttactgcatgggttatatatatatatatatatatatatatatatatatatatatatatatatatatatatataaaccatgcatatatatatatgtttcaatacatatatatttataatatatatatatatattatatttatatatgtttcaatacatatacatgcataatatatatgtatttatacatatatatatgcaaatgcatatgtatatatatattaaagcacttaacattttatgtgcatatatatgaccaaaatatatatttaccctaaagtaaatgtgtacatgcatatagaaaaatagacatgcattaattacaattcattatgatgtcctagctagctacgacttcgacgtagtagtagtcgttatctcagaagctaacgacctatgaattatatttccgtcgtagtagaattcaccctcgggatcaaggatttattcgttgatgaatcccataagttgttcttgaaccgccgcgataaattccttatgtgtgagcttatccctcatgtgaataacctatgaatgtatgaaattaattagtaaacaacaaatcgatacgtacgcaatgaaattttcaatttatttgtatgtacatcgagctctcttgtgttgatgatttggtctgcaaggcagtggcaatactcgcacacgtagtaaccgcacaagttaattccctgatcttactttgcgcactatatatacatgacaaacggtgagagatctaattaatatacacttgtatttgaattggagattcaatataaatgtagagcatgtgtactcacatgaaagttaaacttccgcctaagtctttctctccatttgcagcggaccaaatgtcggaaccgataccaagccctacatggagtttaaagctatggttcgtagtagcaattaattataacaagactcataattaacattggaacatatgacagtacctgctataagtttcaaaaatctagtcaaacgtagacttctttttatctattgagtcatatacattgactacgcaggcctccaagtcgaagagtaaacggacccagtggaatctgcaatgtgcgtcggatgtattacatatgaaacacttagcatgttcgtacgggaatgaaatttggtaagaagacagtaaaaactaactctgtgttgtacggcaatagtataaacgtcttgtaatgctgcgctttaaggagatggacgagattgtcctctgtggcttgcggatactggtcgagcattgcgacgtttactttccgagggtcgacgaatccagtatcaaaaacccccccgctgtcgggcccgttgaatctccattctacaacgataaaaggaagtatatattatatatggtgtacttatatacaaggacctaattaattaaaggaggcgtaataagaaatctaactgaatgatacttacaaagtccaacaactcataatagagacgtcgagagcgtctagctggtatagttcgtagatacccttaaaattgatccagagaatatcttccccttgcatgaagtctgtgtccctgatcctcactccgatcatctctctactagtggcgctcatctccatgtacagttgatggaattggtacatttgtgttggtagggactgcagctgctcaggcttgacaagcggtttaccaagttcgtacatgtatttcacttccgccttttcgattggtgcgcctcgtagcaattgatccgtagttagcccgatgtcattaataaaatcttgtatcccaaattcttcatcggtcaccaacggctcgatctcctggtttggttgctctccaagctaagggactggtttggactttccagaagttgctttcttaagtgttcgctcatagtctgatagctttatggcctccttggcaggtgcagacatacccctgaagaagttcttgacactcgggtctataggaatcttattttctggacttcgaggcttcaattgtctcctgacttctgatgccacataagcgtcaagcttctcttgcgtgcaatcgtaccccgggtccttgtttttggcggcgtcaactttcgccttcttcattgcctttgtgggggcaggcggtggagcttggggggcccttgacttggaaggtgccggacgaggagcttgcggaggagttggtgtaggagcctgaggaggagtcggtgcaggagcctgaggaggagacggtgcaggtacctgaggaggagatggcggagccagaggagatggtgcacgagacgccgcttgtcgcccagggaggatgatgtaccgcttgcaccatagtataatggcgtggcttgtgtcttgtagatgcgtctcaccgtctcctccagggtagtccaactcaaggtcctagtacgcggctttcaccaactcaactttcaccttggagtatcctactggaatcggcctgcagtggtaagtctttgaagggtccgttaggatggccatgcccgacgccaccttcacgtggtgagaggttatttattagtaatcaacatatataagcagcaacttgcggaatggacaagtctaaaatctataaactacgagcttacctttattgataagttcttgaagggaatatgcacctcacatggtgtccgctgagtgatgtcatcaatgaggcaggtggtttcgtcctgggtttggatggcgtccatgctctgtgatcctacctgccccgttgaggcgcagctgctacgattgcctgaagggctcatcattgcaggaggaatggtcggctggggatcatgggaccgatgtgcggccatgcgttcatccaccttccttaccacctcctcttgcatgctgagctcgtagctcgataccctgtactcaagatcttcaatcttcgcctcggtatctctcttgctcctcatccgactcctgtacgtgtggatgtcctccttgaatccaatcttccaaggaatcacccctttccctcgtgttcgtcttggatgctccggagtctgtagggcgagtgacagctcgtccttctctctgtcgggtcagaacgtgccctgagaagaggcttccactgcgtccgttagtcgactcgcagcctcgcgtatctgatcgctgaagaccaaggagccatcaactgggttgagcgttccaccgtgagcatagtaccagaactttgatcgatccggccatttagcggtgaccggttcgatacctctctcaagcaagcttgcctccatctcctcgcacttcggcatcgcgacgctatagccgcctgaccccaagtggtgatggtacttcttcttggcggcattttctttgtttgtttccatcatagcctgcccttgttgacctatcttgtaagcaacgaactcgtcccagtgatcccttagcttcaggaatgtgttgaagttcggtgtctgccccttcaggatgtatgtgtggaacagatctcccttgaagctctacaactgttgtgccatttagttaagagtccaccttttccctatgttctctgtacccgcgggaagggtgaatgtctcgagcattgtggtccacaacatctctttctccgaatctaggacaaagccctcatgatctccgcgtgcctttgttctgcgaatacactgtactgacaggcacgttatcccgcacaacccaaccgttgtgtctacgtagttcttggctgcttctgccggggcactaggtcggccgttgtcacgcccagaaactcacgaatcagaatttctaagctgaatgtgtattaaacccctgtccaggaccagccagggtacacaaatgacaattgttgacatacagatccacgtcttacaaaaatataaaagattataaatgcagcggaaaaagataaaagcgagctgagcctgaagacttgactcctgcagcggacgactccattccacaggcatccttaacggcagcgacgaaaccaacctcttcgagacatcttcaactgagaaggacttcaactctggtgtgggggaaaagagagcaagactgagtactacccactgtactcagcaagtcataccggaagaggaggtatgatgcagggtatatccaagggaggctaaggttcttttgcataaagctagaatttaaaagcagttgttgaaagcagtaaaacaattgcagtaattaatcaatattaaccactcactgtccaacgctacaccacgttgcaacaggcccaaccaaccacctgaactacgccagttcattagctaactaggggtgagactaatcacggtgaatctggtcgaccgcccataaccgcgggcacggctattcgaatagttttactctgatcagaggtgtacaactgtacccacaagacacagccccacgacacattcccgtgcgccgacatgctaccacgacataccggaaagaggccgtgacaggacccttcgcataaccccctctaaccgatcgcaccacaccttagggttcgccccgtccccagcaggcaacgggcagcccccctttcatgccgcagtgaatccggaagccgatcaactggacaccccggtcgacccaactccatcacgcccaccctcgcctgggtacgtcggctagagaaaagctacactacaagcccagccgttgcccacgatggcttgtggtaagtacgataagttcttccagggcatcccgcgaaccggtccttaatcgccatgggcacaactagcaaaaccatgcacccacagcccaccatgtagtgtattttaataagccaacaccattacggtggcactaatccaaagctattgccaaagatca

SEQ ID NO: 64516 - DNA, 22077 bp, Oryza sativa
  unsure (1)..(22077): unsure at all n locations
ttgccttccattgcaagaattccagcatggtacccaactttttgtgtacatgttcgcaacctgggtgttttgtggtccgctaacatatgctccaatttctagacctcctttttaatttcgcaatccttctttacgtcacacaacatctcaccaagatcatctgcaccatcgttttcttcaacagctccgtctgcctcgcctgttgtattttatggaagtccatcgtattgagcccaatccggaatgttgtcgtcttcttcttaatcttcttccattgcaacctctaactcttcgtgcgagatccaacaattatagctaggcatgaatcctgactaaaacaagtgcatatgaagaattcttgatatagaatactccatctggttttgcacttttcgcatggacaatatataaaacctttaggcttgtgggcattggccacactcaaaaaaataatgcgagccattaattaattccttcgatcgtcggtccgtggtgtacatccatagccgattcatctacattaggaagtaacaaatgtaaaggaagtccatgaaagtgaaactacttcaatagtaatacaataatttaaaacatcgtaactaaactgaaaactgagggtaaacatttttaatgtattcttcttatttctaacgattttaatgagtttaaagatccgaaatatttgttggttttgccgatcgagcaaagatcggttgtccagtagtagtgtcagtagtgtcttatgggaagtgccactgatgtgaagaaaattttgctaaagtgactcgttaactttatgttgaaattctctatcattaattcctgtagatatgttcaaaactatctaaatagttcttttttttccaaaaagcagttgttatttttccaaaaagcacttgttatttttataaaatagttctaattagtttccaaacatcccatcttttctagtagagacactccatctactagaaaagactaagaaaattaaggtctactgctggctcagtcgctcagatgtgtggcaaaggtcaggatcactctcttgctgatttgctgtagaacaaaagatgattctgcatacccttgcccggacgcctcaaaccgctgctcttatgtcatagaacaaattgttgatgtcacttagtagcgatggcccacgtggcacctacgactggtcaaaaggccatttgatcaccacacgcctgcttgcgactgcgaggatagctgagcactgcacacggacgcacgcatgcacagccgacttggatgttgtggggaattcccaccgagactactacaccggcgttgttcgcagtttaagcatccaaataagtgcctttttctttccagagacctctcaaccccatcacattttttccacagaatttaaacattatatttttactagttatatattgctcgtgaaaggatatatatgttatatggtatagcatacaaatatccatgatgtagagggccatgttctttaattagttatatttattgaactggggataaatgacaagttcagtagaatccatgaaaatgcaatcaacaattatctatagaaaccaaacccatgcaccccggttgacatcgacggattttccttgcacaacgaagaaagctaggttccggcataattggtacatgagattggttggacttatttaagccaaacacattgaccttgtttgttcttaattagacgtatttttaagctaaccttttgcttatacgtcttataagcaaatggtatcaagcctttaagtttatagtttaaaaaaaagaatggcttatgactttaaaaagtctaatcgaaaaagctatttgtgtacttaggcttagactattcgactcataagttagcttaaaaacctaaacttaatatgatgagaaatttaacaatatgcatgttgggtacgatggtgggtacgatttcatgtttgcatgttgcaaatgatttttttctcctaaaccatttacccaatttgtgagtcggtttaactattctattaattattattaaatctgtgaaacaaaatgtcaggtgattatactttattaaatatgcatatatacgataagcgggccacataaaatttgggcttatccatctatatatgttttatctttccatccgaactataaattggatgctcccatccattaaaatcaaacagaaaatttgatcgctatatcgaatagattagggattgacatatcccatccacccacgaccataaacaaaacacacatttgataaatctaacggacaacacattttcaaccaagtgatttaccacaacgtgaaaaataaggatagagagaactttaagaacatttctttcaagctttcaaaatagagctagctactatgtaccaacagttattacatatgatttttacaatacatgctaatgtcattggtgatggttaatggctaaggcacaaatccaacagtgaatcacgatgctgagattcaatgtgaaagcgcaactgtccttgtcgagggacgatggaatcacgttggaaagccctgatgttttgttgtgcacccgccgccacactcaaggccgagccgacgacaattgaaaccgctcgataatgagggagctcttcgatgagaccttgctgcacaccgtgcacccctttccttttttccttccatgttgaccgcagacgcaggccaacaatctcctagtgcctcccatgcatgcttagcaatatgtttgctgccctgcaggagatgcatgctcctatcctagctagcgtgctaactggctgtatgactatgtagttgtacttatatacgacgggttctaaatctcggagtattgaacaaccatcacgcacacaagtgtatatcaaatggaaatagggatggtaatttcctctacgggccgggtccccacaagggacccaccccgcatttgggcgagcgaggcattccacccgctgggtcccggggtaatatattacctctcaaaatatagcctattgcaggtccaagaagcccatcttaaaatactaggattctaggatacaataaaaaaaatctaaccctaccttatcctcttgacccccacgccgcactcactagtcaccactccatctccagatcttgtctctctctcgccggtcaccctccctttctggatctcgcctcactcgacgctctccctccttacagccacaggtcaccgccctctccactccctcccttcctcaccggttgccctctcccctccctttcccttccctccctcaccggtcaccctctcccctcccgtcctctcccctgcagtctccacgtgatggcgtgtgacacagtggcggtgcgcaggtgcagtgagctagcgcacaggtgtggcgcggcatgtaggtatgggcccacggtgagcggagttgtgtggcgagcacaagattcgcacattgagaggcatttgtggtcatgcatgcattgagttcatggatggaataatgtatcatggaaatatttattttcttgatgaattttcgatgatgctattcatgtattcatgctattttcgatgatgtgtcaagtgattggatgaaatgacttcccaatgcggaggccccagtcaggttacagaaccctggaggggtcggggacgggggctgatttggtgccgcatctccactggggaccagggccgggtggagaggtccggggtcaggggcaaggccattccagcccaacctgctccgttgcatccctatatggaaaccatcattaccatcacatgtagtgttctttagcctatggatcccacgtgatatctccttaacgatttagagctcatcttcaaatatgtctagtcctaatccatcaccggctatacttccatggcttcgagcaacacctacccattaaacaagaaagaaaccatatccgaacacaagttcaaattaacttgactcacattagcacacaaacatcgctaaaccgcacccagggtgcgctatatctaaagcgctcccctcacatgcctcccacaccttttcttgctcatatattctttctttcagcaaataaattactcatagtaaaatctttctattagtaaataaattacaaacagatatgttgatctttacattgttatcccacaccttttttccttgtccatcctgactgccaccacacatttctcttgcatacatagtcctcttatagtaaattaattacttacagttattatattgtgattagtaaatggactactcggatgccttatcttagtaaataaattactattactcgtagttattatgtttttgttagtaaatgaattactcgaacatcttctcttagtaaataagttactccttgcaatacattctgtcagtaaatcaattactccttccgatctcttctttaaatttaaaatatactaaaattctagccacataatttctcctagtaaattagctactatccgcaccaatatttctccctcaataaattactcatagttattgtccttcccttaataaataaattactcttacttctcgtagtaaactaagaagtccttctagcgatgcttctcttagtaaattaattactctttccaacaccatctttcaaaataaattactccagggagtaaaagaatcacaaacatattgttccaaccacataatttaataaattcttaccaaaccagaaaatttttcaatggtattatatcaacgatctgatcacacatgcaatgtggtacatcggtagaatgcagagaagtaattaaagatcacaacagctcccgtaaatgaatcacaacagcaacagcactgatggatacggtgatgaagatttgatgccaagactaatacgacaatctagatcaaggccaatgacgcatctatgcatgcacgaatccaacaagcaagacaacaccaataacataaatcgacgttgagccgtagaggtgctgcaaattccagttctctctgtcgacagatatctgtcaccacggctgtgtggagaggcattccatagccacttggatataaaaaaaaaatgaagattgcatctaagtatcacaaaacagcaaaataaatatgatttcacttaaacctagtatttcatagccataatattgctgttgtgaattgctttgccatagaagaaagcaaacatatttatttttttcctgctggaatataactctgagaatcaacgagatacttaattgaaccaatccccccatcgtacagtttattcaccatgtaagatgctatagcagaagcactgcactagaaaggaaagcacaatctgaagttaatcatgcaaatggctgagatgcagcatccacctccatggcaatgcatcaacaaaacatgaacctccatgaccaaagcaataccaagaaaataagaaccggcaccaagaaacccaagaagcgaatggatccaacgatgatgagcatatacgaggacctccagaagaccatggttgcggacgctggtaacgtgtgcggcacaaaatctttcttttgttcagtctgaagaattttgttctatcgaaaagcaaagagaaactatagtgtttagaaaaaaaatcaatgtatcagctcagttgaaccacaaaatttcagagaattgctatccaatgacctttataggttgctctagctccaacttattcatccgtaaggtgagagtcccagttgagttagtaaatattatttactagcataagcatggtacttaggctaaataaatgtcgttggatttaggtgtgccccacggaaagtgaggtaagcggcaggtggtgacagccttgtccgtcctatattttcctccacatacgtatatgacataagagtgcgtaaataccataaccacgctggcggaccagctgggagtggtctctcggtagtacctaggtgactggagtggtcttggcggaccagctgggagtggtcttatgttgtaagcatgtacatgttaattgttgttagaggcatgtcacgagggcctttagccaggctttccaaaaccacaagaaccatgaggtgttggccaagtccaggaggcaaagcagctgagcgaagctagatgatgaaaaccgaatggtccaccaccaagcccactatcttgacaagtcattactatgggcgaagaccataatgcgaagcaggagggtttcgcctgagctagaagcggcatcggtagagggcttgggagacaccgcggcccacagatgcttttcgccattcatgggccggcccaaggagttcacttaaaagcccataaacacaaaggacactgtgtgccctcactaaagtccctatcataagggtatcgatgtaaattcccatgtacaaactaaaccctagagggtatgagcctgtactaagactataaatagcccccttgggccatataatgggggatcccaaaaaaatttttgtaccaattaatatattgctttttactattctaacaatctaccaagtgtaccacgtctttcgacatgatgcagttgtctttcgacaacaattgtatactagacatgattagtatagaagtatagatgaatcgtaatttccaaatgctaatttcctactagacatcctatcttgctataaagttataacctactaattctaaagctcaacatgcaaacatgacacctcatcacccactagcaataattacatacaaaacttatgcaagcatgcaacatcatccaattatcttccttcacattatttttcacaatatttttaatatatatatatataaccatcatttttataatacttaacatatattcatccatataatcaaagtgcgggatatcatatttcatctacaatttcatacattgtccactaaatttatttctctcttaacatagtttgacaaaccagtttatttgttattttacttttagctcggttattaaaaaatattagaatttacttagtaatttccacagcaaagcgcgaggaataacctaattcttatagagctgaatctcctgtgtgtccactaccatatccattattatcctaacccttgtttagactatggtgaattaattataggttgattaagcagatataaaaatcataactttatgccgccgccttccccgtcgaaatataaatacgatactcttgagaatacacatgggtgaaatgctacagcgttatccgtgcacttgcggattcatccatgaacataagaaaatacaaacaccaaccacaaagatgacgataataaacagatgataggaggcgaggagatttcttagctgatcagatttcggcagcgatattagttcgtgataggtccttgtgggcctacgttaggcggtcgtcaatagtgaaccaatgtcctccatgacagtgctgtcttgaaacttcggtgatgttgatagatcaaattggtgcatgacgatgattccgatctggtcaaggaacatactctggtcgggtcagatatcctaggaacaaagtcattgaaatatcccttgtctaaaagtccatagcgccaatatcttgataaagattgagacagcgagggtcccgatccataggagagtgcaatctggtcgggtcatatctcccaaagctaaagttgaggagttttttgccggaaaatccgtcttcttgaaactcatcttgtcgaaacgttaagcaccaagttccctacctggcggaatatttttgaggttggatatcctgacgatgacatttgcagagtatggggatcatttgggccaagccatacccgagattgaggtaaaaaatataggagacatatttttatacatgttcggaccccttaactaaccggtaatagccctagtcttgttggctgaagccggtgtagccattatatatcagtatcacattagtacaatatttgggataacctaatatagtctcggttagtttggcagaaaggagttctcacacgtagccgatggctagcgtagtcttcgtcctcgaatatgaactcgatgagactgaaggtagcgctagatctctcttgtcggtcattgtggctggcccccgattgagtatgtctaggcttttgttgttgtctgttggcttgtttcctctcctccaaggggtcttgtatttataccctcgaatgtccccctgtcgaaggaaaactagggagacaagtatggatacgatccgagtagttctatttttctttccttatccaaaacaccttccgtatatcaggcatgattctgcataaaacttggtatatggtgggctacgtcgataccaatccaagactattgggtatgcccgatctataacactgacggttagtataataaacttataccactaattttgatagtatatttggcatcttttatgcaatagctaacggttaaagtttgcacttaaggaccgtcaacagtaacgaaaatgatggctttcattgtaaagtattgtcttaaatacttatcccacacattcatcccatcctaccataaatctttcatatctttcatcaatggctcatggacatggacaatgtatctgtgttccaactgctcaacttcttttcaattctctcctctttcattttccaatacttgttatttaactttctagaatgcataggaatgccaagatatttaatagggtaagacccatgcggcacccaaaaatttgagaatattgttcttaacattcttttgcttcaccaaagcaaaagaattcactcttatgaaaatttattttaagaccacaaagcttttcggacacaaaaagaagtaacttcattttcttagaattttctaaattttctcaatgtgtcatccgcatactacaagatagacaaaccctcatcaacgacatatggaaccaaccatttggccatctgaataagtacagccaacatatcaacaactatgttaaacaagattggagagagaggatcaccttgccttaaacccttccaaggtttaaaatttggtccaatctggtcgttaacttctataccaacattacccattggatgaaggaatcaatccattcacaccatttagtggaaaagcctttcattctaatagtttgttgcacaaaagaccaataaattttatcacacgctttctcaaactcaatcataaaaataatcccattttgttttttcctatgcaactcatgaatcgtctcatgttaaataactacccgtccatgatattcctaccatgaataaaagccatctgagttgggcttataacattttgtgccattcccataattctatttgtgaccaccttagtaaatatcttaaaacttatatttaattagcatattggcctatattgttgtattttagtagcatcgttagacttgggttacaagataatcgtaccaaagttaagcgaatacaagtgcaatgaaacattatgaaattattgcgttaacaagtctagagaatcatcttttataacattccaaaaaacttggtaaaactcagttggaaatctacaaggaccgaagctttgttgtgttccatttgaaaaattgcctctctaacttatttttcagaatagtttgcttttaaagcctcattctcaattcgtgccacttgcggaatatcctccatcctgttctcatcaagagagaattgtgttttttcagatggcccaaaaagacctttataataagttgtaatatgcttttttaattcagcatacccacttattatatgatcaccatctagcaattggtatattcttgtttttctttgcttaccattagccagcaactgaaagtatttggtattggaatcaccttccaacaggtcccttactttagcacgttggtaccacttaatctcctcatatcttagaagcatagctgatctattattcagaagcatgcctctgcctttttgtcctgactatataacctgtccaacaactcttttttctgtttcctaaatgaaccacaaatattttnnnnatcctctcaaatgctgtcttatcttagcctacgtaatttcgcttgtcacctttcgttggagtattcccaacctgaacacttgcgcatacctccttaaccatgtcaaaaaaaagtcatctcgcaattaccaaccaagttcgaatttgaaacttggaaggaaacttgagaaagctgagttagagtttaacaataatggagtatgaccagaaatatctcaagataaagctaaaaccgaagataaagagtttatttcctcccattcagtagaaattagaattctatctagcttttcaaaggtaggaacagtaagaatgtttgcccatgtataattcttgcccgacatttgtaattcccgtaaatttggaccatcaattacagtattaaaaaggaacggctatctatctatcattaaagttagaattattcttttcttcaggacttcaaaaaatattaaatcgccgcctattagaatcagtaaattctcatgactacacaaatggactaactcagcaaggaattgttgtttaaattcattctgtgcaggcccatttaaacttatcactcttattacacaaatgaaatttaatataaaaatcaccctcttcaatcaagccaaatccacacacactgtaaatcgacaccccacaacataccaccaaatctacccttaggaggtttcagtgccaaaaaaatctttaccagcacaaagatttttaagggcatttgtcgtaaattcactcctaatagttgccgcaatagcaatgaactccagatgatgtttttttttgttaaacctatctctagtctcccctttatctcttcgtcctcaaccaagctacgggaggcgagctcccatcaagcacctcaattcatccacgcacataacatgatggtatgaaaaatgtaatattctccactttagtctttattaattaacagaatttgttccagcaagaaaaggctcagtgcattattgttggtagtgcgtgttgaatttattccctttgctgtgcaatcacgaactggatgcaatattctgggagaatgttatacttggcatattcttcaaatactggtgaggaagcacacacctttctacatcggttaaaaaagagatattggactatcagaatttgcaaaatcgaaagtatagaaatatcatctttacattaattccaggcagagtggtggcactcgtacagaaatagcatgttgcactggtccattattatttttagagtaaatttcagaaaagccatgtttttatggtcaaagttatagaaaatcacaggtattatgacatgtgccacataaccacaagttttatggactatatgtttcataaaactttacctttattaaaacattgattaatcacagcatatttgaagcattatttttcaatgtagccaatatgtaaactatcaaccttaatcaacaaccaattttatatacactctatggtttagaattttaagtattttatactcaacatgcacaaaggtgggactagtataagaagggactattgcaaagtatatttactgatgccaatactgtcactgtcgtggaggagaaggaggctgccattgagtacgttgaggcggagctggccatgatgacacatcagcatacagaaggggctgcagaagtagtggtggttcgggtgggtagatgtgagagggagacaggagatagagtgaagggggaaaggataaggacgaggggagaaaatgagaatgtgagggaaaggataaggaagcagctgtttttttttctcccccgcactcggcattgctatctgctcgatatgtgtcggtttaataaaaactggcaccaatgtcattttaaatgcaccagctaataaaaaaagtatgggaaatatatatggttcatttttattaaagaacctgcacagacgaggagttatcagtgccagttttttctctctcaggatgtggcggggttgggtgggcacgaaccacttatcattaccggtttttcctaatccaacgcatataacgttgtcccctattaggatttctgtagtagtgccttaaaatctgagatgaacctttccattctacttactgacttgtacgcctaagtttggttttgatccacttatacttcttccttggtgagtcgtttaacaaccctgcgaaatttatattagttttatccttgaacatggacgaaaatttaaaatttatagagtaatgtcatcttatatttacctataatattaacttcgttctatatatatgaggccaaaatttaaaatatattcaaaaagacatgcataacattattttagattcgatgtacaaaggtgagaccagtatagcaattctcagatactgcatacaacatccaaaatttgtcgtatatagcatcaaaaaaatacaatataatctctttagtgtgtattaaattttatcttgcattatgtaaaaataaacttgtttactaacaatatggcctcatactgtaaaccttatgattaatatgaactcatagaacaaactcatgtactccaaatattcttacattcctgtcatgctcgaagggtaaattggacttttcagagctattaattggtcagctaatgataaactgatagaatgggtatgaaaagaatcaacacaaattcaatagtatgcaaagaaagtgagaataaacaggggtataaaagagattgacaaaaaaattaaggccatacaaagaattctctctttggacctatatatccgtctatctatctatagtgtgggatgctcaaaacccaagtatacacatcttagctagtacaaatatgaactgtttctaatcttcctggttactctagtgcagcaagctatacatttgcgaacttaagaagaagttagctacatcagtcaaaatggtgtgttatcctcttcctccctctaaagattttatcaacattttccacattcaaaactgtaacaacataccgatctgtctgtggatgatttagagcatgatagttaccaagtttggtccatggggaggaccaggcggagattatagagacgttcaggtggctccttatcggctcgttcgcctaacaatccgcagcggagacaccgtcgacgggatctccttcacctacatcggcaacgatggtctcgtgtaccacatgggtcattggggttccgatggtggtgttccgcatgaggtaaagtctaccactgatactcctctcttcctctatctctttctttctatgtctatgtagctgtggtttgcatctccaatatttatatataaagttataactagatggtactccatgtgttgctgccgaaattcatacaaaatgattagcttgaaattgtgttggatgatttttttataggtaatgttatggatgaggcgacaatataatggtgcatagaaagtgccataattctcttaggtagcccaagcaaagcgttgcacactgtattagtagtactattatagtaacatatccgaacaaggtttagaaggatccagtacagctacaaacatctccgaatgaggttaagttttgcactgggctctgaaggaccgatgttgatattgatgttagatacaagctaggaaggtagcccgcgcagttgagctggcatcttatttaaactatcatattttttgtggttaggattttgagtattatgactttaatttgtctgtcgatgaaagaatttgaaggttcctttatactacatgattgaaaaaatatataggtcagaaatagtttagaaatgcatgagtaaaatagagtaaacaaattttggaccgaggacagaaataacatgaattttaaaatttgttaacccacatagatcaaatcatcatctatcattgcgtaaataaactgcaattaaccagacaacctttgcattagcagcttgattgtctccatcccatgcgaagggaaaaaaacatgcgcatgcatcttatttcaattttattaattttattgtcatagacatatgctgcaactttttatatgcaccatgcatggatacctcgcaagcaatatgatttagggataagtagatagtgatagtgaggatatacctcctaagttagaattgatcaagtatattgtatactacatattaagcgttttagtatctaagtaataaatttaaggccgagttctaaagagcttattggattggctactcgcttatttatagtgagcacacttcccaaacggctaaacgtgtaatattttatatttttctcataatttctattattttctcaatttattatagtatcaggtagtagtttaagagtcttcgtatggtgtttaatggacttaaactttcctatgttttttttggcatggtattggttggttatgaatttttccttcagaattactataatatattcatgcaaatcaaaggatagtatagatatgcaatcgataggaagcacactatttcttcctacaatccaaaggagctttgaattttaattttaaatcccaaatataattttgagctgaattcaaactttttaatggtgtattgctttttggatgttacaaaagaaaacaaaactaaagagatgaacgtggggcctgtgtgggtacttatgtaatgtacttatgtgcacctagaagtggggattttaagagataaatttaattggtagtttttttaggtagatgtaatggataaacaatggatctaccacaataaataaaaaccaacggttaaatacatttttcttagaatttatatgatttattacaacgccacgtggtggcttataagtgtttgtagatatgctatgaggcgggaaagaagcgttcgtagggatgatatgtggcagcttactagcgtacgtaagaagtttaatgaactttcaatatataatagatagatatatagatagatatataggtagattgtcaagaatagaaaaaattgaactgagcataaaacctgtaaatatgaaatttacactctggaaaacaagttaaaattttaatttgaatgttttatgaaaaaaatatagcggcatatataagtattgatagtcctttagtcaaaacttgtgaattttttaagttatgaaaccgtttttttctttaatttgtgacatgttcatgcatggcaatgggcaaaatccgatgatttatagtggatagaggtttgaaaccagatgaattaattagacatgtactatccaattatgtaatccatgtaaattgtacctgcagattcatctcggccttatggactttgtgatggaaatctctggcacaacgggcatgtgggtcagtggaatgagtaacgtcctacgatcactcaagatcaccaccttgaaaaggacttatgggccatacggcaaccctaaagctgggatcccttttagcttctcagttgatggcagtgatcggatcactggctttttcgtacgcgctggctttataaccgatgcaattggagtctatgttcgtcactgctagagttttaggctagaaaaaatacccatgctttacaacgggtgaaggttattttattgttatatgatttagttaaggtgaaattcactgtgggaattcacttggatatatatttttctaaaaaatcatgagctgcaattaagagtccgatcatcttaagttagtatgtgagttttttttaagaaatatattatacgactccttccgtatttccaaaagcgaacgggcttaaaacccgactcaaatacggatctatattttcaaaataaaatgaacttaaaaaccaactctatatatagatgacataccaaagcaaaaatatcttcaaattttatattactatagataatgaaatgaatctcgatctttgccgcactgaaaagctacagccgctgctagctacatagttatccacattttcaaagataagttttttactcgattaattctcagtgcctctagccgggtgggtgccggaagtagtttctacccatgtagtgatgtagacataccagcatgcaaggacaatattggttctccaacaattatagttcaatagatttaagtgaaatgtaataaacagtgcgacaatatattaagtgaagtattggattagacatattagtcgtcaacctgtgagttgcacatgtggaaatatttaaatcaaattgaatcatacatgtggttaaatgcattgttattttttccctaaaaatgattttatcatgatcgcagctcaaaaaacgggtgttcccaacattacaatgattagaaaaaaagataatatacaagcactatgagtatttggattagtgggatccatacacacataagtaatactcactctcattgtctatgaccacagttgacaccttcccatataataacaatgatgccgagtagtgagtaggagagatactcaataggatagcttaccagtccctccccaagatacgccggtcaaactacacaaggtggtgtatacataccacagataagtcgatctataagggctatcccataactatctcaagtgttcaaaacgcatacttgtgctcgactaattccgatcccagcaaaagaactagcctcccacttttagcttaattaaccaagttatcgaaatatggtgcaagaaggataatttaagaaaaactagagacatatagccaacttatatgcatatggtagactggcgtaatagtaaaagttcagtggactaggggtaggcccctaggtcaactagacttatactaaacatgcagactgactaggggtaggcccctagttcaaaccatcctgaagaagttaacaactagtgatatttgcaatcatatgacaatattgcattgcacaaaaggagatacaatcattttgtcttcatcgctcatgttagtttgatcgttgtgtctggtaggagaactaatgcatactatggtatcttgtgtaagatgcgcatttatggaagtacacttgcaccatcaaaaaacttacttacttgaaatgattttccttgtctgatcacatgtgactgatctagttatgatgcctacttggtcatatatgaccacgatcactctgatactcctgatgatgctctaaccattatatttggcatctcaatggaactcttcgtttgcttatttttgaaaagtcgtgaggcctcaataggcaaaatacaagaagaatcagatcaaaattaaggaaattgcaaaaaaaaaaaggtagtgcgatcaactgatgtagagtcctttccgtcttgaatgtcatacaaatgatctgaatattcggaaccatcttcacagctgacacatagagttcagttgggccacctgaccagtggctcaattgataccattaccatttgttaaaagcgaaatttaacaagattcacatggatttggagttggatatcgatgcggaatcaaaggagattgaatcttaccaaattcgaaatgcgcatcggctggaaacatagttggaaacggattgagccgatatggcaggtagccaatacagcttgacttgggctcggtttgggtttagattggaataactgatattgccgtatagagattgagctcgcctaaggcaattgtatctattaattaggatatttatgtcggtttaaattagagatatgataagagtttgccatgtggacttgttcgtattttatctttaggaaagcttgagtcgtgtccgtaatggacaagttttgtactcagggtatcaatataagccccatacaattgtaatagacggatcgaatcaatacaactttcagcgcatcgccacctttctcttttttacttttcgacgagttcttgtttcaagtcggagcatcggttgcgatctcgcgatctctcaacaagaggtaacttgtcttgatggcttgcgctatcgaggctattatgtcgctttagatgtattagtcctattatcatagtcattattatcatatatcttaaataatcctgacttagtatctcgatttagtcatatcgactgtttctcactttagggtttacgctggcatcgactaaatcatcttactaaattatattaactaagttatctaccatcctgaaaagcggttaatgacttgattgtctagactttatgcttctttgcatactttgtgatgcatcatacctaaccgtgcttagaatcatagaaactaactaggaattaatcataactaaggatagtatcggggtttcatccgatcttacctaatatacttgatagcgcatatttcctgatctgtttatgtatattttccatttatatagatagagattgatctcacttaaacttcatatttcgtgatcaattgctatttggtatatttatatatattgatttgtttacataaatttgtattgaagtattagccagcacattatctatctttgctttaaatactgatctattggttacttccataatattgtcttaaaataattgatataaaccaaggaaacagtattacagttgatagggcatatttagggttttaatctgattaactattataaagtcgcaaccaattaggtatacccatatcggctaggtcctgacgatacgtcatcgggcctattagcagatccgctactattcatctaattatattttctgtttctcttgctggtttcaggatcaaaccagctggcacgctcttgacactcgaggcaagcgttggacctgcactggagtgaaggaaaactcctagggtgccgtgttttccatcaacaccattataccatcggcacgagtcattgatcaacttgttaactacgggcaactacatcaagcttttactgttgcatatggaatgtaggagatacattagggatgctggcatcaggaaaccttttttttggaaggcagagaaaacataaacattttgctagttgctgtcacgtagattaccaaaatgctcttggtgtggtgcaacacatccattatgaattttgggatgtcatgggcataatagacattccgaacaagatttcacttgatgacttcgtgcatgaatttttgaaagtgtcgtatgagcaagactgttttggtataggcaggtaaaaaattgttgatagtccaactaatttaacaccgaacaaagtatgacactccggtgcattataggaagatccagtcctaagaagatgaaggcaaggagtctggaagtggaagatagtgttcgacggatagtccatttaatttgttgacaaccatttcacaggttggcacatgttgattccaactacatcgtattctttgttctatttggatgcaacctaaactggggtacatacctctggtgtagatgcctacgtagtttattgctcaaacagaaatttagtaactctctgaaaaatccaaattaatatcgttgcaaagattcaaaaggtattgactgatgctgagtaaatacatcacatgggtttgggcaaaaccagggtgaaccggcaatattactcagtatagagttcacacacaaccggttgtaatgggtcggtaatgatgttttttgtagaagtgaatttattttattggttattatgcagttttaacctcaataattggatcgcctaattgtgcatgatatgtgaggttaattatatgtaatttttcgttgtatatagctagctaggggttgatcaaatttcctctggtttgtttatctttgtatattttctacgtcatagagtaattgtttcctatagattgtgctatgtttagcaataatgcattaaacgtgcttggcttcggccgtttcactaatttatggtaactttgagtagcaaagtgattttgttacagataacacaaaatatcatcgttccaaacaaaattaatgggcctatgccgatggaagatggaacaagcgtactgaaatgtcaaaacttccctctaaagaaaatgtaaaaacctgatagtgaaattttgggtactaaagcaggtagttttccaaatgaaaaaaaaaaagaaacaacaagagatgaaaacagtctaataccgtatttcattttcgacattgataagtcgattgtacccactgtaaccccccgccccctctgtttgatattataagaaagaaaagtaagaagcaaaacaagatttgataacctattgtacccctctgtttgatattataaaatgttttaatatttttcttcataagttttactccctctgtttcaggttataagtcattttgactttgatcaaagtcaaactgcttcaagtttatccaagtttgtagaaaaaataataatattttcaagccaagacaaatttattatgaaaatatattcaattattaatttgatgaaactaatttagtattgtaaatattattatatttatctataaacttacttaaacttgaaacagtttgacttttaccaaagtcaaaacggagggaggaccaaatttataaaagaaaacatagtagcattttcaacaccaaacaactataccgttaatatatattatatgttagtttaataaactaatttgatgctgtaaacttgattaaacctacaaaaatttggcttagaaaaaaatcaaaaagtcctgtgatatgaatatgaaacggagggagtatttgatattgatcggcatacaaatcctgcatctacccaaaacaaatcaaatgatgccagccaaatagaatggtagtaaaaagtaagaaaggtacaacagtccacacatagtgacaaatcacacacaaacgggtagcagcacaccacacattattacaccaagcagcaatacaggatgaagagttcagtagttcagccactagattattctgttaatgctgaagctgatgattgatctcgtgctcttgtttattctacccaagctatgaagctaggccaccaaattgagcaactcaaattggatcatcatctgtccataaagatgatgcatcgtttctccatggaagtccagcaaaggcaacaaaaaccaaacagaaatcacggacaatgcggatgcagatcgcatccatgacgggcaaaatcatgcagatgcaaaataagcagcagatctgtctgtagacaaggcatctcttccttgcaagcgagacgtcacagtgtcatgcaatgatgcaaagagtacaaggacatacataacttatcattgacttgaagaaagcagagtaagcatctcttctcccatgacatgccaagccgtaatcatttgagatagtagggattactggctacctgtagataggaacccgacggcgtgccagtgaaaggcgttatagtcagatacaaatttaatttgtagcgaatgaaaaacactgaatttctgatatttgtttcctaaacaataatattaattaaactatgtagagaagctaatggtgcaaccaatgaaatcaactcatgcagatgaagtaataagcaagataggaaggacagagggtaaataagtgagtcaatcacctgagtagggaggttctccgcagggctttcttgtagtagtgcgagtggatgggcttgtagagggaaggatggtggttggcttccatgccttcccactcaaggccatcccaccattccttctcgcagtccactataggtggtgtgctatcgtggcgaccaacagatggcagccgtttgaggctccaacagcccctgatcttcacggtctcgagctggggcgtggacatcttgcggccgcagatgcgctgcagcttgggtagctcgtgcaggtggatgcgctttagccttcggaatactatagttgaatcggaatccagtgggaagacatccttgagtgcaccgcagcacacgatttcaagtgttttcaagctacggcatccatttgaatttgatgagcataaggggagtacatgtaccaacctggggcaccgatctagatgtaagaacttcaggttctcgaatgaattgtagctaggctgaaacaatgacgtgtcccagtcccagatgtagaaaacctttaagagttgagatgcccagaatgtttcgagactccggaaaatattgtctcgagtgcaaggcgcagtaaaaatagtgccttctaagttaggacacctctcaattcggcaccaccatagga

SEQ ID NO: 64517 - DNA, 8800 bp, Oryza sativa
  unsure (1)..(8800): unsure at all n locations
cagtatgcatttctcggctagcttctttaaaaccataagttgcagaaatattagcagtagatgaaatctcaacagatacacggttgccaagtctgtcgtgcaaaagtgaccgaatgaatcttgcattcctcaatgaaatgtagaaatcaaagttaacaactgcttggtcgccatgaagcacttttcttgatgatgaacctacacttgtatcgccactggctgcctctttcttgcttgatttgtcttctcccacccatcttgcatcagtggtgtcaatgtgtagcacatacaattctagcttcttccattccctaggccatagtattgctcgtagcttctcacaacccaacagaattagcttgttgagacgtggagcttgcattgcagtaaggtcaagcattttgattgctgtatgtgacatgtccatctccacgaggttctctaacaatcctctcagcaataggctcttcagttgcgtgcatccctggaacgagatgatctttatcttggcggcgacattgctgacgaatataaatgactctagcaacagaggcaggaaattgtgggcaagtttctccagctcaacacagccatcaagggcaattgtcttgatactagaggttgacaggtcagggaattctacaaatgatgatgcttggtttgtaatctcgcaacatgtaactcggagcttgccaaggttgcgcggcctgcagctgttgcttctagcaacatggccaggacctagatggcttatccaggtcgcattcttaatccccttcacattcaactcatgaaggtgaaccatttgatccatcatctcttctgatagcaaccaataccactctgtataacttatgtccaacacccaaagctcctcaaaacatgttctattgtgatggcccattttgctctgttgatgctcatcctcttcatcaagatgagctgccatttgatcgtctatgtccttgtccttgcaatggtcaagtaggaggaacctaaggttgctgcagccaaggaaggggggtgatgaaaaactgaaggtacactgggagagatgtagtacacgcaatctgctcctgtttgaatgtccaaacatgtcacctcgtaatatcatggagctacttttgtcaatcagtgatccggcttccgtcacaaagaaggatgttgcttgaggtggcacttttactgtagctacatactggtgggtagttgaaatccagcggtttgtgtgcctccactctttactactcaacccaaaggcatcacgaatattgactgcccagacctgatgccaatcctccaagtgcatagcactatgcagagcttcagcaatctcccatgccgatctatcaccattggtggcatcttttatgattccatcacatacccaataattggctgcgttggtgccccagttgatgccatagtcatcacctctcaatgccttgtacaagatgcactccatgacaagtttggtgctcatatcaggttcaaggacaccgctgtagaaggctacctcctcagcctctacttgcagcaggtgcctgacactattaagtatggaatcacttgacaaatcagcatatatagaaacattactctcagctaacttcctttcatgcacctctcttatgtcattgctatgaagtgaaaacctgcctcgggaggtccacaacaccctcttgcccaaaagccctgctacaaggataccacaatctttaagatcaatgtagcggccactcccattatggaagatcaccaggaatccgcggtcacgaaggttgtacaagatttcctccttgacatgttgtattgggcctctagcaacctggtgtaccccatcaaaatcgtccttctcatcccactggtcaaagagggctatcacatgttgaggaagattcagatcaatcgcaatggccttctgcacagccctggtgttttgccacagtgagcaatcaacgtggatgattttgtccatgcctgctttcatcacagtagcagcctctcctaacagtgatgctgatgatttgagccgtgtggcgatggctttgagaacagcggatgcccccaatccaccccagccatcaaagtgtatcacatctcctttgtttgaacccatcagaaaatggattatctcctctgcagcaccactgatgttgtctgccttgatattgattacctgttataattagtgctaataaatcagatagtggtggcatatttgtacatcaattgcagcgatggattacatacaagcctttatttcacaagagtacaaaaataattatcttgagagttgggatggatggatcagggtaatatgtttacattgcctttaattttgacacaatgataaaatctgcaatttaattcatccaacaaatatataaaaataaaactttatattctccacgtgaatattaagaacaaatagagttttttaacgaaaaagaacaatagaattatttgaagtaaaaaaataataagcatgtccataatgatatagaaaagtacagaacagaaatccaattattgcatgttcaaattaatgtgtgcgacgtttgaatttgccaagagaatgctgctgacgagagactttctatgttgtttggacgaatgacaaccgttaattacttacaatctaacaacgatttataagagaaggtacctaaagtaaggtactcaaatgtgggtcaagtattaacttcaatattaagtggaatgtcagactaatagtttaatctgtacgtagtgtgttagtatcatatttgatgatgaaggccaaattagtaaataattagccattcttcttgctgagtgtgcctcatattatcaagccgggtggatggaatagcactgcctttgtggccatggtccctgcctatggactgccgacgctcttagttccctaggagacaacaatgtagatgtataaatatggcgcgagagaggcgacatgaaagatttgcaccctcgatggctcgatgggcagaggtaacaatgattcttttgacggctgatcttgacgcttagtagaatacagttctcttttagtctcttcatcccaaaatataaggtccaaccactattttaagatatttcataatataaggcgtgcatatatgtatataattaactagcacctctctcctgtaacactctgaaaattcgactaacaaaatcaaaaccctaaaaatacggaccttcgaaaactttgtaaataaattgcatcatgccagttttattcgcctattttatttgcatttgatttcggagttcattgatcgtgagtaaagaataattaattaggaataaaccctaaaaataaattggcaaaataaataattgaaatataatttaagataaatattaggtgaggatagaaataaataaaatattatcgcgaccatattggtaacaattaaatttaagtgtgatggaataagaattagccctaattaaaattcaaataaattatataaaaataaaatataggtaatattaatatagggtgaatcctttgtttaaaataacacaaatattgagtaaaatccatttgtgcaaaaattaggatttacagaatgaaatttatataggaaataggctaaattaaggttaaataggagctagccctgttcattgcacagtagatgctcgatgagattccctagccctgccccctcctctgccgtgcgcgcctagccgcccctagccccgcgccaccctcaccgtcgtgtcccgttgccgctgccgcaccgtgcgccgtcgccatcattgccgcgccgccttagccggcctcgtgccctgagccgccgtcaccgaccatcgccgtgcacccgtcgccgtcctgtctcgcgccacgtgcccgccacctcgcgccccacgctgtcgcatcgccgcccatcgccctcgtgcctgcaccccgccacgcggccatctcgttgccgtcgccctgcgccgctgccgcgccgcccgtcccatcacaccgagcctcgtgccgtcgtgcgtgtcgcatcgccccgcctgtcacgccgcgcgccactcgcccatcgccgtcgcctcgagccccacgcgccgcgccgtcacgtcgccattaagccggccgcccctccctgcgccctataacctcccccccggtcgcccttcatatcacaccaccccacccccttttcccctcttttctcccctcttcctctccaccgcgctgccgtcctcggtgccgcccgccgtgtgctgcgccatgcgtcaccccgccttgcgccgccgtcgccgccgctgtcgtcggtaagccaccgccccctccccttgttcggtcgccgtcgccgcccgggtaggcagagggccgagagggaagaagaaaccgggagggagagaaaaagaaagaaaacaagagagagaaaaagaaaaaggaaaagtagatagaaattagggagagattaaggaggtttagaaaattaaaataattggggttagttgtagatttcttttagttgtagaattgcaaaattttatataattatagattattttggtaatctctgtaagtaattaattcatggtagataatcggatttaattactaagaattgtattgtttgatgaattttaaagaagatacttctaaatcgcaaaatgacttaggttgaatgagcttaaaattggaataacgtagtttcgctaactttgtagtcgatatagaaagatcgattcgcgttcgacttttatttgagtttatttggattttatttgaagtctaattgaattcaaatcatttcttcgcacgtaattttagagcccgaggtagttgcggatccgagcgaggaacaagacctgcaggactacgagcatggcaagtaatcactattctttgaacatgttgatcccaattgcgaaattattttgtttacaaataaaattgcatgcaatgatgaacatcctacttatgattatgccatgccttgattattgtttacccttaaatccctgtaaccatgagtacgtatgagtccctagtcaattatgacaaatgcttagaaatgttattctagattcatgcatactcatatttatcaaatgttttatgcttgggaaattacctttaggaaggtaattgagatgcggcatgtggagacatgaacgccacattgccatgatattgatgacatgatttgtgaaaggaaaaaaataaaactaaacaaatgttttcgactggggcggctagaggattttggtagtgtccagaaaaggctagtgccgtccctggtcagttaaggaccgaaccatgaagttaagcatgaaacgacccccgtacaaccgcacttctcgtatggttatagacctagcggagtagatagctgagcggaggcagtatccatgcatagtggtttcttgatgtgtgaggcaagggctctacggtggggcagccattggtaggaccacgaggcaggtgtctacagtggtgtcgccatcggtaggactgccatgtgagaatctaaacataattataacttaatgcatgtgtgagtcttcccttcccgggtgcgccagaactcctatcactgctagaaatcgtattacgcctggagtgcatgaggatgtaaagtttatggagcgggtactgccaatgcgaggttgtcgaaaggctttgccgtgacgcgtttcatgtgttggggcgaggctcatatgttgggcagtcgcgaagtgcgggtaaagtgtacatccactgcagtgtgagtaaaccaaatctattcgaatagccgtgctcgcggttattgaacaccgggacgtgtattacacttggctagactctaaattcttaacttgtatgggatgggatattgcatgatgatttttatgttgatggagccacttcctgagaggagggaaggtggacgtcctcagaaaaccatgacgactcaatggcgggaagctatccttaggatcacaatggatggtggacagaaccgtcgttgtttaatgtgaacactggtactaaaatttgatcagactatgctaggtcttaggcttgtgaaaagaattgcaaaacttgctttgcgcaaaagaaccatagccattccttgaatagcctctatcatgtgcattgctgctgtggtggcttgctgattacggttggtactcactcttgcaatatacaaacttaatcagaagtcagagataaagcttcggaggatctctacgcttactaccaggagggtgatgaagatgatggcgctcagtaggtcttagttatggtcgttgcctgtggcaatggcatgccgctgcctcaattccgctgccttatctatttctgcttttggaatgtattccggaccattcggtcctatgatctaagactatgcctgcgggcttatgatgtaataattcgcactagactctcatgtatgtgcacttggtatttcagctatgaactcgtgtgtaccagactacttgatccagggaaatggtacagtttacacgattgattcctattataaaaacgggggtccacatctcctctctaaattttttattttaagtcctccactcttaatatctctaatcccgttgggtgcatgcatgtatttattgagattattcaactaaggaggtgataataattgtttttttctttgcgtctatgatggttatgccttatattttgggatagagagagtatgaaatttagtcgtgtgcaatgatgatggctccccatatactgagtatgaacacaatagtaattgtctaagggtgccatcgtttggcatattggtggaataagccaaacgacatattagcaaatgaaaaataatttgtgaataaaacttttatatatgtgttcttagtgatctaaaagcaaaagctgaaaaataaacttcgatgaaaaaacctcaaattcagctccaaatttaacgttgaaaattcaaattttggctgataagcataagaatatgccaaacgatggggacctaataatacatggagcaccttctacaagtagggatagagagaaaaaaatctatcttttttgcgtgcacgcttcccaaactgctaggcagtgtgtgttttgcaaaaaaaattctataaaaaagttgctttataaatcgtataaacctttttttaggttcaaaataattaatagtcaataaccatacgctaatgctcacctcgtatatattacatatcttctcaatcttcgctttcccctcctctcaaacactctcaaactctctacagaaaagtgaaaaactaactaactcaatagacaagcaaagaaatagcaattatgattggggctcaataagcaaagatgtactcatataaacacatgtgatcacgcaggtaactttagcttttgatattgttatttttcagccatctgattatttttctgaacatgcagtcaactaaggttgcacactgcaagatttgcaactcatgtaacgaagtgtaacattttgttttctttgtttttcatttacagggttaatgggatgcatttttatgcttgtctagattaaagtttgttctttcattttgaaaataagttagatcattattgtgttgcatttcaacaaaaagtgctaattattcgatcgatgtaccccacgcttcaataaaaaaatagaaaataaataaggtttgtagagctcatccaactaagcaaaataaacggacacaattacaaattgagagcccgatttttttcaaaatatctggcgttgtttcacctactgtataaaaatgtctcacatgtatgtaaaaatttttcaaactattaaaatggagatgcattgttgcatcacagttaaaacatatcgctcttaatcatgaaacatcgagcttcaactgttgaaacagccacggagccgcaagaatcaaagacaaaaaaaatgaaacaccattgaaatcccaagtgcaacactttgatgcaacatgtggaacaaccatatattgactgaaacatcgaaaaatcataaaatatgccgattagatctggcttcttactcctctctggtggtacaatctacgatcaatgtggatgagtgacaaaggtggggaggggggggagatggcggcaacaacagcacaaagagcaacgacaactgacgattgccgaccctggtggaaggactgctcctcagcggcaaagagatgtggcctttggcactgctactgcttgatacctgtggatcacatgatcccaccaacattggtaccatgtacctgcgatgatatgaagcctcatcgctgaaaagatnnttatttactgtctacatactagattatatctattgttatttcctatttaattttctaacttaactttcaattcaacaagtttgtggtaataaccgggactaaaggtatctttagcccacctgtcagtccgtccccgatttttgaatttatttttaagaaatacattacaaactttaaaaaatatataaactgaaagtaatacattacattgcacaatataaataatacatcaattccatttaaaaatctatttacaatgtttacaatcttatagaatctatttacaatgtatataattccatttaaaattcattaaaatggttagaaaataaggagaacacactaaaaaatatgtttagaattttaaaaaattctaaaaaaagtaaaatatagataatatataaaattatagttacaacttgtgtgatgttttaattgttcaatgcagatattgtatttacttaactttatgattttcttgccaggattggatgcaggcgactctcaagtttaattacattattcgaaggtcgccaagcaa

SEQ ID NO: 64518 - DNA, 8082 bp, Oryza sativa
  unsure (1)..(8082): unsure at all n locations
cattataacatttcatgtattatttaatgttacgaatagatgacagatcgcaacgattatccttcatcatggaaatgatgaatttcatacatttataacatttatatcattgcttagttttttaatctttttctactatcactatatcctattatatttttttttattgaagaggtgtatgtctaatatagcaatcctctcatatatatgtatacatagtatcctaatcagcctctaaatcaaaaagattagctatgtagtatccttttcgccttcctccgcacacatcagacaaattcatgcaccaaaaacgagtattttacaagttcttacactagattgcacccacctaataagtttgtgtaccgttgatgcaatttactcatgcatttttgtaccagttgatagcaccaaagcgtacgaatcggtactaaatatgcccttagggttagttgaaaaaaacatctcaatctatatcaaatgtatgtagtaggtgggatggcaatgcgtgtgagagttaaggtgagagatcttgagtttgaatcccacaacccacatattttttttaattagtgtgcatctttactaccggctgaaaaatggttaaagattgagatgtttggtctcgatttactggtttaggttgctacaaccggtactaaaagggattttaaccggtattaaacatcgtttctcatgtagtgattggtcaatgttttaaaagttaggagtagactgaatcatgtcttaaatatcaaatatttatgattggaattagtaccaatcttagtgttttttcaactttcacaaagattacaagtattctggaaagaggatctaaaagtctcctcatattttatgtattgattacatgaagaaaatgtagtatgctactcgcaacatttgaattttaggtgagaattaatacgggaaaaagagattggtagtagtatatatgcatgtgtcacaaaataagggaggactattggtcaggtaaggcatgcatcagagtggcgaataacaaacagcagatctagatatataggagatccagcaggtcatgcctaaaaacaattacttgttaactcccaagttcttgttattttatattcgtaaactgccttataatgaatcaacaataagtgtttaatagtctgggaggtaattggaatacggcaaaaactctctgctgttacgtagtctgtcatcactaaattccttcgagacaatcgaagtcagaagagtgatttacctctgtttccatggggaatacaatgtgttgttgctttgcagtatgtttagctagcacttgttaaactacaagctggactagcagctccatctgcatcaatgctttctggatctccatatctcaccatctgctcgcaaaactatctctttgaagctccctacttccttccagccaaccaatatttcctacacagatataaacagatacacttgatgggtccaaagtccaaactgttactagctccttaattacatcgatgatgaggtacatatatgatggctattcatgatttggcttaactaatcattctcaaacaaagtaaatacaagctgtaattaaaactggagtgtcagcatgtattcgtgaaccctcgttgaacatttaaacaagcttgaactatatataatgatgcgtaaatgggtagaggtatagactaatcaccttgatcttgacttcaggaaaccatgcatggttgcatatgcataaggaggaagatgagcgataatgtctggagagcagacaactgacatgcatatactaggtgcttctctaatgcagaggcttcaatgaaatgacgtgcggcgttccattccctggcatatattcctgccttgtgcttcctttgaattgcttttctgcaaagcccccaaatcggtcatatgctgcacgcagcatcaatcatcaaattctttgcttgtatctgtgtcagatgccaggctagctgggacctgccatgaaagataactaaaggtaaaggtacaaggcaggtagagacatgtacgatccaattggggatgggaatggatcaatcgactgaagatttgtctggttaggttaggcctacatggaagaagattagtacggtaatgtaaaactatttcgacccagtgattgatagaataatcttgggcatttgtatttttcttaagtttagctgcatttcagttcgttagttgtttcctcatgcatgtaataagctgactgaaaataagtttagctgcattacagttcgttagttgtttcctcttaagtttagcctttttttagtcgttgtggccgagctgggaacggatcgtgggatggcacgaattctcagatctagctgtttaatcggtcaagttttgcatgtagcaaactcttaagatggaggtgaataaatagaaggagaaaaaccgaaaagctgcagcggcattacgcaacgcaaaaccagtcgttcttgttgctctgttttcttcgtgctctgttcttcagtccattgttcacgtctggaaatattcagagatagtaggatagccatagatcgagtgcagagtgagggaaatttgctgacaattggtatcagagcgaggttccggttccgtttttgatgttgtcggatgcgcgctacattccgccgccgaggcgtggtggaagtgacggtagtagcagcgagcaggggagcggcagtgcaaatggcgcaacgatgccgctggtgccgctgtccagagatggtggcacagctgcgaggctgccaatgcgacgaggacgaactaccccagctgggagatcgaccccggctacgtgaagtaccgcgaggatcgtgtggccctctctgccatactccaggccattccgcgggagatgttgcgcgggctggcgaagcatgacacggcgaaggcggcgtgggaccccatcaagaccatgcgggtcggtgtcgaccgcgtgcatgaggccaaggagcaagggtttcgccggcaatttgaatcgatgcggttcaaggagggagagaagccggaggagtttgcgatgtggctgacagccgttgttgcgaacatttgcgacattggcggagtcatggaggacgaacatgttgcgtgttgtccctaagaagaacaagccggtggcaatttcactcaagcaactcctcgatatcaagaccatggccttggaggagctcgtcgggcagttgtccacgattgattcgtacagtgacgatgattggctagtgccagtggcaaactatacctcggagcagtgggaggtgcacgcgaagcaggagcaagaaggcgcagccgccaacaaggcccatggcggtgctggctcgcaaaatcgcctaggcaaaactactggatcaccgaagggaaaggaagcggctaccggtgggagcggcagtcgtgacatccaagatgaaatgtttcaattgtaatgaatatggtcattatgccaagcaatgtcgcaagccacgacgccaacgccgaggggaagcaaatttggctcagggggagggggagccaactctgctcatggctcatgttatggggttgtctctcactggcgaggcgacatttggccaaacacctggcgtctacgaggtgcatatgacaaagaagaaagtggtcttggatcacgacgatgtaggtgaggaggacactgcagaatggttcctagacacaggagccaccaatcacatgattggggcgtgctccgcgttcgccgacctcgatgccggcgtcgtggggacagtcaagttcggagatggctctgtggtagaaatccagggacgtggcgccgtggtgttcaagtgtaagaacggcgaccaccgctcgttggaggcggtgtattacatcccaaactgcgcaagaatattatcagtgtcgggcgccttgatgcacgcggttacgatgcacatgtctggggtggcgttttcacgctgcgtaacccggcggactcctgcttgcaaaggtaaaactgtctcccagctatctttatatattgagattggacatggcaaggcccgtttgtttggcggcgagtaggagcaaggaggcaaggctatggcatgggcgtttcgggcacttgaaccaccaggcgcaaggtgacatggtccgcgggctccctccacttggtcactatgatcagttgtgtgatgggtgcctcgcaggcaagcaacggtgctcgtcgttcctggaggaagctaagtagagagcgcaaatggcgcttgatcttgtgcatggtgacttgtgcgggccaatcacgccggcaacgccgggcggcaagaagtactttctgttgttggcagatgatatgagtcgtttcatgtggatacgtcttattaccggcaagaacgaagcagcagcagctattaagcaatttaagtacgacgtcgaggtggagactggccgaaaattggaggtcctccgaactgatcggctcgtcgttctgacggctccccggcctcctcgccccacttgtcccgtgcactcgagcacctcctcctcctcggcctccttgagccgccgcgtcatctcagcctctactccctgtgcacctcgtcctccaatagctcctcggcctcctcgccacgtacccccatagcagagccgcgaatctggccacatggccatggccacggcgaccgcagcatgcgcgtgtggcacgttcatcggaggaggaggttggtggccatcgacacgcacgggggctgaagaagaaaagaaaataaaagagagaaggaaaagagaagggagaagaacagtgtccaagggcattttaatactttcaacgccctttctctctctgttttcaccggaaataataaaataatgcctcttgtgtccagcagctaattaccatatttttacagtgtctccaagaaaatacacgttcgtttggtgtcttgcagtaaatgccacaaactttgagtatcctgtaataaattttgcccaattacatcaatcggctggtcgattttcactactacacatgtgcttttcctggacgccggcccctttaggttccaggcgggccgtaagtggctccgcctggaaccaggcgatcccggcgtcgggcagtggaccacatgggataatcaattatctcgtgtggcccgtgtaagccgaccgcctgcgatggtgggggagctatataagccccagcccgactgttgctatggcatgccggcgatttctctctcctaaacctccacaaattaggggggaaggttttcgacctcaaatttttgattgggttccatataaaaggtgtagagcttgctctcctccttcatttgcttccatttttgtcagttttcttatttttgtcagtacaatacgaagaaacttgcacatttataaatggaatagtgtaggcacttttttgtttttttcttatttttttagcaaatacataatgattccattacatgtttataaaagtatttagtacctaaattgaaaagttgggtttgtctctattaaatttattttcattcagatgaaagtacgatttttttcattttttttagaaatggataatattttattaatgcttaaaattgttgtgcggccgtttaaatagtccgtaaaactttaatttgttatgtgattagttccctccaatttaaatacattcgtgtttgaatcgggcatggatgtattaatgacaagctttattctaggtcatggatcggacatggatgtacaacacgaaaagagctcatccaacgttcttgaaggaagcaaccaaatttgttgaggtcgcaaagacacatgctgtgagggagaatttgagaagcattttttgcccatgcaaagtgtgtaagaacgaaattttgttgcaagatccgaatgaagtattgtcgcacatcgtagagcgaggatttaagaagggctacgagatatggacttttcatggggaagtcggcggtcgtaacgaagtgacggatgatttctgctttgatgatgcagaaaattttataatcgaagacatgtcacagggaaacatcccagaatgcggtggctttggtatagagaatgaaggtattgattttgatccggaagatatgttgcggcacgttgaaccagaggtcctaactggtagaacacgagggttggacaattcggaagcgttggaaaaagcagcgtaggagcttttgtacgacgaagcgaaaggatgcgacaaggactattcggtgctgcgctcgatgcttgaacttctcagattgaaggccagacatggatggtcggacactagcttcaatgatttgatggaccttttgagagttatgcttcctaagccgaacctgctaccgacgaacacatatcaagtgaagaaatcgatatgtccattgtctctaggtcttcagaagatccatgcatgtgaaaatcattgcatactgtaccgcaaggaattcacggatttagactcttgcccaacatgtgggacgagtcggtacaagacgggcaatggagcctccgatggagaggtggtcgacaaagatgatgcaccggtggatgagaataaaaagattcctaggatggtgatgtggttcctgccagtgaaagatcgcctgaagcagctatattccaaccgtgacgacgccgagttgatgagatggcaccaggagggtaggaaaaatgacggtaagatccgacaccccgccaatgctcgacagtggaaaaactttaatgcactacacccggaatttgcaaaggacccgagaaatgtaaggtttgcattgagcacggacggaatgaacccgttcggtgacttaagcagcacacacaacacctggctagtgctgctaaccatgtacaacttgcctacatggatttgctagaagcgaaagtatattcttttgtctatccttatacaaggtccaagacagcctgggattaatatagatgtgtttctggaatcattgatggaagacatgcaagaattgtgggaggaaggattacgaatgtgggacgagtaccgtagggaacattttactctgcatgccatcatattcgttacgatcaacgacttaccggtaaacttttcgctctcgggccagtttaaggggaagttcggatgtctcatatgtatcgacaagatgtcgtacaagtacctcaccttgtcaaccaagggtgtgtacatgcgttgtcgtcggttcttacctcagaggcataggtggcatgcgaaggctagattattcgacaatacagtagagaacgatctagttccggaaacacgaactggtggctctgttttcgagctgagaaagaacattaagattgtgtttggcaagccaaagaagaagcccgtcaagaggaagaaatggatggatcaggaaaatactgatgcagctgcagaagaaagtaatctgccttttaagaagcactcaatatttttcaggtatctggattactggaaagacctgaaggttcgtcatgccatcgacgtaatgaaccttgagaagaatatgtttgatagcaccattggcactttactggatatcccgagtaagacgaaagatgggttgaagtcccggaccgacctcatcaatttggacctaaggcatgagcttcaaccaaaagagctgccaaatgtgaagatcgatattcctccggcttgctactcactgataccggaagagaaaaaaaattatgtagatgcttgcatagtgtgaaagtcccgactggtttctcagcgaacgtcagaaaacttgtatctttgaaagatttgaccatctctgggtacaatgctcatgattgtcacaagatgctaacaatcttcctaccgattgctataagagcagtcaagccagttcacactcggttagtgataaccaagtgctactttttcaatcgagtatcacagaaggtttttgatcctgaagagttaggaccccttcaaaaatttgcaatcgagacaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64519 - DNA, 3238 bp, Oryza sativa
ctccaaattctcttgaaaggagtaggtgtctgctgaatacaaagagcattgtaaaaagttttgacagaaaaggtcccttacttagtcaggttccagcggagcctatctttgcaacctggctgaaagtgtcatcagcaaatttttgtttaatgaggttccaatctgtcaacttttcatcaaccaaggtccttctaaacttgaccacactccaacctttttcttttatcttagctaaggagataagttttgtcaaggtaatattataaagagcagagaactgagaggatagtggccagccacccatccagctatcctcctaaaacattacagatctcccgtctcccactttgtttgaacacagactataaaatttgtcctttagttcaagaagcccctaccaaaagtaagaatctccagattttgctttcaggacagatatgggtttcttcttcaagtatttgtttctcagaaaatcttgccaccatccctcttcattttcaagttgccagatccatttccctagcagagctttgttcataagatcaaggtctaacactcccaacccccctggtccataggagtgcagataactggccattgaacaaagtggtacttcctaatgccagagaagccttcttcttaaaaaaaatccattctctctcttcaccctgaggaattctataaaaggacaacatgtagagagggatattacttaagctggagttaatcaaaatcagcctcccaccaattgattgaaatctcccttgccagcaacccaacttgtgttccattttgtttttagctgttttccgatcctttttcaggatccttcttttatctataggtacccccaaatatctcataggcaaatcacctatgttacaagtaaagagttggctatagttttttttttgtctttcttctgtcaatcctatacaaaaaatttcactcttgttgaagttaattttgagacctgataattgctcaaaaagacacataatatatttcatttgtggcatattctaaactatcaggaaataagagaatagtgtcatcagcatattgcaaaacggcagctttgttttcatcattgacacctgatccttctagcaaggaattattttctgccctatgaatcaacaaagtaagggctttagctgctaaattaaaaagcagaggagatggagggtctccctgtctgagacctttgtaagtttgaaagtaagggccaacttcatcatttactttgactactactttccctgctctaatgactttcatcatctaggcgcaccattgaggtgggaaattctttgcaactagcattctatgaataaaatcccaatctactttatcataagctttttcgaaatcaatcttaaaaagaatgccactttgtttcttttagtgaatagaattcagaatttcatgtagaattaccaccccctccaatgtaaacttattcttaagaaaggcagtttggtttctggagataatataagctattacacattcaatcctattcatcaaaacttttgtcaagattttgaagctcacattcagagacaaataggtctaaacttttgaatttgcacagcatccttagttttaggaaccaaagtgataatgccaaagttgagcctctctacatccaaaattcctttatgaaagtcattcaataaatctaagagatcaagttttatcaagtcccagaatttggcataaaactccccaggggctttattgtgtttaaggtcaaataccacagtcttaatttcttccaaactaaaaggctgaatgagccttgctttgtcttcctcagagactgtagaagctccacccatgtcaaaattcatggtgttttctttagaatggccaaaaagttccttataaaatagtgttatataatttactaattccctttgtcccactatcttaccctcctcctgagagagggagtgtatctggtttttcctcctcccatttgcttttgcatggtaatattttgtgttacaatcccgctctaatatttctttaactttgcttctttggtaccatttcagcttttcttccataatcataaaactcagctgttgctctaacacccttctctcctttctatcactattagtcatgccagctgattcaattttgatgtcaatagcatcaatttttttgaaaatctcttcttttcctttcttatacagcccttcccagtttttgttccagccattcaactttcttctcagggctaagtttcttttgccatctctcaatactactaccagagatctggctattccacacttctgtcactactttagtgaggtgtaacagttactaggtaattgttgctacctagtaactctattttgaaagcttgaaagaaatgtttttttaagttctctctttcttttccacggtgttggaaatcacttgcttgaaaatgggttgtccgttagatttattaaatgtgtgttttgttcatggtcgtcgatggatgggatatgtccatccataatttattcgatatatcaatcaaattttttgtttgattttaatggatgggagcatccaatttatagttcggttgaaacaataaaacatagatgggataagcccatggtttgcttttatatatacatacaataaaatataatcacccggcatcttgtttaataattaatataacagtgtaagactcacaaattgggtaagtggtttaggagaaaaaaaatcatttgcaacatgcaaacatgaaatcgtacccaccacagctaatctgaacatgccacgtccaagtcctccattggaggattgatcatattaagactctctttgtttagacttataagtaaacaaatgtctacctaagtaaacaaatagctttcccgattagaccttttaaagacattcttattcttaaggaaaacaaaactatagaatttttttatatatgtgaagtggaggtatgactttgtattaaacttaaagccttgaaacaacttgcttataatacatttgaacaaaaggtttgcttaaaaaataagtttaagaacaaacaagttctatgtgtttttgcacaaattttgacaatttgacgctttgcggaaactaattttacaaatgaaccgcggccaaaacttattttagaaatgacccttttgttcagcgccaaatcgtatggcgctgaacttaaacacctcatcgccacgtcaacagacgctgaatgccgtgc

SEQ ID NO: 64520 - DNA, 4206 bp, Oryza sativa
cgcgctaaagaaaagggtcattttttatataagttttggccacggttcatttgtaaaattagtttttgcaaagagtcaaattgtcaaaatttgtggtttttgcttaatatataagtccaaccaatctcatctacagctatgccgggacctagcttgcttcgttgtgcaaggtaaatccgtcgatgtcactgcacatacgggtttggtttgtattgacaattaatttcattttcatggattctattgaacttgtaataaatatttagatcgataaacatcccaaattaaaggacatggccctcttttttttttagataatggcgctctacatcatggatatagatatgttccctataacatattctttcacgagcaatagataactatatatattttttttaagataatgggtagcgcccggcctctgcatcataggtgaatgcacacggccaatagataactagataactagtaaaaatacaataatgtttgagttctgtggataatatgtgatggggttgagaggtctctggaaagaaaaaggcactgggatttggaggtttcgactccaaagaatgccggtgtagacgtgtagtagtctcggtgggaatttcccacaacatccaagtcgactgtgaatgcatgcgtgcgtccgtgtgcagtatactcagatgtccggggcttgcgggcgtgtggtgagtggcctttagaccaggcgtaggtgccatgtgggacatcgctactcagtgacatgttagtgtgaagtcctcatatcagtgccgatttgtgtttacgattagaacaacgaggtctagctcggagcaatcatcacatatgggttgaaagaatgtacctgtcagaagcaaaatccagtactcactccctcccaaaataagtgtagttttgcactatttatgttcaacgtttgaccgttcatcttatttaattttttttatgattactatttttattgttattacatgataaaatatgaatagtacttaatgtgtgactaaatattttcaaatttttcataaattttttaaataagacggatggtcaaatgttaggcacggatatccacggctgcacttattttgggatggagatagtagtattcatgtttggaattatataactggacgtcaatttaattatttgttgtatgaagaaagagcaacggtttgaggcgtccggccaagggcatgcagaatcatcttttgttcgacagcaaatcaacaagagagtgattctgacctttgccacacatcttagccagcagtagaccttacttttcctttggcttttgtggtagatgcggtgcccttaagaataacagctgttttttgggaaaaaaatctatttagaaagttttgaacatatctacaggaattataggtagagattttcaacataaagttaacgagtccctttagcaaaattttctacacagtgtcttatcagtggcactttccataagagttgataaaacggttggtgatacgccctataggcaattataaagatgattgtatcacatactatgtttacatatttattatattttgttcctcgtaatagatacctcgaaatagatagctcattactggttaatagatatatgattctttcatgagattatttatgttgtatgttactacttgtaaatgatccctggtcaaatatcatgtacggaacaaatatggttcaatgataagtatatgtattgatacatgatgatgtctcatggattatggtatggagataccaaattaataatgtggacatatgttgttggatagatccaacaagagacactacaagagctatatgtgtgatgtgctatcagtggtatcatttagtgttagtgtagaattcatagagttgagattatcttgagtcccgacatgtgtagtaactaggcagttattaaagtagtattcatgcattctatgaaacatgtagtggaatatgaataattaagacgggatttgccctcctccagggagatatttttggggccctcggtgttatacattatggaggtgcatgaccatgtcgaaagtgattgagtcaatccaagtcaaatgatctatcacatgatcgagtaaatgattgagctattaaaggatggtatatatctagccttgagcttaatcaatatcgtgaagcaaagtagttcaaacaagtataaactagaggttcagtcgatatgatctttatgtatttttggtaagtaaatatgttctgctaagggactctgttgacatgtggactggaaaagaagttttaatgttgcagccgagtatacatgaacctgtggggtcacacacttaatgggctagaataaaaaggattggatggagatcctgttgagttgtgacccaaattcatttgtacttactaaaggccagcttctgccggagcgaagcggatgcccgtcgccggaggcttgggccggagcgaagcaaaacccgggttccaccatatatatacctcttgtaagccgccgtacagcgttgtaacctcacatcgatatagtgaagatattttgctggctggcacccgtcgttttttctcttcttctttgggagggtttttcacgttaaatctcgtgttttttgtgattgatctattgttctttatcgttcatttgcctatcatttcctaacagatccaatatgtgctccagctgagagtccgcccgcgcgtggcgttccatccctgaacgtgtggatgtcggtcgagccacctctggtttgtggtgttgatcggcgtgggagcatggtgagacgaatgcacaaggaggagaaggtcgggctactgcgatcaaccacttcctctacatcgacgaacactacattgtcaattttcctttggcttcatagcacctacttccgttgcacagcgcatcgagtggtaatgattcacgatctacttgcatggttcctggttcacgcggtagataatttttatttattctaccgtagtctttgcgggatcatacttctattgaaagtgacttatttgaaatgcaagatcatacttttgaataacattctacaaaaaatcctgctagtcatttataaatctcaatttacattttagatcttaattaatagtcctattcaacacaaattcagaacaagaaatttctaaggacaatcgctagcccactcatgcaagcccatgctggctcagtatatagtatgttgagggaggcacaggaagtccaaccatagcaaattaaaaggctactgtaaggttgcactcgctgtggcctcatggcagtcaattatgatttctgtactaatctgatgtttgttcccttcatcaaatttgttggaactaatcttgttgtaaatgattatatggtgtcgtcttagtttagtttgatcaagtcatatgttgaaatagttgcatgagagctcatgcatgcatgtgtacttcctctgttcacaatgtaagtcattctaatgtttcctatattcatattgatattaatgaatttagatagatatatatatctagattcattagcatcaatatgaatgtgagaaatattagaatgacttacattgtaaaacggagggagtagctgggaacatgataggttcacgttgttcctggtttgcaaggttaggtagctactaggttaggcaatgcaagcatgtgttgcacgtaaagcgagtccgtacattgagccgataagcctcttgcgtcactactgcagaggtgattttccttgatgccaacccattttggttccaggcgggccaaaagtggcttcgtctggaaccaggcgaatgccggcccgggctgtaggtcgtacgggataatcgattatcctgtgcggcccacgtaaggcgaccgcttgcgatggtcggggggcatataagcccccagcccaaccgttaacagtatttctggcgttttctctctcttaaacatccgcaaattatggggggaaggttttcgacctcaaatctttgattgggttccatataaaaggtgtagagcttgttctcctccttcatttgcttctatttttgtcagttttcatcggtggaatacgaagaaacttgcacttttataaatggaatagtgtagacacctttttgttttttattttttttagcaaacacataatgattccattacatgtttataaaagtattcagtacctacattgaaaagttgggtttg

SEQ ID NO: 64521 - DNA, 16237 bp, Oryza sativa
tgtgggctgtgttcttgactcttgcatgagtccatgggcttaggaggtgtcgaggatttgagcatgagaaacagttgatgtggaaggatcaaacatcacgaactaagccaaccagaagaggggtgaatggttgtagtatccaaaaaccaaaatttttagcgaaaataaaagttacccttgaatcgacggattatggtttgaccgaagtagatcggccggtctgaccgcgcctatgtcaccggtctgaccggtatagattgaccggtccaaccgtcccgaagtcgcctctgcttcctgtcaccgtcgccagtctgaccgccgtgtacccgccggtctgactgctggtgtctcgccggttagaccgctgaacccgagcaaacacaaatcaaagaactcttgatgtagatgacaactttattacttatctctgtgtttagaaagtgcaacaacaacactcctaaagaaaatctctactaaactcgaaaccctagctattcttacaactcaatgctctctaaaatgataccgggaggcctcaccctccctctctatttatacatgaggtaggcagtctaaagccacgaaccaaacttatacaagaagtcctaatccacctagtataccttcctgtacatgaaaccaactttacaaactccaatcataccaaatttggactccttcaaaattcgaatccgcatcccatacacacacaatatctccatcgtatgccatatggaatcttcaccaaccacgtgcgttaatctttagcctaagtatctcgcatgatatctgaccgtctggacatcgccttatctacaagttgactcccgatccatcaccggcaatactcacccgaggcatcaagacacctacacttgaatcaaacaaaaaaaccatattccgagaccaagctatctccaacttgactcattgttagcaaacaatataaaatcaaaggtgtttttgattattattctgtgatgaacaattgggcattggagattattggttttgttatttggaatttattcacaaagtggttttggagatgattggatttacacgtgaatcgcaggatcgttatttcatgtgactggtcagaccgggcattgtgtaccggtcagaccggcggtgatcgagtggtcggaccgaccagcccgcggtttgaccggccgacactgtgtcggtttcggttttgggttgtttgtttcgatatccgagtttatttcatgattatggcttctaaatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagatttcatatggcatacgatggaggtattgtgtgcgtatgacatgcggagtcgaatttggaaggagtccaaatttggtacgattggttatataaagtttctttcttgtattagagggtttcctaaggtgtttaggactcgtagtatgagtttggttcgtggctttaggctggctacctcatgtataaatagagggggagcgtgaggcttcccggtatcgctttagagagcaattgagttgagttttgagttagggtttcgagtttagtcgaaatttttctaaggagtgctgttggtgcactttgtaaacatagagagaatcaataaagtcgtcatctactttaagagcgggtttcggcggtctaaccggtgatctaccggtggtcagactggcggcaagcggcggtcagaccggcgggagcacggcggtcagaccagcggcggcagcgacaggcgcggcaggctacttcggcggtcagaccggagattcaataccggtcagaccggcggcatctacccggttagaccaacaggacaacttcggtcagaccgcgatccgttgaattcgagggtaacttttatttccgctaaaagttttcggtttttgggtacaccaaccattcaccccccctctggttggcttagttcttgtgattcgatcctacaagtggatcagagcctgacgacggctgtggcctccggctatggccgtggcggcggcagcaaccgggtcgacagcggcagcggcagtggttatctggggtgttacaccatgtctgccataacatgaggagcttcgtagacaaggtgacattgctcgaccctgaggtgtctaattcaattgtttatacacacataggatgacaaatttacaagtatgtagactaacttggcgctgaacatgcatgaatttatttcaaggattccggaaatcaacttcgaaatcattagagaggagatagcacaattcatactagatgatatcttgtcaccaaaagggatgtttagagtgaagtcctaggtagctcatctcagaatggcagaacatttgcaatgcatacgcgataaacatttgatttttgtaaatattctttgtaatacaattaaattctttagagtaaagtcctaggtaacttgtctctttatatacttgcatttctaattacatataaaattgttccaatttataacttagttttgcaggttttgatgcatgtcggtggtttggagagaaaaatggatgtgaatgacatatacttcctccttttcacagtgtaagactttctagcattaccacattcatttagatgttaatgaatctagacatatgtatgtgtctagcttcattaacatctttatgtatgtggccaatgctaaaaagccttagattgtgaaacggagggagtatatgtgatgtgaatgcatgtgttgtgatggaatacaaatgtgaatgagttgtgaattggctgtgaatgcatgttttgtgatggaatgtaaatgctgtgatgctgggaatataaatgttgtgaattggctgtgaatattgtgatgctggaaatggggttgctgggaatgggactatatatatgtgcttctatcaatttttgcagcgggcatggctagcaaagtcctaaggctagccaaattataaaattttattttttttttccaaactcatccctgacgggcatattaataatgcccgaaagagatatgtcatccgtgacgggcttttagaataagcccgatagagctaagtcatccgtgatgggcttttagagtaagcccaatagagataagtcatctgaaccgggactcgtttgacttaacacgtgaggtcaaaccaattggtgtcgggctctatctaaatgcccgattgagatgactagttacccgtgacgggcttagtggtgtgcccgattgagattagtcatccgtgacgggctcctaactatgctggtttgactggtcatactcatctgtgacgggctttgttttcggcctgattgagataacatccatccgtgacgggcttttgcccgattgagatttttcctcacatcagtgacctttgtccagtgacgggggccttacccgatagtgatgaggcttttagcacgtcacagataagcgatcccgttctagtgggaggtggttcttcctccggggcgaggctaggaataagtctattttgcctccgtcaactcatgctctagttgaatcgcattccacaacccctaaaccgggtataacccgtccgctaactttcaaaaccattgcaaatcgactttccggacggtttcggataagaataagttcaccagccgtccctcaactttacagtgactggaaggtgcatgtagccatcccttccatggtcagaaaagaagcacggaaaacatcgttgccagggccatcttctgcttcaacgatcgatatgtaagcacatcactgacagttcgtaatcaaacttgagcagtgattgaaacaatttcagccaaagaaaaaggaaaaaagagttcgagcagaaaacggactctgtttatgacattctgcaatcttggatgcgtatgttcttgcattggtcgtcgggtgtagatctacagcggatgccaggggacagcacaggctggggtgggagggcgtgctgcgtgtgccgtcagaggcggaaggatctggcttcccgcccctcggaagcggcgacggctgagggggcgagcggcgcagcacgcggatccagtacaccgctagcagcaaccacccgtatggcatcccgccgccatcgccacaccagccccttctcccctcccccatctcccgccgactggccaccctctttagctagccgcgtcgggttgggacaaaaagagaagaaagaggaggatacctgtcatgtgggcccacacatacgttttgttattgttttgctgactaggatgccacgttagcgagaccatatatatatacagttatgagaccaaaattgcatggttttatataatttaggggtgaagattttcgatattggggattagggatgttatacaaacttgacgtaaagtcgagggatgacatgtaaacttatttctctcagaggcgattccgtcctacgtgggaccaaacagcccaacaagggaagtagcggcccacgagggcacgacgggcccaaatagccccaaactcctcagacgggcgggctcacaatgattcatgggtattcaaatgaaaacccaagattttttttaaaaaaatacatatatgaagtatatattccatatgtatatgacatgtgaacttatttctctcgagaaaaagtacatcgaaggtccatcatgttgtcatcgggttacaaaatcatcctccaaccacaaaccaggtatatcgcatccctaatcttacaacaccgggttactttaggtccctaggcggttttgactctggttttgatcaatgtggcagctgagtcagcatgggaccccacgtgggtcctacacgtcagcctcttcttcccctcccctctccacctctcttcctctctcctcatctctccacggccgacggctgacggagacgagctgtgcgcggcatgccgatgcggcgggagcgggcgcgggcgaaggccggcgggtgcaggcgaaggccggcaggcgcgagcggcggcggcggcgtcaccgagctcggccaagcatcagcgcgcaaagagagagcagtggcaacaatcccgcgtctgtatcagccttagtcccgacggcggggagcagctaaactatgggatggtcgacgtcacacccgcagcctctttccaccagacgcaccatcatcaccccaacctcaccggcgacgacaacgacaaactccctccaccattccccttacttccgccatcgccctccttcgcctctccccacctcgccggcgacgacgacaaccgtaacgacgcgagcgcaaggtatgtgagcacctcctttctcttcgccccaagcattgccaccatcgccaccacaaccgccggcagcagcctcagctcctcttcgtcggtgtcgctgttccctacatgctctgcgccaaccagctcctctccgtggagagctccacccgccaccgtcaccacggtgctcaaggtcctccccgagcgttgacttgtgcttccgccgctcagccgcatgctcctgcactccttcccgacgcgctccgctgctccttagccacccgcaacttccacgaactctttcacgcactgctcctgttcctcaacctttcttgtcagctccgccacggcctcgccatgcgccgcgtgccgttcccacgccgtggtgaagacggcgtgcatctgctgtcgcaaaccccttcctctcccgcagcgtgggctttatctgcggcgaccaccggcaccgccgcctcccgtcggtcactctcgtgcactggaaagagatgggggaagagaagggaaagaggaagaggagctgaggctgttgtcgatggctgtggtggagatggcgacgaaagagcgtcaggtgtcgccgtcactgttgccttcgctgggcaccccccgcctcgaaggtctcgcgcacggacagaaaggggaggaggagaaggaggaagtgcccaggtcgtggtcggtgacatcgccgccgccggccaccacccgtctttgccagcgagcgccgccgccaatggccgccacttgtctttgccagtgagcgtcgccgtcgcgccgcacccttgttgtcaatcaccaagaagaggactgcaggtcagaggaagagaggtagagagagtagtgcaaatagtcactgacaggtgggcccacatggggaccacgctaactcagatgccacatcatctaaaaccgaagacaataccgtcgaggaatctagtttgcactttgcactgttttgtaagttggaggatgtgtcatgtcgggttttgtggttcaagggcgattttttaattcaatgacaagatgagggaccttcggtgtactcatccaaaagaagcccaaacctatccctcccaccatcttcctctccccactttttaaggcccattggcccaatagcaaaaaaaaaaatggcccaaactctatcaaaccctatctcctcacctcccgttcccgatcccgccgcccgccgcccgcccgcgcccggccgcccgtcgcccccgcgccgtcgcgccgtggccgtctcgccgtcgccccgccgctccggtcagcccctccacgcagttacacgcgcgccgcccgcccggctcggcagccgccagcggcacgcgccccgcgcggccagggccagccgaccacgccacggcaccagcgcggcagcgcgccccggcgccccgatccctccagtagcaggcaagcttccgggctccagtccaccggccacacgccagcgacgccgcccggtcgtccgagtctcgaaggtaactcttccctagttcccttcatcccctgtcctgcgcccttgctgcccgtagatgtcatgtctgatgttgctcctgctaggtatgaggccatgctctgcttcatttttaccatgcccttgtgcagttcctgctccttaggtgcctcctaattcttggaatcacgcagataaatgacaaatttgcagtctagaaacctttagctgtatgtgctgaacttaaataggttgtagccgctgcttttggtgtgaaatctagttgagggagagggtcaagactgaacattttgtagtttttgcttgggttcaggacttcagatactaattgaaattaggaagcactccatgctcggagaccagggagttactaggcctttcagacttcagggaggaggagttgttttggaggagttgttttttattagaagatcctgtcagttgttaatgtatcttaaaaactgtacttatctttgttgatagaaaacgttggtctgaattttcatctgagcacctcaaaagtagtttcatggttgaatatagtatattgttgttttgtaggtttgaaacgtgaagagaaaaaacatgaatatagtatattgttgttttgcaggtttgaaattatgtttataccgttatatattatacaactattagtgggttggaaattttttttttatctcttctaatttcgaatacccaagttgaaaatcctgggcccgcctgtccccatggctggaggtgagccggttcccccaaattcgacaacctgttgcctcacgcgctgccgcccgcctccgtcccccgtcgccaacctgccgctgtaatcccagccgacgggccacctctaagtgaactgctcatctcgctcccatttaagcctgcagctagtgggttagctgtttgtcgttgtgcgtgtgttaatctactacgctgcgagaattgtatggtgttttcatttagtggtgcagattgtagcttgtagaatcgatcctccttgtgaataactttggtatttcaatgttgtgcgtgtagaaattcgtaggttgtgtagaggaagggaaccgttgcttcactattgattgcagtttttttttcccaaattccgaatttaattgttgattttagcctgtttttatacgagatgctattgctatatctatatctttttttttttagcaaattttgtaggtgtatattggatttatggtgtgataaaaatttggatttgtgggttgtgacaggcacaatcaacaaaaaaattacttgaaggagttctactgtacagtgagcattcgtcgacgatatggttcatttcaagaacaggtacatggtgatggaggtgttcatcgatacaccagtcaagggccagcccgaccctctcattctcacgcagatcaatatcaccaaagctatcaaagacagcatccagctcaactttggggagtgtggcctagcagcttgtcttgggtcgttgcaaggttggtgtttgttaggagtacatcgacaaccctcttacagttttcagacagcgtcatgaatgcttgcattttgagtcgttatttataggtgtttatgagctctgttcatctgcagtgaagtatgtaaatccgataacgaagctttgcgtgatccgagtttcccgtgaagatcaccagaaagtgtgggctgctatcaccatggtgaggaacattgggaaaatcccagtttcattcaacctgcgggatatgagtggtaagtggataacttcctatatatacatggtggaagaaagcaaattttagttttaggtttacatctggagtaagtttatttcactgtctggtgcccaagtttgggaaatcaattccctgcaataaaactgtctgtctaaccatgttgctttatttactcagcccacagccttgaattcatgcaacttaaatacattgttatcctgattccttgctttgatgcgaccaacttaacgaggactttgaattgctcgctgtacactattagtctattatgacaacaaattctttcacatttacattttttaaagctgcatactaattgaaacctcttggattatagtgttttcgctccataaacgatttcttcctagtgcgtgtgttgaattagtgacttagtgggcttaaatatttcaatgaaaactttagctgaacatctcactacaaatttggattagtagtggttggggaatggattgtgaaactaaagcagttttatcattatgcacgataattgatttctggcaacatgtatcttttcttcttcttctttttttgtacagacatgaatttatttctgattttctgtattcagggcaatcctgattttcagtgtaaggtgaagttcagatgctatcagcgctgctaaatgcattctctttaaattccgatgacatgaatactacagtttgttaaaacatcttcaaacaatatattgtatggtgttttcatgcattttaactctagcatgatggagtctcaacttttccatttgactcctcatgtattttgacatgctgactcgttctgcgtgtttatatattgcattccctaagtgaaatgtttgcaaggccatcgtacaacccggagcagagctaattcatcaatatccttttaacttcattcaggaagtatcagggcctgcaagaaggctgcgttggagtgtgaagaagctaagttcgagtattacaaactggctgctggtgatcgtatcacgcccaagtttgtggagaccatggagagctgctttgccaagattaaaggattagagagctaatgcatcctcgtgtatcatacatttgtttcctgacactttagtggattattaatctgtagggaatcaagtaaacaaaaattttgtttgtctgatcaactaatcactgagcctattttttcgaatgtgcaagaatgacgcatatcgattaagagaaattttgtttgtcttgaattctgtatgtatattttacttgagaagcaaaaccacaagctgacggagtcccaattttcttgattacacaaaacagaaatattaactccgggatgcaatacaacatgaaccatcagattcacgacaaggcagaattgcatcttcagatcaagcaagagaagcaaaaacctgtcatgggcacagttgtcacccacgcagggtcgcatcttcagatcacacacggttgcatcttcagatcagattttagtcacagttcaggatgcaattattatcgcgaagaaaatggcacggtttgaaaattaagggtaaactgaaacatacattggcagttgccaccctcaaaaccagtccctgtgttctttacaccttctgttacatctgaattcaaacatacggaaacacaattcctgcagttccctagaatggttcagcggctgctgaaaagatatatattcattttcccaaaaatataacggcaatttttaccaacacatcaccagatggaagcttcacaataagcgacggttccggctttccaggagttgacaagctccaggacatgctagtcattctgcctctgcttacacaaaccgaatctagtctctgctaacacaagctaaatacaggcaaccttgaaattacgtactgctgttgattaaactgacaaatgacaaccaacttcagagctattaatgaattgttcactattgttatgttgtcaatgaacaaaaatggtttgcatgactgcatttcaacttaataattgcatccacaaatgtctgaaatttgatttctggcatagtgactaatgaccacagtatagcatgttttatgaactaatgaaacatcttccagtggataaaaggtatgctgatttggggtaagatattcaatcatcatcacataatacactgctatcaatgtgaatacaatacaactaccaacccacaatataaaaataaagaacaagaggatatttgatgcgatggaatggtgacaataacaacaggagcaatactaaatacatctcaagagaattacacacgaccagcaataaagtcagctatacgttacaaggtttctctcttgcaaatgccacaaaagaaaagctagcacagcatccacagtcgcaacacaaaaacaaacaaaagtatcatttcacctattgttttggcagttggcagtacagaagaagcaattcttcccttgaaattacaacttcgcgcattgctacggagctccacgataagttgactgcaaccaagcacaccaagatcagtaatgaaataaacaagcataccaaattgaccaatgaaaatatgtttcgtatatatgtagctgtgtgtaattgtaggtttgatgaatttaatcaaagaggcttccaatttctacagtggtgaacaccaaatcagtgttcctagcttctcatcactgttagttccaaacaaacaaaatgcatggcagctcaaatctttagaaaatggtgcttgctaacataatggagttgccaactgatttcattcattagaaagtggaaagctaccacagaagcataatttcgcctaaatcaacctcaccaaattaatcagtagcaataatcagtgaagatagacaccaggtctcaccaattcgtacctatccaatccgaaatatttaatggccatggccgtccgaggacgaggagcagcatccaccgccgccgccgcttgtcccctcgccggcgtccccgggcgggctccggcggccgccgtcggggtcgtcgtcgctgcaatcctcgtcgaaggggacgtccttgtggaagatgcagcacttcttggagctcttgcggccgagggactcgttgtccaccgtcccctccttccacgtcaccttcttcttcgcccgccgcttcagccgcagcaccaccgtctccgccgccggcgggggcgccgacgaggccggcgcggaggaggacggggtggggtccaccgtcacggtcgcggacccggtcgccggcgcgcgcgttgccatcggcggcgaatcttggtcgtctccgactcccgtttcttctcacctgttttttttttcctttttttcgatttttagtttcttttttagtcagcgctagtgttacgacgaattttatttcccataagccaaaacaggaaataaaaattaaataaataatcctttcaagtcatatctacgacgctagaatttttctatcatttggatggtgtaaaccattactacagcctctaacaccaatagagtccgatcttcgttgacctccatctaataagtgcaagccagacaaaggctaggtagtaaaggattgcacgctaataaaaatagagaagattttagtgttgtaaatatggacatatggcctatataggactattttctttaatttatttcatgttttggcttatggaaaaaaaatttaggcgttaagaagtggaaatgccaatttaaacttaaattgaactatatccatgagagttttattttttaaaaacagtgtctgggagttgacatgggaactcctcggtttttttttacggtactagtgggacttgacaagaagaatggatttgtattaccaattagttagttcagaattttttatttacattttatataggaaaagttcaaggttgcatagtattcttttcacttaataaacgatcgtacttacgagttacccgttgttaattttgttgctagcacacacctaaacctatattcaacatcaaattttttcgattttcattatttagaattatttaaacaataaaatatatttagactatatcttagcgtagaaaataatctaatcctcgtaaactaaactttgacaagagttcagtcaattttattgacctgagattatttattggttataggagttaccttgcactttatttggagtattttggaatttttttatctcccgccactgctgggaaaccctctttaatcccggtttgcaacccctatattcccgggttgtaaaccgggagtaagaatcaggtattaaagatcgctatctttaatccggttaaaatactcgggagtaaagatgcattattagtcccggttggtaacacaaatcgaaagtaatgtttttttctttttttcctccttcgttttttttctcctttttcattcatagcacatcacaaatttattcacagaaaaattcacaaatcaacatcaacaaatcatctaaaaaaatcaagaaaaactgaaacaaatcaaaatcccatcgtgccacctggccaccagccaccgaccggcctcccttcccgccgccggccggccacccttcccatcgcctcccctccgaccggatatggcggagggggcggtgtcagacccctctactatcgagactaaaaatctatttttagttccatcttaacacaacaaacgggggaaaaagcctgagccacgcgcgtccagctctctctcccatccttgctccatcctaatcacgcgtccggccggccggcctccatctcgccgccccgcgctgggttgctatcggccggccttccatcacgccgcctgtcggagggaggggaggaggggaggagaggggagggggccggaagaggggggaggaggatgggtgagagaagaaggaaacggaggatgagagaatgggaggagagaaggagattaggatggagcaaggatgggagagagagctggacgcgcgtggctcaggctttttcccccgtttgttgtgttaagatggaactaaaaatagatttttagtctcgatagtagagggatctgacaccgcctaccatatattgaaccgggcctaataatgatttttagtaccagccagtcaggcagcactatcaggttgtgattgccacctctcctatcatgctatctagcctgagaattagttagcaatagcatatactcgctccttcaaataattatatctaagtacatcttatatgtcatactggtttttttattttgttagtatgtgttacatcccgaaatagatttgtttattttgttatgaaagcagtttgaatttttttttgaaaaaaagacaatcactatcgtgactcctacttacggtgatatggagttaccaatcacttcgatctagtcaaaagctaaatcaagatgagttttgtaagactaaaccagctagcaaaatcgatttagatggaacaaaggataaacacccatttcataggcaaatggtaggtttacgagacaaacctgcaaaagggataatcatactctcatagctaagatggacggctttcagtataaaccggtgaagttggacaaaactaggctaaaactagttaaaaagtaaatgcgatattgaaaagcgattgtgttgaaagtagattgtgtgtccaattaaaccggtcttgtctcttataaaaggattagtcttgcctcctacataaccttttccacatcaaattatggtagagataaattagaatttgaaaaatatctccccatgcaagaaaactcgaaacccggcgaaattcgcttcaaacttggaaaatacctccccatgtctctgccgccaatgaaaatctcttttcaccaccaacgaaaacagtttttctagtagcgcttgtttgtttctcactgtgctctgcaaatatgggctggacatataggacgtttaacaagaacatatgggctggacattctagcatctatcacggtacagtacgttgatcctcagaggaacaattgcttttctaccgcaatgagattgcgtagacgaagctcgacaatctcatccaaagtaacccaatgttgtgaccgctcactagtggaaaaaccatctttgatccgtcggccgaaatccacgatagtcccggatccatttaaaaccaggactaaagatgatctttagtcctggttggtggctacaacgggcatatttgatctagtctcggttgtagagatgtcagacgttgtcagggccccgggatctttagtcccggttggtaaacaccaaccgggactaacgatcctaactttagtcccggttggtgttaccaatcggggctaaagatccaccgggaccaaagatccccctttatatatgccttcttcctctttcagcccaagagcaagcttcaaaatttctctaaaaaagaggggaggtcatgccaaaatttcttgtgaaatttttttagtgattatatacaaatcggagatgtctaaaaggttagtaatttcatcctccaattttttttttgttgttatattacttttggagctatgtttcacacatttttttttgtctccaaaactttgttgtaagttgatgagagagaaaatttgtgtggggaagaagaatatatagaaaatttattctcatagtttaaaatttgatgaaaattaatcttaaaaaatataaaacaaactaaattgaaaattaagagaagtacaacattaatattagtttagaacttcaaaaattattaataagaattgcttgtcgaaagagtttttaattattttatcattactgtttgactgtcattattgtacgaaaatttatttatgtacgattttttttatttcatgtagatggatcgacaatggatgtacgctgaccggtgatccaaaaagtttatcgagggcgtgcattatttttttgagagtggccgaagctaacaagcgtaacggttttatttgttgtctatgcaataagtgtaagaaccagaagtagtattctgcatccaggactattcatttccatctgtttgagtcggggttcatgccaagctataattattggacatcccacggtgagcaaggggttgaaatggaagaagatgaagcggaggacgagaacattcccgactgggctcagtacgctggatttgaaggaaatcaaacgggcgaggtggacagggatgttggcgataacaacgcttcggatgatcttggtcagatgttgcagaacgcaaaggaggattgtgaaagtgaaaaggaggcccgtaaattggagcagatgttagaggaccacagaacgtcgttgtacccaggttgcgagcagatgcacaaaaagttggataccactctggagttcttgcaacggaaggcaaaatatagtgttagtgacaaggcatttggcgatttattgaaactcgtcaagaacattcttctggagggaaacaaattgtccaagacaacgtacgaggctaagaagatagtctgccctctaggactggaagttcagaagattcatgcatgtccgaatgattgtatcctatatcgtggtgaggagtccgagaacctagaagcatgccctgtttgcaaagcactacgatacaagattagacgagaggatccaggtgaagttgacgggcagccaacaaagaagagaat

SEQ ID NO: 64522 - DNA, 2542 bp, Oryza sativa
cccccttggctatgcatgaagaggaaatacataatgatgccgattattattcaaggccccaagcaatctggtaacaacattgatgtgtacccaagacaactagtcgaagattttaaactattgtggaaaaaggatggtgtcccagtgtgggacgaggacaaacaggaggagtttaacctacgagcgctgctgttcgtaaccatcaacgattggcctgcactaagcaacctttccgggcagtccaacaaggggtacaaggcttacactcgctgtatggaaagttgtgtacatgggtcatcgccgattccttgttgcaaaccacccggtacggaagaaaggcaagcactttgaacataaggtggaccaccatacgaagcctaaacatcacagcgggaaaacaatgtttgctatgattaaagatcttaaagtagtgtttggaaaggggcctggaagccagcctatagagagcgaagatggtcacgcggtgatctggaaaaagaacactatattttgggagttaccctattgggaattcctggacgtccgccacgcaatcgacatgatgcacctcactaagaacctttgcgtaaaccttcttggctacctaggtgtatatggaaagttaaaagatacacttgaagcacgtaatgatttgaagcatatggaacaacgcgacgaccttaacccggaaccaacggagaaaggaagccattacttgagtccagctagctacactcttaacaaggcagagaagaaaagtatgtttgaatgcttggagagcataaagttaccgtctagatactccagaatataaagcgaataataagcacgaaggagaagaagtctcatgactatcacgtgttgatgacacaactgctaccagttgtaataaggggtatccttccagacaatgttcgggaaataataacaaagctatgtgctttcatgaacgcaatttcgcagaaggtcatcgatccggatagattagaagcccttcagaatgatgtggtgcaatgtcttgtcagttttgagttgatatttccaccttcatttttcaatataatgacggatctgctttgtcaccctatcaaagagatcagtattctcgggcctgtgtacctacacaacatgtttccgttcgagaggtacatgggcgttctgaagtagtatgttcgtaaccgtgctcgtctagaggcaagcttcgccaaggggtatggaacagaggaggtcatcgaattctgcgtagaatttattgaagacctttgcccaatcggggtacctgaatcactccataaagggagactacgggacaggggactctcggaaggaaagcaataatgacggtagacaacaatttattccgtaaagcccatttcacggttttgcaacaatcttcattggtggctccttacatcgaggagtacttggctctaggtctcgccagaaacatcggtaagttcgatgcatagattacacagcatcacattgatactttccccgcgtggctacgacaacatgtaatgggtaacgagacgattaaccaacaactggccttcctggcgaggggaccatctggctcgatcgcgacattttagggatatgagatcaatgggtacacattctacacgagagcccaagacatgaaaagcacgaaccaaaacagcgatgttcgtatcaatgccatgagacatgatggaacaactggcacgtattacggtgccatcgaggacatatgggaacttgactatggtcctctcaaggtccctctgttccggtgtcaatgggttaggttgactggtgaaggcataacgattgatgacagtgggatgacaacggtagaccttaacaaggttggatactcggacgttccttttgtccttgccaatgatgtaacacaagtcttttacgtgaaggacatgtctagcaaaggaaagaagggcaaagggcctgacgggccaaagcgccacgtggttctcccaggcaaaagaaaaatcatcggagtagaggacaagactgacgaggattacaatcagttggatgggcatcctcctatcaaatgaagacaccccttactcacgtagcgaacacaaggagggaacaatagtgaggagaaagtacgtgcggtcaaccgtcaccgccgatgtattgccgtaattattgtgtacacgatgtaaactattttggatgtattgattatccatataaatcaatcgttgtatggcttatgttaattatgtatgattattagaattttgaacaattttaaatcgtgcatatgctagtaatatgtgataattagaattttaaaagttttaaatcatgcatttggcatttacatatgttaattagagtttttaacaattttaaatcatgcatatgctaattatatatgattattagaatttttattaattttaaatcatgcatgtggtatgtacatatgttaattagaatttttaacaatttaatatcatgcatatgctaattatatatgattattagaatttttaacaagtttaaaacatatatttgcttattacgt

SEQ ID NO: 64523 - DNA, 1477 bp, Oryza sativa
cccgccgatgccgaccccgacctcgatgcggccgccaccgccgacgacgtcgcgccggcactgccgatgacgccgacgccactgctacgccgccgcgccacgccgctgggccgcgcctcgctgccgccgcgcaacgccgcagctgcgctgccacgccaccgccgcgccacgccgctgctccgctgccgccacgtgaacgaaacgtgaacataacgagaacgaacgtgaacgaacaaacgtacgtggacaaaacgtgaacttaacgagaacgcgaacgtgaacgaaacgtgaacttaacgagaacgcgaacgtgaatgaacgtgaacgaaacgtgaatgaacatgaacgaacgtgaatgaaacgttaacgaacgtgaatgaaacgtgaacggtcgccttatacgacactacgtgaaatacaatatatgttactttgcgtttagactaatacatttttttgtatgttgcagaaaagacgtcgtcatcgtcgtccctcaagccggagtggtagctagccctcgaaggaattcgcgcaggtacgtgatgtaaagatatgattgttagatttctaatataatataagactattagatttaatatacgacacttagacatagcatatatcattatctagggttctaatgtacgacacttagacatagcatatatgattatttgagttctaatatacgacacttagacttagcatatatgattgttagagttttaatataagattattagatttgtaatataggactaataatataagactattagatttaatatacaacacttagacatagcatatatgattatctagggttctaatgtacgacacttagacttagcatatatgattatttgagttctaatatacgacagttagacttagcatatatgattgttagagttttaatataagattattagatttgtaatataggactaataatataagactattagatttaatacacaacacttagacatagcatacataattatctaggactaattatataagactattagatttttaatataaaattattagagttttaatacaagattattagagttttaatataagattattagatttgtaattagacttagcatatatgattatctagggttctaatatacgacacttgaacgaggaagggaacgtggagagggatgcggaggggaaccaggagggaaacgtggagagggatgcggaggggaacgaggaggaggaggctagtgaaagtcaaccctccgctggacagaagagagcccacggacaacgaggtgccgcgaagaagctagagggtcgacacatcataacagaaatggacgaagacggctgtcacgccctgaagttcccctttccagctttaaaattgtaaaataaatcgtccgaagaaattgttctttttaacctagagctaattcctcaaattaataaatccaaataataatcggaatgggca

SEQ ID NO: 64524 - DNA, 9471 bp, Oryza sativa
agtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatatatatatgtatatcgggagatactatactacaacaggggtgtagtatagctaaaacacacccacactcctgtcctccagccagtccgcacccccccccccccctaagccccaagccccttgtcgcatccatattctgagtaatatttttactggacagtacctacacaacatatatagatgtctaaccacttctccattcagttacaatcaatcccgatcctatttttttggatctgagagacagaggcggtcgctttggcggctcggtggagcagttgagcgtcggcaacggcaacagcctcgactaggtgcggcggcggcgacggagaggatggagcggcgtcctccatatcactctcccggcgccgacgcccgcctcaccggatgtggccacttgcttcttttcaacacgaagagaaacgggagaaggagaagaaagggatgccagtgatgttgcaacgtctcctctgtgcacctggcatcaaccccatcgatctagtcatctcctttctcctgttccgctttgttttctttctgtctttgctctgacacaccctttgattttgtaggattttcaatgtagtcaggcccgctgctagaggctattgttttcatgatgcatttagacggccagtggtgctccccttcaaccaagtgatcgtcagcgagaggagccggccgcggtggccggggcgacgactggtgctgcaccactctcccaagctgaggccaacaagaagagcaagcagcgtatcccggctccaattggagagattcaaaatgtaaattacagtgcatcaattatttgttgggatgaagacatctgttttgtctttcgttttcattgattcgcaggtatccttgtcagagcagaacaacacctacaacatgcacatactctggtgtttttctgcatctgctatttttgccaacgagatcatcgactccccaccctccaggtacaaatttgatccttggatataattgactagtgaatgctagaatctagatcattctgaatttatgattgttcttttcactaagatcattaggtccatttttattcttttttttgaacattatccatttttattcttgaaatcgcttttcatctgaaaagatggcaggttttatgtagtttacaacttgtatgttattaatctgagatatctggatattttagcctgaagcatcccaattacctattctacatttttcggccaactgcattcttaatttttcttttttgcacaatgtcatcgattgcatatcgggtctaggcgagcccaggaaccacagttaaggaaacaaaatgtgacctccatgcttgtctgaataaaaaaagaactgttggctaaaagtaggcataaaggaacctaaactggtagctcaattttttatgaagcattttatttcttctttggcgaaccatatctcatttagagtcatttatgagtgtaaattaaagacttctcttatgatgtaatcgcttttgtctatatccaggtggctgtgggattctctctggatattcgtgggtgatggatatatgtcgatgggagacctaaggaatctatagtgctttgtcggctcaacatcgatatgtggcactagcatcgtcttgcttgttggattcgtgcatgtaatagtaatttagttactaagagacatatgttgagaactatcggtgcaatagtaacttggttactaagagaattttttggcaatatcaatatgttatgttgagattggtgtaatataaatttatttactaagagaaatcttgtgacgatgttaatacgctatttttaagtaatttatttactgcgagaaagtatgataaccaattaagtgtagtattattttaagtaatttatttactaagagaatgaatgagaacaacctgacagtaattcatttactgagagaagtaaccaattgagaagggctgaaaacaacctgggagtaatccaattactgagataaggaatgaattggattccgagtaatttatttactaataaaagatattaacagggagtaatttagttactacgtgtgcaagagaaatgtgcgggttacagttggaatggactatttactaataataagatattatctgcgagtaatttatttactgaaagacaaaaatggtgagagagagaaaaaggtgcgggagacggtgggagagccccctggtgagggtggggggtgggggtgggtgctgtgaagggagtagtttagttattgcgcaccccatacgcggtttagcgcatccctatgtatatctgtatatacatatatatatatatatatatatatatatatatatatatatatatatatatatatatatatatatatatatatatatatatatttgcttgtcacattttcttacctcttcaaaatctgcttgcgtttccggcatcttattgctagctacatgataaaattaataagatctgatcgtcaggtgtgtttgaaatggtatttgttctctttttatattaatcaaaaattcaaaatctttgccacctatattgtccttggactacatgcacactatgctcgctctgagtgaaatatatatatgtgatcatagcaatgtcgatgatgttcaacacaaatatatatatgtgattatagcaatgtcgttgatgttcaacaaaaaaaaaagcaatgtcgatgaactgtgatctcatcttaattaatcatttagtgacctgtcctttatgtaggacattccaggacatcgtcttcccgaatcaagatgcattgacagagggatttgaattaatgatgagagttaattgattacatgatagaaaggtctgtaactagtactgatcgagctcaggatacccttaatcaaatacatgcttagtagagttattttcttacctctttaaaggtaataataatgcatgcaagggaccacatcgatcgatctcctagtattagtttgtgatatatctcggtggaacgcaaattactagcattgtagagaaaggcaatatatatttgtcccacgataaccctcatacaagctaaggtagtatttggttacaagaatgggatgagatgggacgaacccacttttaaaagtgcttagtttaggggtgagtgggatgggttggtccttggagaggaatattcctctcagatccgggatcaaccgatccggccaaatcttgcggacgaactcgtcccacctgggactagcggatggcgtgacgacgccctgctcgccctcgggagatggtgggctcgagcgaaggcagacggatcgagcgacggcggcggtgggggcctcggcgacggtggatcccgtggtggggagggcggatccggcgatggggacggctgcggcaaccgtgctcctccacccggacgaccgcgatggtggccacggccggggccaaggtcgaggccgacagcgccctcctcggcgcggcagaggtggggcctgacggcgatgcggccatgggaggcgaaggagaaggagagggagccagggaaggagaggaggaggcacttgctggcagtagcggagagggaggtgagggcagaggcggaggcggccatagttgctctgcccgcttgcccgctcgtgccgctcctccaccttcttgtcgtcaggttgtagtcgcgcaccttcgcccggctgaccgtcgtcggtggttgcaaacggtgtccatcccatccctctctcatcccttcaaccaaacaaaaaactgggatcgtcctattctacaaaccaaacacgcgagtggaatcatcctaaccctaaaatcagaggtggtttcatccattccacatagtcccaaaaccaaacacatgctaagtgctcctagctagcaagtggcactctaataaatctctactattataaaaattaaaaatgtttttgtaggtattttggtacatcatccatgtttgagttggtttttaagttcgttcattttttgaaatgcagttctgtgtttgagttcgattttaaactcgtttccttttggaaatacagaaggagtcgtatataaaatctctttaaaaaaactcacatgctaacttaagataaaagtcgtacttctaattgcagctcatgattttctaaaaagaaacatttaagcgaattcccacagtgaattttaccctatctaaatcatataacaataataagattaaagtagcattcacccgttgcaacgcacgggtatattttctagttaaataaatatcttagtcattaattttcaattaactcggtgtacccgtttgtttcgaccatgagattagattcctacctctccttcccaatttacgatggctctcatgcatggtttggtcccaccaaaataattaattaggatttctcacaaagaaaatcaacgaacaaaattttagatgcaaagccacgggaacaaaatgcaacacacctctcagctcgccttttttaccactatcaaacaagatggacctacacatcgtcttttcgatatgtgcccagaaacaagctagaagaaagacacttacatctctttattattagatctctaaacataccgtgccacttctctcgatctttctttaagcgtgcaacttttatactactccatggtagtggtgcttatcttctgatctgttgtaactagcttcaacaaagtgatatatcaaagctccatggcttttggataatatatttgtaggatcgaatagcagtaactaagccaattagagagaggggtgaatggttgcagtaccaaaaaatcgaaacttttagcggaattaaaagttaccctcgaatccgatgtagatcggtctgatcggagttgatccgctagtctgacaacgcctatgtcgtgcggtctgaccggtgttgatctcccagtcgaaccgccctgcaatcgcctctacctcctgtcgccgccgccggttagaccaccgtgttcctgtcggtctgaccgtctgcgaatccgagcaaacacaaattgaagatgtctcaaagtagattaaaactttattacttctctctgtgtttacaaagtgcaacaacaacattcctcataaaaatctcgactaaactcaaaacactaacttttttctcttaactcaactctctaaaaaacgataacacccctccctttctatatatacctgacgtaagtagcctaaagccacaatccaaccttgtacagtaagtcttaatctcctaagaaaccttcccatacaagaaacaaactttacaaactccaattgtaccaaatttggactccctccaaatttgactacgcatcccatacgcacacaatactccatcgtatgtcatatggaatcttcaccaaccgcgtgcattaatctttagcctaagcatcccgcatgatatcatgatcgtgtggacatcatcttctcccaagttggcttccaatccatcatcgggaacattctcccgaggcatcaagaccacttatgcatacatcaaccaagaaaccatatatgagcatagttctcatcaacttaacttattgttagcaaacaacaatattacatacgcatagtattcatctagaagtcataaacatatatgaattatccacggatatccaacgaaacaacccgaaaccaaaaccgacacagagtcggctggtcagaccacgggttgactggcctgactgctcactatactccgtctgattggccttacccagccggtctgaccgcaaccgtcagacttatcaaacctatccatcacctgtaaaatccaatcatctccaaaaccacttcaccaataatctccaaatatcaaaactaataatctcagatgccaattgtttattatagaataagaatgaaataccctttgattttacaatatatactaacattgtaggtttttgggtgctgtcagttgaatttttagcacttagtccgaggtgcctcgaccccgcgtgctttgccgccggaaatttgtttattgatatttttaggaaagtaactaactctgtcagttagttgctaattaatcgttttcaagggggtaatgcatgaaaaaagaaacataatataaacgtaggtactcacatgtacacgtgtacttactcatatgcatgtatacatgtacaccctacctctataagcatctctgagagactgcaccggtatattttgagtttaacaaaattatcaccggcgcatcgctgtcgacggaaacatcatctaccattgaaaggataattacccatgttaagtgtagctatgggtaccatcctcccgctcctttacttctgtccctgtattagttgaaataacatttaaattatacatataatttttattcaatcacattgttatattttgtacaattaaatcaaatcaataacttaagaacaatgttgactatttttttttaccagaaacagtgagagacccccacaatatggactatattttcatttataaaaagtaattgttttgggccgtagtttgaccctttgcatatataatggacaaaaaaaagaaaacatatgttataaaatcatatatcacatcatgcataactaaattagttctacaatgttttaaaaaaaattcaacattaatattatttaccattaaattaataatttaagatctatattaattatatttttaacatgtcaaataaaattgtattttagtttgtatttttattctttgcacgtaatcctaaccgaccttgaaattttgaaaaagataacaatatagagtatatatatcagtatatatccattatcagttcacaaatatgtacaactgaattagatttataatatcaacaagaaacatgtcatatctttgggctttgcgtggcattcaagaattttgaaaaatcatgaaaagaaaataatgatatgagtaatagaatcacataaatatgcttactatgtagggttcagtatgtttgtgccacatcagttcacaaatatgttcacaaatatgcacgactcaattagatttacaatatcagtcatatctttgggctttgcataccgttcgggacttatgaaaaatcatgagaaaaacttaatgacatgaattatatcgtccaataaatatgtttagcatttagggtccagtctattcagatcatatggggataacctaaaatattgattctattaccatcatgtatagattctacattttgcaaactgcaccctaaataataagtaaaagaatggagagagtacatgccatgtttttttccctttgatttttattaaataagcatggtatacgggtatatcatactaagtttagttaattaggtaacataaatcatagtaaacttttatatgaaaaataatacaataaaaatatacttcaaaattggcataacaaaagtgtactttagtccatggtgcctaaatatttataaattatctacacatactaattatatttatatagctctgttgttatttcaaagtaaattcatttttagcagaaaataaggaatcatatgaaaaacagagggggtgtacacgtaaatagaaatctgtctttaattagaaatagtcgtattatccatatttttaacagaaaatatatttaattaatatgttctaaaatccataaatacatctacaatatacaagaaaaaatgttacgtaaagtttataaactccataagtaagacatgctaaatatttaaaaaaagaaacacacatagtaaataattgttcataaactaaagaccatgcagataataatttcatatgaaccaactccattgttgccattcaatattttctcataaattaaagaccgcatggtttaagttatttacgtcggtggaggccctaatgtcgtcaagttcaagcaagacatcaataacaacggtcaaaaagacggcgcctccatctctctgttggcgcaaaaaaagttaaaaaaaaaactagaactgcatgatctaagaacatcaatcaactaattcaacatcgatggcttagatcatgtttttccgcactaagcaaagatgaccatgtatgggctaaataattgagattatgtaaattaaaactccaacaggaatgtctcatgtatctctttattgtaacagtatggttatgaccacttttttcttattcaatgtaatgtacctgtttggtgagaaaagaagatacttcctctgttttacaatgtaagtcattctagcactttccacattcatattgatgttaatgaatctaaataaatatatatgtctagattcattaacatcaatataaatgttggaattgctagaatgacttacattgtgaaacggagggaatatataggatcacaaacaagctcagaacgaacacattaatttgattatcaaaaccagagatcgagtcacgtggaaccgtcaaatgtagagagccaacgaactgtgtagcatcgcggttgcggcttagcaacaaccatgcataaagtccttggaattgttggaaatgttggtaataaattggtcgacttgatactgtttattctagtaaacgttgaatatattgtcaaattttaaatttattgcatcttaattacaaattccaatataaatccctagcatgatgtgtcttgtttgaactcatattcactattataaattgacatacaatactaaaatcgttttcacaagcggtataaagtgatttttgcatgcagccatcccaaatgcatgcgccaaaaggactgtgaaaaatcagatttttgcatgcggccagtgcaaccacatgcaaaaatctcattaattttcgcatacggtcacctatacaaccgaatgaaaaaaaaatttggctcaaataaaaatctaaaaagcccaagcgaactctagcatgtcatcgtcatcggctggatccgcgtgaggtggtgcccaagccggacgtccttcacaccggatccgcctcccgccatcatcgtcggcgccggatccacgccgggcgtcgccgcccactcccgcgcggtcagtgaggagaggaagagaggagaggagaaaagagagacagagaggaagagacataaggagagggacagaggagaggaggtgaaaaaaaatttaaagtggtgagagggaaatgagagagggggagaaaatatatgtgaagaacatgcatggggtattttcgacacttaagaggcctacatgtgaaaatctattttatgcgc

SEQ ID NO: 64525 - DNA, 2565 bp, Oryza sativa
atataatacttaatgtcataattattttaaaataatttagccaacatataataattaatgttatgataattttttaaataatttcacgtgataaaaaggatcaacttggtgtcaaatattgctcgataaatatataacactaattcatatctacatgcagggagagtgaaacaacattgtggtttttcagtttagatctgatttaattttaatatatgtgaggcttttctcatttttttataatttttcagaactatttggttggaatgtccagggaatgatcttgctataatacaatcccttaacccatcacgtgaattatggtcatatatgttttttctttgccaaatagttttggtaacaaatcaacaatcctatgcattaaactatttatcatatattttcttatagtttagaaattctaatacgtcggacataattgatgatgtatgccatatacccccactgaagtgattataaatgcactccaatgaattagttactttaaataattttggaaaaaaataaatatattcttaggagtagtaaagatgtatcatgcaattatgaacaatacatgaaaaaaacaaagtaggcgctaaactatagatctttatcaaattataaacaatgatatagtcctctgaagattgtcatggtcggatatccatttagccatttttgaatgatcaaactcgctcatttcaaaaaatagatagttgtatatataccataaaaaaataagcagtactgattaacacacaaaacttaaaaaaaactatttgttattggaaaaatactttcatcatgtacattctctctctgtttttccttgaagggcaccaagcatgctatgttgccatgagtatagcaagggtcacatatggctgagttgaggctacccgagcagagggccaccatttacaataatgcttaactttctatttactgatgcgatcatcgatatatgaaggtgtttatagtgaactagggattaacatcatactccatgttgaccttgaggggcacgactacgttgactcgagacctatgtttaaaggcagtggagaaataaagtctcggcgactatagtcggctttattacccgttaaagggggcattcatatttgattttaacagtgttatcttatcaaccattaggtacaataattatagaatatttattcatagatttagaaacaagagttgacataaacagttatgtttgtagtagatataaatgttttatgtattaataatatattgggcttattttagtggtatagatgcagatccatttattaaaaatgcatcccgttttaaggataattaaaacaagtaaggttgataatagctgagtttacatgtaacatggacaaaataaaccctacctatggactaactattattagtttctcaagacatatttatgaccattagatccatcgttttcttttaaaaaatagaacccatatcccaacctccaccacggccctgtacgtgggcgcttactcattcgtccaccccactgcccacaccctcaaacacaccgtacctctattttcctcctattctcatgctacattacttagaaatcataatttattattaaaaaatagagaacaatatcatccaaagcatatagtgaatttttgattgacttatttttgttatattatttataactaaagttaaagacacatattcacaatattcaaacttttgaaataaatatgtttgattttggtttatattcttgcacttttgcgtacattcaaacaaatataaaaaaaattatgaaaaacatttaaatgttcatcttttaaattatttatgaaatatatatctaacttataactaattgtattcctttttttaaataaaatattaatcacatataaaagttatattgtagtgctaaatacatggtgccgacatatgatacttaatgtcataattatttttaaataatttagccaacctataataattgatggcatgaaaattttttaaataatttcatgataaaaaggatcaacttggtgtcaaatatctggaacagtgaaagagcaatgatcaaagctggattcgatcaagggggagtgttatgaaacaacagggtgatctcatccatataaaaggatggatcgcaaccgaaggcaaccgcgccttccctaggcgctccttggcaacagacgcgatgattcccaaccatcgcgtctctaattgccaccccttccccatctatatattgtaccgcattgatcaataaagattccgctcattcattctctacattcttgtgtgcaattctctctctcactcaatcactctcgctcaatcaattctatacactttcaacacgttatcagcactttcgctctcgcaaaggagatcgcgaagtgaaagaaggaagaaacatcgcttttgatctaacagaaaagcgtacagaagaatcatcagaaaaggtacgatgcctacctttcattggattatggatgccgttctcggcctccctcgcaatcagcgcgctcatcgccttcaccatcttctccgtagatcaga

SEQ ID NO: 64526 - DNA, 4129 bp, Oryza sativa
ccccccccccccccggtgcccttttgctgtcgggcctaatgggccgcgccctagcgcccccgctgccccttgttttgccagcccaatgccgcacggtagtgggccgaatcctttagatttcggcccaccacccaatttaccatttaaatttagtttttaattttattttcagcagcaattacattttagtccctatgttttctataatttagtggaaacagttcatcagctcttcatattattatgtaatggtccaatagactacttatgttatgtgttaattaacataggtgtttattcaaataccctatttcactaaatttatttgttgtcttaataacatgccttttgcatattatttcaagacacgctctactttctcgttttattaatttacaaaattctataaattttgtactttgatttagcaaattctcttaattatgtacaacataattaatggaggatttaatgcatgttccacttcacattttgacttggaaattaatcacatgtcgatggaatcctatactttggtcatatcgaccataacttaggcagcgagtatctcgcccattatcaagtggtctacattttgagatgattacccgatggagtcctacaaattgatcgcactggtcataacctaggcagcgagcatttcacccatctcacagaggtctacatctcacgatgattacccacatgtgttattttccgagaatatgtttcgaaaaatgagattatttgaaatttggttgaacacaaggtagtggagtcctaaacaatggctgcggtatattcaccagaatatatttgcctggagaccatgttttaggcagcaagtataacttgcccactattaagagatctactctactgtttaattacttggagattatccacattgtgccacctaatttcgaattctaactcaaaattgtcaggtctattacctgcatttttcgaaagattacaaaatatgaagttttacattacgcattgagattacaaccttaatatcatgtttttattaatttacctctgtaaattgataatgttaaccatgattgtagggacatggcaacaaaagagttcgacgaactcgccctcgattggactaactatcctatctgggcttctgatattaaaatcaattttgcctctcgggggattttaaatacaattgaggaacccaatgatggggacccggaaattgagcccaggaagctcaatacagccctttttcttttgagactctacattcacaaggatctcaaacatgaatacatgttagagacgagccctctcaacctttggaaagctctaaaagagcgttatgaccagcaaaaggaactcatttggcctgaggctaattatgagtgggttcatttacgcctacaggactttaaaactgtggcagaatacaaccatgttgttcataacatttgttccaggttgaagttttgcaaacaagagccaacggaggcagagaagatagagaaaactctatcaactatgcttccggaggacaggatactgactcaacagtatcgcgctaacattttccagaaacattatctgcttatacatacattgactcaggcagaaagacaccatgagctttctttaaagaatgcccaacagcgcccaccgggctctactccactgcctgaggtgcacttcaatgtacagaataatgctgagaataagaaaggattcaagggaaattcttcgaataatcctaagaatctgactggaaagcgcaaacgcaacaacgacaggcgcaaattcaagggtcgaaagaaaggaaaagggaagggtaaggcaccacaacctcgtagcaatggcaacaagcattgcaacaggtgtggatctgacactcatgtcgctaaagactgccgcatcccgaaacatcttgttctcttgtaccaaaaatccctcaaggacaaaaagtcttctgagaacccaagatttgaagcctacttcaatcttacacatgaagagcgccctaaggttgcaagttctcaccaggctcctgttgaaccagagagcaacctcaatgttctcccataagatgtcgctccactctctgcgatggacgatatgttcatcgaatactgctcaacggacccacttggagatttgcaatgatctcggtgcgtcacacttggagatgaagctgctcttatctcagtgtgattgaaacagtatattgatatcctataagtttgccaaacaatattggttgtaataagtagataagtacgaactcccttatattgtaaggttgtatggcttgctagtcattagagtatgtactattaacatatgtaaacgtcatcctatgtatttgatgttttaattattgtatgtatgtatatatattggataaagaattcttaatcaagcaattcttctttcattatagatgtctaaggatatcgctccgattggagaggaattatgtcttgtggacagtggtaccacaaactctatacttagagagattaaatactttcaaactctcaaaaagagagaaggcaaagttttgactatcgctgggcgcgatactgtgatagttggctcaggacgagcaattattacactcccaatgggtacacaaattaaaattgaaatgctttattgtatcctgattcaacccgtaccctactaagttatagagatatccgtcaaaatgggtttcacattgaaacccatatggataatcgagaagaatttcttctcttaaccaaacaaaacggatatggcaaacgcatttgcgagaaaattccatcactcacatcgggattgtactatacatacattaagcccattgcacatgttgcgtacaaagtaatttttcaaaatgttgatgcattccacacttggcatgatcgacttggccaccccggtatcgggatgatgagaaaaattattggcaactctgttggtcatcatttgatcactgacaaatttcccaaatcctctgatttcgtatgcactgcatgtgctactgggaaactgattttgagaccatcttatctcaaaattagagccgaaccacttaaattctttgaacgcattcaaggagatatttgtggccctattgtgccaagacctgtaccgttcaggtactttatggttttgattgacgcatctactagatggtctcatgtgtggcttctatcgacacgaaaccatgtctttgccaaattaatgtctcaaattataaggctgaaggcaaattaccctgaacataggattcaatcaatccgtatggacaatgctgccgaatttacatcccatgctttcgatgattattgtatggcattgggaattcaggttcagcactctgttccatatgaccacacacaaaatggtttggctgaatcattgatcaaaagaattaagcttattgctcgaccattattgatgaattgcaaattaccttcgtcgtgttggggtcatgcagttctgcacgctgctgaccttgtccaactacgaccaattgcatatcatgaaacttccccaatgcatttagtacgtggaaatcctccaagtatttcccatttgctgtatacataccgatctcaccaccacagcgtaccgctatgggcccacacaggaatgtggggatctatgtgggattcaaatctccgtcgatcataaagtatttagaacccaacaggtgatctatttactgcccggttcgctgactctatctttgacgaggaacatttcccggcattagggggagacttcaagtgccagaaagaatgccaggaaattgattgggatgcccaaggtattcccgccttagacccacgtactactgaaactgaacttcaagttcagaaaattatacatttgtaaagacttgcaaataacctgccagatgcatttaccaattaaaaaggtgtgactaaatctttcattcccgctcagaatgcgccagaaagagtggaggtaccaaataaaaccactcaacttccactcactaaaaagagaggaagaagtatggccactcagcgagaaacaattgctaataagcaaacaaacatggtaaatgcaaaccaacctttagtttgtacacaccaaattgataatatatatcaagcagatcgtg

SEQ ID NO: 64527 - DNA, 6929 bp, Oryza sativa
atgaaggttcctgatggaatcgacatcccgaatcagaaggtaaatcgtaacatgtattgtgttaagttgcagaagtcactttatggcttaaaacaatcgggcaggatgtggtacaaccgattaagtgaattcctttcactaaagggatacactaaaaatgatgattgcccgtgcgtctttatcaaaaagtcctccacaggattttgtattatctcggtatatgtcgatgatctcaacatcattggcaacacacaagatattaatgaagcacgtcatcatttaaagacggaatttgagatgaaggatttgggtcaaaccaaattttgcttaggtctacaacttgagcatttaccttctggaatccttgtgcaccaaagtgcatatacccagaaaattttggagatatttaatatggacaagtcatatccttccaaaacccctatcgtggttcgatctttagacgtggagaaagatccatttagaccaaaggaagatggagaggatgtacttggtcctgattttccatatcttagtgctattggcgcacttatgtaccttgcaaatagtacgaggccagatattgctttctcggtaaatctattagcaagatacagcgctgctcctaccaaacgccattggactggagttaagaatgtcttttgatatcttaatggcacaagagatcttggacttttctttaaaaagaaccaggattcaactttaattgggtatactgatgttggctatctatctgatccccacaatgctagatcacaaataggatttgtatttttacaaggtggaactgctatttcatagaagtcttctaaatagactctggtagccacttccacaaatcattctgaaataattgcattatatgaggcatcacatgaatatgtatggcttcgcagaatggttaaccacatattaacatcttgtggtattggttcattggaatcacctaccattatctatgaagataatgccacttgtgttgttcagatggaaactggttatattaagagcaacatcactaagcatattgctcctaaattattttatcctcatgagcttcagcaacatggagagataaacatcttgcaaactaagtcatgtaataatcttgctgatttattcacaaaatctctaccatactccacattctttaaatgtgtcgaaggaattggtatgagacaactcaaaaatttgcaggattcatggggagtatcttcctctagaaaataacctattttcgtcatattatactctttttcctttgtatgagttttaccctttaggttttctcatccaaagtttttaacgaggtaatatcaacataagttatatgtcttatcatttggcttttccccactggggtttttactaaatgataactgtagacattatactattttggatcatactatgagctttactcatagatctaaaatagtcaataatatatatcacggttctctccttatttttcccactgggttttcgaggggttttacgtgatgtatttaactataattatttctaagattatctttacagatatctggaacagtgaaacagcaatgatcaaagctagattcgataagggggagtgttatgaaacaacagggtgatcttatccatataaaaggatggatcgcaaccgaaggcaaccgcgccttccctaggtgctccttggcaatggacgcgatggttcccaaccatcgcgtctctggttgccaccccttccccatctatatattgtaccgcattgatcaataaagattccgctcattcattctctacattcttgtgtgcaattctctctctcactcactccctctcgctcaatcaattctatacactttcaacagatttaatgttctgcttgaaaacataaaggttggatactctctattacatcccattgattttctttttaagaaaacggattaaaatgaggtctctacgtctactgagcggatgtacacagccaactgtaaatcccattattaaaattattgagagaccgaagtgcattgcttttggtgtagtggtagtgttactggtatccgcagggctaaaatttgaagtcatctaatgacgcacccgcagctgcagttcgatcagttggtattcggcaaggtttatttatttattgttcattgcatctatctgtttgtatatgtgtgcatctttcgttaaaaaagctataggaaaaaaaagagaaaaattgtttacagtagcattcagatgtcatattttaatttcagagcacggaaaaatgttggttcaactgttagcgctgaaagtatattttcttactccttttagcatttcattgaatccaccattatccccctccccatcatttcttcctcttccccctcccgcccggcctccccttcttccatattcaaagtaagggatggtagaaggggaggttgctatcagggagggaagcaaggacggcgctgcaaccaaggcaaccatgaacaagtttatgtgtaaggggaagaaagaatgggtcgagggataatggtggtatttcgtacatgcatgctgtgtgttttttttaaagaaaaatgaaagctaaagaaaactatttgaaatttgggtaatggaatacttaatagccgaaaggagataactctccttgctcagaagtaaatctggatcaatcggtgttatatataaaactaaataccagatgaaaatccagatttaccgaaacaatttttcatagaaggaaacaaaatgccggatgaatatggatgaatggatcaatttttttggctctgtcaaacgtacatatggtgctgaaggttcccactaataacacacgtggatccttcgttacctttggatgtgccggttatcagttcacatccacgagtgtatagttgttgcatattagaaaaggaaaacttttacgttaccttttgccatcgatgatttttactgtcattgagaaagaatctagacagtccatcctttccgatctgaggtctgaaaacgcttagtacctggtggtaaagtccctcatgagcaatgtgtgtggatcaatggagaggcaccacagctgtgagggcaaagaatggaatttcgtttcgcccatacatttggatcataccaatctgcaagcatcgattccatgatgcccctcctacacacatcatctttctcctaccgctggccgctctccaatacaccatcaatctctttcggcgccaccacctccaagatatcggtgccacccttacggctatggcgggattcccgttctcttccactaccacctccaggaggacatccttccattcatataatataagagattatcaagaatatatcgtgcgtaagctattcgctcatcaatttgtaaattataagtaccgatcctaacccttacagatcaatagttagatgtagttggtacctcctcaaggataataaaaatatctttgttatcggtttgcaatagtagagtttaattatgtaatagctattcttagctggttacaaggcttgtagtattcaaggggtttttttggtttttgttttcttgttttctctgtaaataactcttttatttttaatatataactactgggcaaagccctggtagtaatttacataaaaaatgtaatagctaatctatagcacgattatcccttaatctatatagcccatataattggaacgaaaaacttaatatacattaagacaaatagtctagaaaatagtagcttttggattaatctcatgcttagatctcaatcatccatttgtcatatgcctttacaactcactaagtgtagttattattattataaagctcaatgcaaccatgacactaaaagagtaacaaatatgagatctctcttgcttgatacataactaatgtacaattacaatttcacaacaagtactatatagagctcaaaataaaatattgtccatttaggcactacaagtacatgatttataaattattttcttcgagttttctttgaattatttctaaattctctacttcaatatgcgggatattagctagtgtatattgtgtttgagacattttagcctattttttaaaaatgatggtattgaatactctttgtgatagacgacatggttttcgaaatacaactttgaccactaattattttttgttctaaaatatttagaagagctattaaaataagatagtaaaacatactaaggatccttaaacttgttgttagatgtcatccagatcactgaactcggatatgtattaaaatacccaaaactctaatactgctattgaggtccaaaaccgtgtttttgaccatttgaacaccaatgtggcacagcaacatcgactctgctggcatggggctcacagggcagcaaatgtcctcactttggacgatgtattttgtgcatgtgctgatgtgcttctcaactctttctcattctcatccacagttttcttgcccaaggaggatgccctagtgtttaaggaccaacagcaggtctctgtgtgttggcctgccacattggcactaggatggtcaactgagcttttcgacctttgattgtaaatttagcaagttcagggggtctaaatatgcttttttagagttttgagatgatctgaagataagtttcagaaccattggagtatttaactcttatgataaatcagttgtgcttattttataccgatagttccatatttatccgatttctttgtaagaataatacttcgtagtcaaatcaattgtgcttacggttgataaccatcagagttgttgtgtgaggattgtctgatgcttggtgacagagtataatagatcgtggacgtcattggtcatccttgaacaaatatatacttacatctcgtgaaagataactagcgatatcgaagagcacatcatagctagataggaagggcgcatgtttgttgaactgtggtggtatgagtgtgaagctgttcattaactatgtaaatcaacctcactctctaaaacaaaaataaaaatcttagagcaccataccacttatgaaaacctcaaattgaaattaaaatgaaaatatgtcgatcacaaacctaacagctgcaatattgtgggtttgtacaagcttgtgaccaaaaacacgctatctgagtgtaaacaatttccaatgcctcaaaaaggtagcagatctattggaccagagaaagagaccagtaccaaccactctgccattttatccatttttagtacccattccaggatcctaatgttgttcaaagataataaaaacacgtggtcaacaactgatttgggtaaattttagctccaacctttcttcaaagaaaaaaaaaacacaatagctccaaggtttctagagagcagagactgtatacgaaatactaacactgtattcaccataataatgtaataccaacaatttatctaaaagtttcacatacatttattcgattatgtaagtaatttctagcctaaacactaacttgggatacacacaactatgtgtattttatagtaatgttgtgcaagagaagcaaaatttaatatgcatgcatggatcagaattgatttcaagtcctttctttacagtgatttcaaggtaggacatgagcccaatatggtcaatgattctgttcttataatacacatgggacatgggttaatttaagccaatattctagaaaaaagagttgatacatcccaagttacatggcagtgtgtgatcgatcaaaatgtgatattcttaatgtattgcattgctatgtccacatcaaaatgtgagtaatctccgcgagaaatgggcctactcttttgactgtttttttttttaagagatcaaaggaagagtcctcgcaaaaaaaaaagtgatcaaattaagaaagagaagtaaaaaaaaactactatagtaggacacacagtagcttgtgtgtttgcttacacactgatatatatttaaaaagaatatgttgtactaaaatcctaaataaacattgctggcaaaaggggaaaacggaacagttgactgcaccatccatacatacatagtttggtcgatagattctgaagaaaaattgtctttcctaaataaattgagaatattcttcagatggactcatgaacagtgcatatgaaattaataacagtacttgctagaaaccccataaaatggatatacatttacgcggtcccggtttcagaattacactatataaaaaaaatcattatcagtcatcattcagttggacaactgctctctaagtagttgtgcatcaaagcaaattcgaccgattaaacacaaaacattgatgcataatatttgtctcggaaatgcacgacccgagtctgtttcaatgggccatgctgttgaacataggccaattcaagtccacatcactgttctggcacattgtgcattatatcatgttcatatgctgctcttgtttggtcttaattcctcaattgtacacgcacacaatggccttgtccaagcactcaagtaactagaggccacgcacatgattgttagtagtacatacaagtggctacttgtaggatcattgattattaattagctagtgtacatgctgagaaatgtggagcaatatatttatatatatttcagaatatatatatatatatatatatatatatatatatatatatatatatatatatacatatatacatacatatacatatacacatatatatatatacatacatacatacatatacatatacacatatatatatatatatacatacacacatatatatatatatatatatgtatatacatacatatacacatacatacatatacatacatatacacatacatatacacatacatacatatacatatatatatatatacacacatatatatatatatatatatacata

SEQ ID NO: 64528 - DNA, 10373 bp, Oryza sativa
  unsure (1)..(10373): unsure at all n locations
tatatatacacacaagacttgcatgtaaatccagtggagtagttgttaatttaggcacttttagtgactttaatttgcaaaggcaaattaagttggtctatctgttctgttttctccatgtttttttttttgattttgtgagttagtaaggggttaattgttggagcccaattaatacaacctaattttaattagggtgggggacaatgcatccaaaatccccccttgcatgtgagggagggggtcatgctgggtcatggcatatttagtggtcatgtgcatgttgggtgtgtatgggttgtatagtgcatgcagttgcctgtggttgcttaacttgcttgcttcatagcttctcttgaccgaccttgcttgcatcttagctgtccatttattttcttttcttttcttttattttattgagggagaggatatcagaagagtgctcagtccagagcttgcatttcactattgcagcgcagcagcacttgcatttgcttgaatgatccatccatctccgaagccaaatcgatcggttcattcatgcaagccggtgctttgcagctttaaggaaagtaaggtcatttgccagcccatcatatatgcctcctctacactgtcactactacactttactactctacagactacagttgtcacttgtcagtggacacactggctgcatattgccttaggttaggtttaccctccacatgcgcacacaccctacctttgagattctttccttgctccttaattctaccggctgctgctttcaagggtccagcgagtgatattccattccttcttttttacctatcgtaggacatcgacatgtttttaattattcttttttaaattcaatttatgaaaaatatagctacattaaagtacttttcatataaaattcactgatactattttcacaaaacaaatcttattagtttttcatatattagtgatttaggattttaagttttggctactcactcgtacagaaagagcaatcccttcctattcatcactaccggtttaacgtgagccaacccttactgcaggttcatggcattggagggaattttcctgccaataagccatgaaccggcaatgatgctaaacatccctactggtccagtgaccgacgggcaatgagctagcagggatttcaatggtctggactgttttttaagacattgggtggtccggacttgaacttttatttgaataactcgtacaagatgcaagacggtgcgaagttctattgatacagtagaagaaaaattacaagattacaaccccgtaagatcgtaaccaggaaaaagaaaaaaatataccaccactcacacatcaacagcttcaacacacagaacaaggagaggcctagcaccggaccagccacccgctaagcgtgaccgaccgctgctaggccaacaaagaaaacggctgagatcgcccaaaacccaacccttactatcaacacaaagccctgctctatccaaatcttcaggagttaaggagagagggcgaaagagaagaatggaacacctctccccctaggccctctgacgtggccaacttgtagagactagaacgccgccacaagagaatgaaatctagagtgagcttgcaccgattggttggggggttttggctagggcatgcctaaacgacgtctccaaggagagaagcaatggaaaacaccgccgctgccgtccgtgaaggtctcaaagagaaccgaggctgggctttcacctggcatccacacatgaaggatgagacggcacgacaatgccctcaggaggggaatgacgcttcgagcatcatcgctgccggcccggccgaggccgggctaggttctcacccgccgctcaccacctacgagtccacggcgggtgccccgatgctccaccaccgtccaacctctgccgacatgtgcgaccactgcaccagtgccctccaccggctggccttcgtgcgctgtagatcgcactgcaccccaccgccgatacttctcccaccgtgccccccctcatcactgcccgccccgcctcctcgcaccgtgccaggctcctcccgcgccgccatgcctnacccgccccggctagcctcatccaatgcccgccgcgcctcatcgcgccaagccggcctcccaccaccggccacgcctcctcgcgccatgccgatctccgccaccaccggtcgtgcctctacgcgccgagctagcctctgagcactcctcccgccactgacgcgccggccaaatgcggtcatctgccacacctccctggctagccgcccgtggtcgtccatgcctcctctgccgaaatgcccgccgcacgcgtcctgtccaccggcaaccgccgctgtagagtagacatcatcaccgtcgcggaggagtcaccatgacgccactgccaccacgaccagaaccaccgccgccccactcaatcccgccacaagccatcaccccaccgccaccgtgccggcctccacctgccgtgtaccgccgccaccatgccggcctctgccggctgcgaaccgccgccaccgtgccggccttacctcctcacgcgcgccgcgccgcgccgccctgccactgtcgcgccagctgttgccgccgccatcgcatgggctccgcgtgcgcctccatcgatcgcggattcgggcctcgcccgccgccgcaccaccatgcgccgccctcactgtcgccaccagcaagcgtcgtagccagcagctcctccttccccatcgccggtcacctccttcctggcccactgcgtcctcctcccgtgtgccagctatgcgggggagcacaggggaggccagatcaggtgtgaagcatcggatccggcgctgggggagccagatccggtttcgctctgtgccggcgagcccaccgccgcgacctctgccccgccgccaactccgcctccttcgcccctccactgccactacatcctctgccccgccgccgcctcctccaccctgcctccttcaccttgccagccggccgagcaggccggcgccaccttcttcgcgccccatgccgcgtcggtgccccaaccttagcgccgctcttggggaagaagaagagcgcccggccgccgctgtccttgctgtcgtatggctttgccgacggccgctcgggcggcggcgaggcggaggggaagagcgagggtagcggcggtggtggggttgtgtcgctgtccggtcgcccttggggtgggagcgacgctccggacttgaacttgaaccggcagtgacgtactataggtactgcaaaatgcgtacatcctaaactggcatctgtttgtaaaatagatggagtatcttgcatgcacaattagttatgtctcaatctccttatgaaatcatcggagttaatttgtggaggttaggcacagaaggtgccaatcggattcgatgattaaaaaaacatactctatatacctggcctagctgatctttttgtacaagtgtaaatcccacaatgcatcaaaggatgtgccacgtcttcaaaatagtattaaccattggatgctaacagtgaaatgacatacaccgttggatgaacatagattacaaaacacaggtgttagcaaatcttcacgagacttctagattccaaatccaaataagagaaatcggtgaggagagaccgggtccaaatgtcaatgcaattttttaatttgatccttctataaaattcattttacatataagccctcaatttgatatatctttgatttctcgaaatggttgcattgtactgccttcccaatatgtaagatgtttaggattcaacatgggtattaaaaaataggtaaaattaaatgacagaagattacgattgattgaaatgagcaagtcactagagaattaacaggttgaatgttgtgattggttatttagttaacattttatgattttcttttacaatttttgacaatgtatattaggttggttagagtcacgcgaatgcgtgacttcatagcctagttaatatggtgaatgtcaattaattaatcgttgtgtagattaatttacataggagcaaataaatatgtgtgcacggtacagaggactggaatgaaatctacctctggataggttgaccttatctatatggaaatgctaattatccatcacaaatttactctctctctcatgatcctttttggaactttatgtgcatatgatgctccaaaatcaaaacatttagcattattgtacttcttttagaaacctggtgctcataagatggtcaaatcaaaacattagcattattgtacaagttgaaggttagtacattagaagttttcaagattaaatacatccgaaccctcgcaatactagtgcgtttgtctgaattaatgatcttaaccgagatcgcttgatgtctatgagcctcataggtggccatattccctaataagccggaataaaaattaatttacaagtaaaacttttacacatttattcgtatcgacttaaaagtcaacacttaaaaaatcgcgttgaaaatatcttaaaatcaacttcaagttcaaaaatttaaattttggtgttttcttttggcttattaggccaaccgatagggctctattatttttgtttccttgaagttattgagtgcatgcaattaaacgttttaaaacatttatcacttatacacacaaatatattttgatttatcatatggtactgatattagtaggctggtatataaagtacttcaatatatattattctatatattttttattttttctagcgattatatgagagatgtactctcgaaaattaagaaatgtaatgagcaagcagtacatgtattgaacacaacattgacgtccagtggcgcaagtaggagaattttgataatttgacactttctttgccactttgctttaattgacacttttgaaatgatacgtgggatcatccgactgaatgaaagtggatcattccttctaagatcatggaccatcattgagctaacccgaatttgaatgtgtattaaaatcctatccaggaccagccagagtatacaaacgacaaattcatacacagatccacgtcttataaaaataataaataattcttacaaatgcagcggaaataagcaaaacttctaatagacacaaccaaaatgtagcttcctccataatccacaggcatcctaaacatccggaacaagctcaatcctcaaaaaaactcaccatctgaaccaatctctgcctctggggtggggaaaaatatcgtacccaacaagtcataccaaagggaaggtatgatgtaagatattcacaaaggaatggctcattggatatttgcagtaaaagcagcatttataaatcataatttgaataagtaaaatagtatatgtaattaaccaatattaaatcatcactgcccaatgctaaaaccccgttgcaacaggcccaaccaaaccacatgaactacacaaattcaaaaagtcatattattatagtggaactaatcacagtgagctggttgaccgcccaataactgcaggcacagctattccaataactgcgggcacatctattcgaatagttttaactctgatcagaggtgtacaaatttacccacaagacacaattccacacatattaccatgccccaaagtaccaccacgatactgcaaagggggaaatcgtgacaaaacccgttatataaccctccctaaccgaacatacccacctcaggtttcaccccctccttgtgccaagttgggcagttccctctcgtgcctaggtaaatccagaaacaacatagactaatatccaggtccgaactgcaccatcgcctctacccttgccatggtatgtcagctaagttaagttatactctagatttagcctgaagcccatgctggcctatggtaagtacgagtatatcttcctgggattctcgagaaccggtccttaattatcatggacacgactttcgaaaccatacacccacaacccaccattatagcatattttagtttaattaaaccataactatggtagtccatcataatataattaaggactaaattataatgaatcccattgcgagctaattgatataagcatggctaataagcattcctaaaccaatcatctagtcaattgtagcccaagttatcaatggcataagatattcagcaggctaagtacaataggcatccatcccacatgacattctaaaataatgatcaatcttgtatgtatgaactgcgttgctcttgatctgacgaaacctcggcaaccattttgaaataaactggatcactagaactgacggaatctaaatgacaaacaaagcatacatgaaatacaagcaataaggctactgaaacagcaaaagaaaccatttttaatggatttcatacattttaccggattcacttcaacttgaatgggttaaaacggagctcagattatttagttatgaattttacaatatgagctacgttattactaataaccgaaaaaccttattcatttattacatattaatgcccataaataaatagatcaatggaaatatacctccggtaagcaagcctcgcgaattagcgactcaacgagccaatacttcgtgacacgggaccatccaaacggtcaaccgaaccggtgaacagaaccggcggctcagaacgactatggctaaactggtaaactagacacggtttacggcaaagactcgatatggcaaacaataggccagtaggagtttagggatgcacctacggctttgtgactcagctaccgagcattcagtagagacagtgacttggtttgacgagacgcagcagtggcacgacgagacgcggcagcggctcagctcggctagggcagcacacggcagcggctcggcatgcagctgggccggcgtacggcagcggctagggcagcggcggcgcatggtggcggcggctgtggcacagcgaggcggtggctgcggcgcgtggcagagcagtgcggcggcagcggcgcggtgcagggcagcggcacggcaaggcacggccggcagcggcggacgcgacggcaatgctagggttttgcgggataaacaattagggttacgacgataacgctaggaaaaataaaacctaaactaggagatcacaggaaaattcctcaccaaaccgagacgatcggcgaggaggagacgacgacggtggtctggcagcaacacatgaaaacaacggtgacgctagatgagaaacaaatggaatagattaaatagataaattgatggttgcagcggtaaacacaccaatagagagggagatcggaataccggcgacacaacggcgatgacggcaatggcgggaggcggccggcggcggctagggcacgggaggtggtggcggcttgggtttgggcacaaataaatttgtgaagaaaattagggggatataatagcttatatagagtagaattaagagggaggtggggccggctaggggcgcgacaacaggagaggaggggaggctgactcgggttaaggggggcggccaagagggagagggggaatggagttggattaggattaggactttcccaactcggaaaagaaatgtggtgctattttaggaaaagaacggaaacggaaccggaaactgactcggactcggctcgttatacaaaacggaaccgcggacggaaagagaatactggactgggcatggttcacaaccaaaggcgggagaggaaaattattgttaattcaactcctcacaaaataaattaacatttattccgatgctctgaatattcaaagagaattcaaaaaaattctccctgatatttccgattattaaatacattgttaattagggttttctcctggttaaccaaagtaatttctatagataatttattggtaaattagaaactatagaaaaggggaaactccgagtgtgacattaaattatcaaatctcttgatagttaaaaagaacggaatagtaatttgtatttctaatatatagataggaagcattagttaaactaatgcaatattaaatgtttcggctaccataaaacttacattatgaatttgctctgctcctctgaatggaccaaactgagaactttttcaaacaggtcagaagctagtagtacacattattttatcaaagacagagtcccttactctatgccactaagtttgttatagttcaattctctatgccactaagtttgttctaattcaacgatttgctactgatattatccttttctagaatatactagtaactttatcaatatatattctaagatataccattaggctagtccttttaaaaaaaaaccccaaagtactattagagatatgaggttcaaaaaattataaaaaaaaactacgagacctccttacataacgtgataattttttatataagtttcaagatttttctggtatatttaatttttttagaaaaaatatttttatgtggtatatgggagataatttacttacacaaaatataatagcataaaaaaatcttatgtagcgtatgaaaaacatttaaaaaacaacacaaaaaagtattttatataacatatagctgataaattatattttaaaaaatataaatgcaaaaaacttaaaacttatatacaaatgtccatgttgtttaaggagaccacatgaaaattttcatattttttgaaaaactctaatgagataaattgaccttgtatgtccataaggttatttttggcactgttcaaaagaaggcccggcccaatgacttgttatagaataattgataaagtcgtcggtatattatagaaagagaaaatatcggtggtaaattattaaactcggacaaattcagttatatataatgtattctctcattacaattagacaaaattatattattttctttctggatcaggctatgattacattgaacaacaatatataaagattagaacaaaatccacaaattacaactatgtggccaaaactataactgccacaagtttaggtgggtatttcacaaaacatttgtaatagcaaacaattttatcaagaaactacaacttcatcccctacgtcactgctacaagtttaggtgagtatttcacaaaacatccataatagcaaacaattttatcaagaaactgcaacttttatcccctacatgtctctgacatatgggcccaacttgtaacatcatcactattgcgtatgtgtatgactagtgggccaagacctgtcattgaagcgaagttgttgttttatgataaaagcatacactatcattgcacttctatgaaatgtagctaaaattgaagcatactggtagttatgaaagaaatgttcttttttaaaaaaataatctaaagataaatttagaatgacatatcttggcatcaaattaagttaattagctactcgataaatctggggatgcaatacaacaatattaaaatttctaatttttaccgaaatacatcgtaaagcaagcattaagattaatgaagtttaggatcacatgtaactaatgcacagttggacatatgttagtatgtattagaatttagaactgagtaaataaaatgattcatggtagtacaaagaatggcttaggagtactacaatcatagcgtaattaaggtttaggccctctttggagcatatgataggaaaaacacacgaacatgaaaagcacataatcaaagtggcgtgttttttttcaatcatatagaaatcaaaatcacctgaaattgaaccaaaagaaagttttaaggagatccaacctcttgcatattttcatttttaattttaaccttttttttattttaaagataaactctccctaaacttatttttaaatctgaaccttttggccacgctagtcaaactgatgtggaaaaacaatgctgctatgacagcctggctgacagtagcattgttatttggccacgccgctctggcttgcgtggcaatgttattttaccactctagctggatggcatggtaaaacaaagctgccacgcccattgtagatggtgtggtagtgttgtttcgcaagcggggtgacatgacaaaaaaggttcaaattttagaaataagtttcagaagattttatttttaaaatttaaaatttaaaaggtttttaaaataggaaaaattcccatattttcctatggaattggacagtacgtaggagggcaatcttatgattttttttaatctttttctatgaaccaaagaggtctttatggaaaaaaatcctccaaaaatcttttgcttatcctccaccctgaagggggcttagaattaaaaaaaataacattttgtaatacacaaccaaggaactgtatgtagccatgcaaa

SEQ ID NO: 64529 - DNA, 12421 bp, Oryza sativa
  unsure (1)..(12421): unsure at all n locations
atttctcttctttacttcagttatgtgtggggcgaggtgagcgaatgcgtgaaaaaaaaaattttcatgccataggacgattctccatttgactcagcttttctgctaaaggaattgtcaacatgcaaaagattaatttagtattaagtattaaaaatatgaaaaatgattttatttgttttttagatggatttctatatagctttttttttaaaaaaacaccgtttaaggtaaacgaggaagttggaaaagccaactgcaggctagaacgcaccctcagtcaataaaaagaaagaactcattaatttggtctgtggatccatgtttaattctgtgacatttgacaaggtaggcaaacacatgatgactcgcaattttggaactaccgaaagtatacttgagtatcagtactagtactgtatttcagtcagttgtcgacaacagatttttggtaagagatgttcaacggatttcttttttcctattggaaacacatgtgagcaatgatcttgacacgctgttgagagtattaattgtcaggtagtgctaattgtttttactccatgttgttgttgttgttgctacacagtgtgattattcttatactagtataaaattgacacaatgtggcactagtaatagtagtagcttgtcttctcctattaattttcccctagttttatcttgtgtttgtccatctttctttcagtagcagtcagttcagtttcctggctggccctgaacccaagaaaatgaacagtaagctaaatagaaaaaaataatcaatccactcccagtgaatgaatcatcagatgctgctgagcctaactctaactgtagttgttctagcgattctagcactagtacactagtgcaatttacccttcactttcaccttatcaaggaaaatacttaaaaagcgatgttaaagggaaaaagaggaaaaatctctgttaactacattgaacagccttgaaattttttgtaaagctgcaataaaggctttggatgaaaggagagatattttagcagcgattttatcatgctgcatttagtagcagcagattatttgttatttgaaaactcaaaattccaaccaagagattgatttgtacttatccataatctggtattaaaccccacctttaatcaggtgattagaattgccttgatgagcatggatattgtcactgcatttaccttcagacttttttccccttgaaaactcaaaatcccaaccaagagttcaatatgtacctatccataatttggtagtagtaaacccacttttaatcaggtgattaggatttaccaggtgcacacatactgtcgcagggactagttagttaatgggaggtgaaagaaagaacatgagtgagagagagagagagagagagagagaggggggggggggggaatgctgctactctagtagtaggagtagctaacaaccaagaagatgccatgtccttgttgcaggggcagtggtggtaaggtaagaaatgcagcagtataagcagtaagcactccactcactcaccaaaagcagaaaaagaaagaaagaaagaaagaaagaaaagggacaaggagattaactaagacacaccccacctacacactcttcttcctcctcttccttcttcttcttcctcttcttctcctccatttccatttctccacccaccaccaaacatctccggatccttcgctccatcctcctcctaagaagagcccaagaagccagcaagatccaaagatcaagagcagcatttgtagctgcaactgctggtgctggtgctgttgctgttagatcgaggaggattcaacaagtgtgttggtggtggtggaagttgttacagaattgcgggtgagagaagtttcttcaccgcacctcaccaaaatctccatccatccgtctgaatcccaactccacctgcaactgcaactgcacggcgagattgcagtacaacccaagaaaccatgatgaagtggcagcatcagtagcagtagcagcagcaggaggaggaggaggaagagggctcctctttaatccttgcttcactcatcttcatcagaatcctccttattggctccgcctcgcattctgtgctgcatcggctgttgtatggtcggtggcgaagatgacgatggagcacggcgaggattgctgcgtcaaggtggccgtccatgtccgcccgctcatcggcgacgagaagcttcagggctgtaaggactgcgtctccgtcgtctccggcaagccgcaggtattccttctcttctctttttatcactcactcatttggcttcttttttcttgtttatacgtcccaattcagagagactagattgactctcatcctgtcaattgtttctggatttctcttttattttattttttttgggggggacgtgatttcctgggaaaatccaaacaatatgataagttctctgcattgttcttttaagattacctgaaatttttaattaaattcagagattggagacatattttgtccaagtcaagaaagaaaaatctctgactctgtttttctctgttgagtacaagaacagaggagctcagaagaggacttgttgtttcccccaattttggtcctctaattcagaaaaaaaaacttgtcaaaattcatggagaatctagcttgcttccttgttttagctccctatgaaatgatagagatgcccatctgttcgctttccctttctcttagttttgttttcttttccttttgatcatcattaaatgaggctctagagtcttccttctccttttttcttcttcagaataaaattgtatatatttttttcactgtcggcagcgccaaatgttcctcattttttggtgtgaagttgcgtccaatgttgatgacgctaatgctataccctttcttttatctggggctggaattctgtcagcatcacgcaattatcacccaggttttctttctccagttttgtccatccaacactcatccttgttggattcttcccttcccttccttttctttcttccatcaagatttattaagtcattttctcagacaaaacgcagcaagattaattaggttccttaattaatctaatcctccattacacaaactcgaatgatgagatctggcttaggtatcatattcttttggtaagatggtttgctctccataagactgttgtttgttgatctttcttgggttccccaccaatttcatttctttgggagatgatgaaaagttactttctttcattctcccaaatcaatctttttaccggtggtggcggtggtgatgatgggggtgaaaaaaaagggcatatctttctttgttttgttgttgctgatgggttttgttgttgcaggttcagatcgggagccattccttcaccttcgaccatgtgtacggcagctccggcacgccgtcggcggccatgttcgaggagtgcgtggcgccgctcgtcgacggcctcttccagggctacaacgccaccgtgctcgcatacggccaggtccgccattgccattgccatccaatcatatgcttccatctccatccccatgtgccaccatggaccaccatgttggggaagatgcaaaagccagcaccacatcatgtgctcctgctcctgctcctcctgctgctgcctgctaatccccttttcttttcttttccttttcttttcacacttgcttattagttgcttttcttctccagctgtttctgcctcatgatgctagatcattttcttgttttttcacatcctctgtgaacaaaaaaaggaaaagaagagaagagattggaaaaatgctgattgatttggtggttgtttcatctcttcctttttacagactgggtcagggaagacctacaccatggggacggcctgcaaggagggctcacacattgggattatcccgcgtgccatggccacgctgttcgacaagatcgacaagctcaagaaccaagtagagttccagctgcgcgtttcgtttattgaggtaaattacctgttcctggatgaatcaaacatttgtgggattgtagagaatccaattgtgctcgttctcttgatagattctgaaagaagaggtgagggatttgcttgatcctgctactgctgctgttggcaaacttgagaatggaaatggacatgcaaccaagttgtcggttccaggtaaaccccctgttcagatccgggaggcgtcgaacggggtcataacgttagcaggatcgaccgaagtgcatgtcactacccagaaagaaatgacggcatgccttgagcaaggatctctgagtcgtgcaactggaagtaccaacatgaacaaccaatcaaggttagcaaacattatcctaatcattcgtcctttaccttttttagaggaggaagcaggtccattgatcaaccataattgatgacaagaaactagcatcattatggtcagaaactggcaatctttgcaggatacagctgtttgtgatgatttcttgcttctatgtttagtgtaggacctttttgcaggattagtcaatgtattgtcctaccctcaaaagagaaaccaattatttgtctagtttcaagtaattaattctctgctcaagtgctttaggacacattcaatcagattggttacctgatattccgttactaaattctacaaactttaatgaactttatgcttttggtttcggcatgtaatagtcgttcccatgccatcttcacaatcacattggagcagatgcgcaaagcagatcccatcatgactttagatggaatgcctattgaagagatgaatgaagactatctctgtgccaaactccacttagtagatcttgctggatcagaacgtgctaaaagaactggttctgatggccttcggtttaaggaaggtacttggcatgttgcttgttctatctgaatccctaatcaaacatccatcttgtcttgaaacaagatactccgtataatttatttatgtatcatgtcatcaggtgttcatatcaacagaggacttcttgctcttggcaatgtcatcagtgctctcggtgatgagaaaaagaggaaagaaggcgctcatgttccttaccgggacagcaaactcactcgccttctgcaggtattattcttctgacccaagtgcacaggcctttgtacagaagcattgaattcatagctctgttcaagaagtagggccagctcacatttaagcatatataatacttgaatctttgcatttagtttctttcattttactaactaatctgttttatatctattttattattataggactctctaggtggaaacagcaagactgtaatgataggtaattcatttggttggagattgtttaatcatatttttatatgatttaggattttttctaaataatgcttgtcaaagttccagaattggggtttaaaataaaaaaaaataaaacgatgatctattcattttatcttcggtaaaaaaaaatgcatcttgtcatatgatttaatttgttttcataaataagaaaactcggatgtaccttgattttcactaactgttttggttgatattactattacatgcaactgacatggatctatatttttctcctgcagcctgtattagtccagcagatatcaatgctgaagaaacactgaacactttgaaatatgctaaccgcgctcgtaacatccagaataagccaattgtaagttcattaaaatggtctcgtcagaaaagtatctgacatttatctgcgttatgtttctttaattaattggtttggttccgtcaaggtgattatttgacatccctatatttactttcctattttcaggtaaatagaaatcctgttgctgatgagatgaaaaggatgcgccagcaaattgaatacttgcaagcagaactcgtttcagctcgaggaggagttgtcttagatgatgttcaggtaaattcttttctcgtctatcctcagtgtccttgaccatcttgttctataaggcacactcactcacaataacagtatgagtataataacaagtggttccattttcagggtctcagggaaaggatctcaatgcttgaacagaaaaatgaagacctttgcagggaactgtatgaccttcgcaaccatggttacactgatccttgtgaacctgaactgcaagtatgttgatgagttcttctgcaagctttcggagattttacatttgaaaacaagcatacaatttactcttctacggcttctttcatgatagattcccttttctctcaaaggaaataaaagaggggacataacatgacattgtctactatggattgttttcatgcaattgcgcttgaaatggtatatgataaaccatgcatataactatttttatctctttcagaaaattggaactggttacactaaaggtgaagggctcaaaagaagcttgcaaagtacagaaccatttgatgtccccatgactgactcagtaagaggtaatctattagcaccttcattatttcatctcgttggcattcagaaattttattcagtcccatcttaagccatgactaagcagtgaacatggtggactactattttcattttatttttccttgataatttccttattctgcgataattctggacctccagcaggcagccctaaagatattgatgatgaagtggccaaagaatgggaacacacaatgctgcaggatagcatgggcaaagagttgaatgaattaaacagacaactggagcaaaaggaggtaatacagaaaacgtttaaataaatcaatgtgttttaatcttctaggggtgattaaacaaatacacgagctaatgttcgttcctggatgatatatgattgtacatatctcaatcaagcttcttgtgcaacttcatttttctggatactcaattcatctccatatgttgtatcatggtgacagttaaacgtgttgtcaaagaagttacaaggatcattggttgtaccatttttaatttcaatatgatggaagtgtggatatgaacattatttttaatggttcactgaatgtacatgcagtgacatgctactcttgttaatctgctcatgcttgccaagacctaccttaaattttctcaatttctttgcagtctgagatgaaaatgtatggatctgacactgttgcacttaaacaacactttggaaagaaacttttggagcttgaagaagagaaaagagctgtacaggtttgttttaaaaaaaaatcttcccattagcatattcactcatccaacagttgtgttttcctaacctttgctaacgagaaagttctgaacaatttcagcaagaaagggacagattgttagctgaagttgaaagtctaaatgctgatggacaaacacacaagttgcgagatgcccagctgcaaaaattaaaaacccttgaagcacaggtgaataaacctttataatttgtttgaatgcagttcgtgttgttcagtacatgttggtcatacaagacttggacctgcagattctagacctcaagaaaaagcaggagaaccaagttcaacttctgaaggaaaagcaaaagagtgatgaagctgctaagaagttgcaggaagaaattcattctataaaggcacagaaggttgtcttccctttctcatcatgtcaagttctaatgcatcacattttacactatcgtaagtcataacaattttgccaaccttgttccattatcaggttcaactacaacataaaatcaaacaagaagcggaacaattccggcaatggaaggctacccgtgaaaaggaactcctgcaggtatgaataatttaatatgcagttaaagcaaataactgcaaaattgctatgtcattaaattaaattcatatagaacaaggaacgggtaaaaatgatgtgaccgtatctacttagagattcatctctaacccctttttatgtaatgtttctgttgtactatttttgtggtaagcattatgagaagtaaacctcacttactgtttcctgaatgcagttgaggaaagaggggcggcgaaatgagtatgaacgccacaaacttcaagcacttaatcagcggcagaagttggtaagcttcttatgtagaattgtatttcaaagaaaagaaagtgtcaatgtgaaagtttggaaaaattataagtttattgtaggcattatccaaactatcattatttggactatcttaaaatactaagcttcactttatgtgtaactagctgccctgacatagttttcgtcaaagttcatatcttacttagctatataattacgtgtaagtttttccctcatattatcatgtctatttataaaatattaaatatcaaagttttgcatctttatgcaggttttgcagaggaagactgaagaagctgcgatggctaccaaaaggctgaaagagttactagaggctcggaaatcatcaggacgtgacaactcaggtatctctctccgcattgcgaccatttttcgcattataattaatactcccaatctaacagctcttccttctttttctttttttttttttttgctttcttccaaacacatcaggcatgaatggtacttctcctggctctcatgtaagttattttccatacttaaagaaaaagatcagttgcttatttggaaatatccttgagaatacttttttttgtaatgcagatgactgagaaatcattgcaaaaatggctagagcaagatttggaagtcatggtgcatgttcatgaagttcgaaacgaatatgaaaagcaaagtcaattgtatgtgattcattttatttccttcccaaatgtaaattatagagatcattcctcatgtaatgcatgattatgatgactaatttaaatggttttaaaggcgtgctgcacttggtgaggagcttgccattttaaaacaagaagatgtcatgtctggtgcagctagtccgcccagagggaagaatggaaactctaggtaactgttatccccatagttctattttgtagttcaggtacctttaagctggacagtatctttaatccatatattatcacaaactgtttaagaaatataagagcaccgtttaatatgtccttgtctgtaatctggttgttatatttgggtccgtattttatatttctcatattttctcaaaatgtgcaatcagcacatccaaatatttatgcttgtattgctgcattttgtttctcagggcaaatactttgtcaccaaatgcaagacaagctaggatagcatcacttgaaagcatggtgacaatatcttcaaatactctcgttgctatggcttctcaactctcagaagctgaagaaagagagcgtgcattctctgggcgtggtcggtggaatcagttgcgttcaatggcagaggcaaagagtttactgcagtatatatttaacgttgctgcagatgcaaggttggtatttattcttttggcttcattatttaatagtatggtagcatccatccttgtaggacttctcaatttgcagaacctggaaacaaattatttttactaaagagctaaaaatctcactttttctttctaaatagttgaaaatctgtaagtgttattttgctaagaatatggcactgattcgaataaaagagtgtggtactgatttgaaaataggaataacaaaaaaaaaattctgaactcaaagggcaactttatttcttcctgaaagcatgacaacaatgtgaatggaagaacaatgcaaagccgtttttatgatactctgtaaaaatgatcatttgtacaaaagtatggaactaaccttcactggtgaaatatcagatgccaagtaagggagaaagagatggagatcaaggaaatgaaggagcaaatgacagagcttgtgaccatccttcgacacagcgaatcacgtagaagggaaacggaaaagcagcttaagcaaagagagcaggcagctgtaactgccactacatctccagtatggtttctatgagctcacagcaattacccctcagtagaaaaaaatgttgaatgatgaaaggattacctaaacatctaaaacaaatatctggtggtgaggagggtatttaacatctccattacccatgttcaaattctctcgtacgccctgcttgaaagggcgaaaagaagaaaacatatcatagggtatagtagatggaactgacaaaaaaacattgagtcacttgaatccctaactgatagtcacaagagtacaagatattcaacaaatatcgtgatagttcttaatggaaattttatgcatcttacagggaaacggaaatggttcagtgaagcactctgctgatgactccaacacaccattgtcaccagttgcggtgcctgcacagaagcagctgaagtactctgctggaattgtaaatagccccagcaaaggggttcctgcattcaacaaacaacatcttaaggtatctctacccccctgaaatactctttgttctatctccctctctcgtatttaaaattggtgacgtacaatgcagatggttcctatggcacagttgcctgttggcaagaaggtttcaatagcagggcaatcaggaaaactttggagatggaaaagaagccaccaccagtggctactgcagttcaagtggaagtggcaaaagccctggaaattgtccgagatgattcgacacagtgacgaaacgatgacaaggactcgacccagaccccagcttcttcctcatagacctcaaagagtgatgtgaaaaaggcttttcttttcttttttttcttcgtctccacatggactgacacggtttacacagctaactacctccacaagggtaacaatgcagctaaaagctccaggagatctccttcgtgcttcgattttacttagccacgggatcgaaaaaaaaaaagtatatgttcatagggtgactgtctttggatgtaaatttcttgtgcctatatagtgagtgtgaatgttagagatgaaaatttagcgagtgagcgagggagggagtggccgttcttcgcgaaagcactgactgagcacaatgcttcatgtttcagcactcatcaactggtgagatgtcatacttgttgtccttctgcatataaggaaaaatctgtcgaaggatggcgtcttgtaaagtcctttctggtgtgcttttgtgatcttgcatgggtatagttgcaagaatgatgatgaaagttgagattttgggtgcttgggcagtgcttattttcttgtccttttttcttttttgttgatacaacactaagattacattggtttggtttgtgttaggagtctattgatgtactacagcaacttgtgcccctatattttggccaattgtgtattctgtgctgttgatgctttgactaaatagagagcagtttgtgtcgacgtctatctaaagactctgaacttcgatggcaaacagccaacagcgactgttgcttagaatttcagcatctacagcaacgttttgtgtttttcattggtaacatgtgccaacctgttcaagtgtgcataactatttattaaaacatactagaaaccgctactttatgtttgatccgcattttcgctgcgaatagtgagctaacaatgttcatatgtttttgacaatagtataataaaacacagacacggggtcgattgagctaacgatgtaaaactaagctagtctgtttctgccaatcttagctattttcttgttgcagtcgactgatacagtcatttgtcggtaataacgtgaaaagatgccaatttctgaggaattattctaacacaaaattattgtgtcataatccgttgtagtctagctggttaggatactcggctctcacccgagagacccgggttcgagtcccggcaacggaatttatgcgttttggcccaacataaagaatcactgttgccttcacaagactcaaatccttgtctgatttcaaagaattgtccaagtttttgtttttctggttcagagttcagagggcaatttcagcatccatgtttgtcattcaagttccgaacccgcgtgctatctttgctcgggcgtttgggtgaaatagggctttcgtgctatcacacattcacactccatcaaaccaaatgcacagaaaaattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaatt

SEQ ID NO: 64530 - DNA, 8385 bp, Oryza sativa
cgaaagatatagaagaatttaagatgcatatagaagaactgctgaaactaggagcaataagagagagtagaagtccacataggtctgcagcatttatagtaagaaatcatgcggaagaagttagaggaaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacatgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataagcatcatattgctcacctagaattattttttagaaaggttgagcaaaatggtttaatcctatcaaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatatgctaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaactgattgtgaagccatctgtagatattataaccagcttaatagcaagaaaagctcaactagaagatggattttatttgaagatattattacaggaaatggttatagagttatatttgaacatattaaggggaaagataatagtttacctgacatgctttctcgtttaaccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggataatttctggtaccaatacaataataaaagggaagaaaaagggtatttgttatcaatattgaatagcctctctgaatattttcacctaataaatgggtcattaatgcctgccaatgaagatcatgaagtaatccaacaaaagcctatatatgtagtatttgatggaaagctccctggggtctacatttcttttgaagaaattgtggctcaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactccggagacacacaacaacaacgaagacaccattcagagcaaagcttccaagcgcgctctcaccctccattccaccgttcttagtagtagtgacttagcctacctggggggggggtgggggggtgggggtggggggggggggtggggggggggggggggggggggggacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggtgtctggagaatcggtatccgtagagaagtgttcccttcgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacaatgtatattgtctgaagcataggtttgtctgaagcataggtgtggtgtatattatctgaagcataggtgtggtgtatattgtctgaagcataggtgtggtgtattttgtctgaagcataagtgtggaatatatatggggctgggagtggtcgtcgtgttcaaacgctaacagtatctgtttggtcaagtgctaacagattctagcttgtgatgcacgagcagttcgaagcatcagttttcagccattttaatttgcccgatccgcccaccatgacatcattgattcatcatttaattttcacgcaacaatggccctaagcagaatcggttgtagtcttgtggagaaaactaatactagaatatatcatttgtacgtataatttttttttagattatttaacagaggctaagaatgagggaaagagtctctttcagtcatctcgttgatcaaattttaaaatttaaattgtttcacttcattactacagatccggccaacgttgatgaactatctgtgatgaataccagcaacctgtcacggaggccgtcacctctaacgggtagcaataaacccagttaaagttaggctaaacagaatgacccgtcacatataggagttatatataatttaactatttgccaccattgacgggcaacgcggcgccgtcgacccctgctctccccgcgtcggcagaggcaggaagggtagtgcaagatgtgaactgactggaactaggaagaggttagtttagctatgattgcctttcttttagctattgcacaatgtattgcttacgctaaccaatttttttgctggaagagaaacaagaagacaaaaacaaatgtgggaaggaagaaagcaaagggtgccattgatgcccaagccgctgcagttgatcttcaagcgaatacacaccaggaacaagagcagctgcagcgaaagaagcagctgcagaatcacaagtgcatgcagcataaactcgcagtcctggaccaatcgctaggaaaggcttaattgtgttgtttttcattttttttttcacttaactttggttcctgcctcgcttacacccatcaaaaacaacacgaagttggcagtaggggtatactggtcatttcaggttcccattccatgctggcaagcccatgtgggcagtgtacaatgtgaaaagtggcaaaaaattagaaaatcttctctcttcaatggcatattgttaactgcaaacctaacaggggcatttgaacaattgccaaatgtaaaagtggtaaatagttaaattccccgagttatatataatgaaccatcatctgtgataggtcatatgacatagcccgtcaaagttgtcaagtatcatcttacaaactgaccaatgtgggtgggtatctttatataccagagctcactcactatgagctatcctaaccatttgtatcgtttacattttaagttggggacttgagggaatctttgctataaaattggagggaaaatttttgtcatccgatcctaaccctatatattgcactaaaattttgggatgcgtattatttgaattattcttgatattttagtattgcagatggatcgaaaatggatgcactactggtggagaaagcatctttaatctcggtttgcaactcctttagttctgggttacaaaccgggacgcccaatccgggactaaagataccctgttaaaataaccggtactaaagattcacctttattccctaaagatggcagcgctacatggctggcactaccctctctagttcctaaaggttttattttctttttcttcattgttctttgcatattgatttcacgtcaaactgaccaacatcacaaaatcaaagattgacatcccaaattcacgtataattgaattcacatattattgacaccataaattcacaaaaattcttcactgctgaggaccattgcctgccaccgcctacctccttccctctcgcctgatccggcagaggagagggcaccgtcaccgcctgccgccgcccatcgcttgctgccgcccgccgcctccccccttcgtgtgacaccgcctgcctcctctcctccgccggaaccggcggaggggagggcaccgccgctgcccgttgcccaccgcctgccgcctcccccttcgtgcgctgccaacgcccactgcccgccggctcctgcccgccactgccaccactgcctcagtcgaacggattgagaggggaaggggaggatgagagggggaggaggaggagtggaggagtactgagataaatccggcgtgcgagggaggagataaggacgatgggatcgaggcatgtggctctaatattgtcccggttggtataaacaatcgaaactaaaggtagtggggacctgacagctttttgaaccgggactaaaaatcataaagtccccttacacttttaaaccgggactagagagtatttttagtctcggttcttattggaaccgggattattgtgatttttggccaacctagcaaagatgtattctctagtagtgtacagtagtattcgcttgagtacagaaatggagttgctcagttttcgaatggtgcagaggatgacaagtctagagtctagacggagcaaccaatatatggtttgtccagactgtttggaaaaatgtttgctgaaagagtgcaattatattttcacttgatacgatctggaagggttatacttcttgaaccaaacatggtgaggaataacctaccggtactacactaatgaatggacataacgagaagcaagatgaagacgacagattcgtcttaagcccccgtcacagatgataggttttttttagtgattcccctaccaaacttctgactagccaaaatgcttggattcccgtacattggaattagtgctgcataaatacttatattatgtaccaaatttgaatctgaaaatgcttatatttgagaacatatgaagtaccttttaagtgaacataaatgtatcaaattaaaaagttgaaatattcatattttcataattcaaagttgaagtatgttgttaatttaaattcacataatatgaaagtataaaatcttgcacggtaattggattcagaaatgttgtcattaaatgctaaaagtgtttatttattattcgagctatagttttgtataaactcaattctgaacgtacgtggtgaatttaaaattaagaaatttgaaatgaacaattaatattcatattcattattattttcaaggaaaagtcaatttcttcttccgtactcaacgccaatatcatctaattttttttagataatggaataaatatcccggcctttactcaaaagagttacaactaattattacatagaaacgtttaacgaacatagtgtaaatctaattgaatagaacataccgcaaggaacaataaagaatccagcctaacataaggagattacaattattgaagtctatttgtaaatctccaaccataattggcaaaaagttgcataaccgtagtctccaacttccgacatgcaactttcagaaactcttcatcatcttcacacctttatagttatgcccaaaaccgaagccaatgggttgctctgaaaatgacctgcatataggaaaatgatggtgatttgtcaaaaactatatcattcctactcagccatattgcccaacaaatggcagaagctccaacaagtatcaatttactcattttcttatgaactcccaaaagccacccatcaaaaatatgatatacgctaactgaaagattaaaaccaaaagaaaactgaactgctctccacagaataattgtgatccttcaactcttaaaaccacatatataaaccttacactcaacctatccaatggcagttttgactcagatgacatgcgatccgatccattgtgtttatatggctcacttgtcacacacagtgggagagagatgaacaggctatagatgacatgcagatagtgtgaaatccagatagtgtgacaagcatcaccatcttagatctttcaaaacgccatatgttgcgccaaaacttctccatgacaagtggacccagtgacaccttgaacccccaatgtatgcaaaataggttttttctagggttttagaattcagggatgaaagaggtattcaatgataatcatagtcaaatatatcatatgaacacgtattccaagcattaaatattcgagatggctaattctcgcgcacgagcgagatcagcaagtcgcgagcatttttacgagacacgggagtagttacacctaattaactcggttagttttacataatgacactaattaagataagatttttctttttccgaagattttttttactaatatattgaaaaattttaagttagatttgaaaactttctacttaagatataaactttaaagtcaaattttgaaatatttcaactcaaactttgaaaattttcaactcgaaatttaaatttgcaagataaattttgaaaactttcaattcagatttgaaatatttcaactcgagatttgaaagctttcaactcaaactttgaaaattttcaactctaaatttaaatttgtaagataaattttgaaaactttcaactcagatttgaaatctttccactcgagatttgaaaactttaaactcgagatttgaaaactttcaagtcgtgatttgaaaactttcaactcagatttgaaaactttcaactcgagatttaaaaactttcaagtcgtgatttgaaaactttcaactagagatttgaaaattttcaaatcaagatttaaaaactttcaacacaaaataaacagaaaaaagagcgaaaagagaaaagaaaggtaaaaacaattgtgcaaaaaaaatcgcggcgtgggggagagcctgtcagctggtgcccgcgtgaattaggcgcccccctaaatattccattttttatactttgcaaaagaaaacgaaattcatcacattaggatagaatgattttcctatgtatcattgctgcttattagttggttttctcagccattcatagacctatattatgtattctcccgtataactccagtcttcttttaatcgtcactctccagtcatcttttaatcgtcactgtttttgcttgtttagtaggatatataaagcataacgacaatgaataggcacctttacaatgaattgtaaaatatgtgtcattaaatgaaaagttgctaactcagccttgatctattttggatctttagggctgcaggaattc

SEQ ID NO: 64531 - DNA, 8566 bp, Oryza sativa
  unsure (1)..(8566): unsure at all n locations
aaattatagcagcatctaaatatcaatcggttttattaaatttaacactgaatgtattttaatatgtttgtttttttaaaatactattatttttctatacatttgatcaaatttaaagaagtttgactaaaaaaagtcaaacgacttataatataaaacacaggcagtatgtccctgcttagatcccactccaaaactttccaccctgtcacatcgaacatctgaacacctgcatgacgtattaaatataggctaaaaaataactaattatacaaattgcgactaatttgtgagacgaacattttaagcctaattgctccatgatttgacaatgtagtgctacattaaacatttgctaatggcggattaattaggcttaatatattcgtctcgcggtttactgtcggattctgtaattagtttttttattagtgccaaacaacccatgcgacactttatataatacccgatatgacacgacaaaatttacacaccgggatctaaacaccccatatgtaatactactaccctgcttctagcttaattacgattgcagttctagcttaattacgattgcaggcagctgaggatgccctgcgcttgtgagctgatcaggacaatcaatcaatcatgtctactcaatggtcacactataacacacagcataactcaatttggagctagagagatgatccatgcaaaatagaggcctgtgcacatgatccaattcttctagggaatctttgcctagcttatcaatcgatcgagttggtagctttgcttttaggtcgcatgcatcaatgcatgtggccggatcgatcgaacacgaggaagctggaaagctaacctacatgctgaagaaaggaatggaagcaacctttttctgcacgagggagctcttgctagctttcttatcgatctgtcccttgattttcagcgtgtcggcgtcgtgtcaccacgtgccatgtcgatccatccatggcttttgtgtctcggagacgattgatgctatttatttgttatactagtaatcactggcatatatatatatatatatatatatatatatatagtaaatttgtttggtgctccatggtgcccgggcaccattattgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattatgaaataaagttaaatttgagttgttttgttgataagtataggtatgaatcaaattattataactaggtatatattcacaatttgaaaattttgaaaaatttgagtaattttgtgcattagataccatggtgcccgggcaccatggtgccccatatgagtgtcctagttagtaaagtatacctagttactttactaactaggacacttatatatatatatatatatatatatatatatatatatatatctgtgtgtgtgtctgtgtgtgtgtgtatacatgctggcttctatgtgaaggtttattttttttagatactggaaatagattacatctccggcttatgtcataagacacacagccataagtttaatagtaataataaaatgtaagataaaagtaaatcaaaatgagaaataaggtgataggataaatccccaactcccatttattattgactagcgttaaaccacataaaatattttagctagcaattcttatggaactacaccacccatagtggaataagagacccttggctaccaattccaagagtatagcaccattgcgcatagtatacttctcctcctgtggtagtattatagatcaaaagtggagccagtaggaagacatgaagataacctgcatagggttagataattgtttaccattaaaaactttatcattgcgacaacgccgaattgaccaatatacaacactagctccaattagaatcatcttcttaatggacctagatacccctctaagccaattaccgaaaatgtttttggcgttacggggtgggggatattaaaagcaaaaaacacacatctcccaacaaaccgagcgacatgacactaaaaaaaaagatgttggattgtctcttgtgcatagcagaaagaacaatgtttgtctcccccattttcttttagccaggttatctttctttagaattactttcttgtgaagaaaccacgtaaagaccttgatctttagtggaattttcaagtcccacagaattctctttttgatccgaacattacagttcatgatcgccgcatacatagatttgacggaaaattgaccattcttatggagcgaccatacaaagcagtccttttcatttgacagagttatattagctagcctgaggatcaaatcgttctactcgattagcttttggccaacaatagctgttctaaaagagatatttagcggcgttgtgctcatgacctctgccacagtagactgcttctttcgagccacattatataatgtagggtattgatctttgaaaacacgcgatcccaaccacgtgtcttcccaaaatcttttgtttgtcccattgccacatctaaaagaaccaaacctaagaaattggtctttgactttcattaaaccggcccagaactgagaaatacctatcttgctggacataccaggaagaggtttaccctttaagtatttatttcacaaaaggacttgccataggccttcaccattaaacaattggaaaagccattttcttaataagcagctattttttatatcaaggttatggacacctagtccgccttgatcttttggtcggcatatgttttcccacttagttagtctgtattttcttttccggtcatcattactaaaaaaacgtgacctaaagtaatcaaatctttgaagcacacttcgtggaatttcaaagaagaataacataaacaagggaaggctcgaaagaactgagtttagaagggccaatctcccaccatatgacaagtttttgcctttccatgtgctgagtttcctctcaaatctatcttcaactcctttccaatcaacattccggagtttccgataatgaataggaataccaagatatctaaacaggaatgatccagaattacaaccaaatagttgtctatgaaggtttattagtagtaattgttcattcggctttgggttgcatctgacctactgtgtggttctcaattaaaaaggcaagatcaatttcgttaggattgcacctttggctaaatattgctgtgtccagttgtgagttataacaccgctggagaaagggtttttaatcccgattcgtaaccccctatagtcccggttatacaatcaggactatgaagtaaccaggtttaaaaatctatctttagtccaactaaagatgaaagaggccaggtcccgattggaccctccttgcatattaatttcactccattcccaaatcatccccaaatcatctctaaatcatagatcaatcttcctcaaatcgtgaaatccctaaattatctccaaatcacatatcatacatcacaaattctcaatgatggttacatcacaaattctaaaaaagcatcacatattcacaccacaaaatctcaaaaaaaaatcacaaatcctaaaatccccgctggccgccggcgaccgccgcccccacccggtcgacggccgccgccgccgaccccgcgcccagccaccattttttttttgatatattttggggagtcagagaaaagtatcaccatattttttttaaaaaaaaataccaaatataaatttctagatgaatttcataaaaagaaataatttagcatttttcagcctgccaatnnnnnnnnnnnnnnnnnnnnnaattcacagaagatatatacacatttgctagtcacaatgactgcctcatcgaatttcatttatttgattgaagtttcttgaaaattcaaattcaccatttgaattttgctcacttttggagattttgtgatttccataatttctagccctgggaacatatatttccctggcaatccctagggcaacatagttatatactccctccgtattttaatgtatgacgtcgttgactttttaaccaatatttgaccattcgttctattcaaatttttgtgcaaatatgaaaatatttatgtcatgcttaaagaacatttgataatgaatcaagtcacaataaaataaatgataattatataaattttttgaataagacgaatggtcaaacgttgaaaaaaagtcaatgacgttatacattaaaatatggaggtagtatttgagaagaactaatagtgaataacattttgagcatgtagaggatgcgcacacaaaagttctacagcgagatattgaagacaagaagagaaacacacagaaacactaagaaactcaactacggaagatattgttgattataagtcctaacgtttattagcagctaaaaataatttgtaaatagaacttttataaatatctttatagtgactaataaaccaatgatgaaaaataaagtacaatcaaagtcaacgatttaagattgaaattttggctgtgggggtaaggtgaagagcaaacgatggagctcgtgtggcaacacttctttctacttggcaggaatggtgatttgttctcaaaattgtttggtatacaagtaaagatgaaaacaatgtatgcttttcagtccatttatatgccccgtattagagggttgctagggaatggagtcccgtcggatggatatgtactttaatgaacctcctccaatttccttttttccacccaactggactctcatccataaaaagaattgtgtaggatcaaaacaccataactaagccaactagagaggggtgaatgtccaaaaaccaaaacttttagcggaaataaaagttaccctcaaattcgatagatcgtggtccgacctaggtgtatgcgccggtctgaccgcctgatgaacgtcggtctgaccgagatcgaactccggtcgaaccgccgagatcgcctgccgctccctgtcgccgccgccggtctgaccgcaggtcacctgctggtctgaccgccccttgccgccggtcggaccgccggtgcgctgtcggttagaccgccgaaacccggtgaaacacaaatcgaagaactcttaaagtggatgacgactttattgattctctctgtgtttacaaagtgcaccaccagcactccttataaaaatctcgactaaactcgaaacctaactcaactatcaactcaattagtctcaaaagcgatacagggaagcctcacgcttcctctctatttataccccaaggtaggcagcctaaagccacgaaccaaactcatactagaagtcctaatcaccctagaaaactctctagtacaagaaacaaactttacataaccaatcatactaaatttggactcctttcaaattcgactattggattttatagattgaagtaaccatgaccccacattctttgcctagtgtggatgcacaacgattctagcatgacacgataacatcggggctagtggctaggacactaggaggaggcagagtagggcatgatcatagccgtagtagcagccgaggtgactcccaccacaacagctgcaaagaaaagaggatggagtcgagaagagaaaatgaagagaaaaggggacaggagatgctagaggcaagcgtcttcccagctggcaaagcggcgatgaagtgcgtggctccccttatcttgatatcatatatatgagataccaagacttgatacccacaagtatcaggtccggtacctgggtactatggtacatgcgtgtaccaatcttggctgacacctaggtaccaggggtatcaggcctaatattcatagacatcggatttaatactatgaatatcaaccatgataccatgggtatcatgcctgatacattatgggtattggtcgaggaagacaatgcacgatgtacctgtacacaaatgctaatgagcagcatgatggaatagtgaggagcttgccggatttggtgccaccgtgccataaacttgagatgaaggaaaccgacgtagtccagcgtcctcgttgccagtatcgaacgatgggtaggagtgtaggacctaggcctccagatccatcgcccatgccctactctgccatcacaatgccatccgacagattagctctccacaacaacattgatatcaccgtgcctccgtatgcgcatgctcaaggtgagagagtgaatggggagcaagaggtggtgtagtttggaggtgagggagagaagggaagcatcgttaacgccgacaggtttcgccgtcactagctgcaccgctattagctcatcattgtgtcctacgttaggctcaagagacatactagggtgatgagtggatgatactacctctatttttgtttgtatgacgctggttagttaaagttaaactaaccagcgtcatataaaaaaaactggagggagtagttgatagagcagtagcacatgtgggatatgaacgtgattttcttactggtacatctactatcttttaaattatcccatccgaagttatttcgttgcttagtttttctgttcacattaagggctcggttttttaacttgccctaaagaatttatattaatttgttgtaagtgctcatattaaaggctcgattgtttaactttgccctgaaaacatatattaattccgaaaaaaattaagaaaacttggttctactttctctagctaacaggattgcaaattctttcctacttagcaaagaaacctaaatcccgaattttttacattttaatcattttgaaaaacttattttactaatagacctctgaaaaaacttatttcaagaatggtcatttttggtgagctagagatattggcgctgtcatccaacagggcaacgctaccacctctagtgtcgtccctgcgccaccgtggcaccgtgttggctagccgagctgacctggcacgaggttggagaaatatttttgacttatgtaagatagaggtatgactccgacttaaactatcggattataaattatataagtcaaaaagataacttaaaaatttaaaccattaaatctaagcctaaacaaaaagccctaaataattaccagtgttgaatcggaaaagcaaaggaagaaattatatgccccctttgcattatccgataagaattaagaaaggaagtagattaaaagatggagtagtagcaaagttcatttttatgttgaaagaatatttagaaaggctgctagtgtagtatgggccgcgggtcacgtggccgggctgtaccacaaggctgcttttacgagcggagtgggggctcgaggtgggcccgatcctagggcctttaccagccagttggcccaccaattattgaaagctcaaacttacaggagtactatacactgattaattacttaattaattgatgaattgtccatatggaatccaaaggaaacgtgtgttttgcaagtttgcaattaaggtacaaataatgtttgtatagtaatgtttgcaataaaaatcttcataccaatgaatattgtctaattgagcgtgttttaagagagtgtctttttttttaacgaatcgacgagcgccaatttcattgaacagagcaaagcaagagagtgtatttatgggtgtgtgcattcattcatatgtaataaaattaagaaatctagcatataaaacaccagatttcgagacaagcaaaatgttaaactctgtatggttatagcctaaacccatgaatgaaccaatgtcagcaatgattttattaagataaacagcattatatgcagggtagattttgttccctccaatcgacgtgccacagcaaagacacataatttggtggtcccagaaatcaaggggcacaataacttattatgttaatggcagattaatttgagtatacttattatgttgtacacgcacacacttaattagattgttgtcatctagtactagctacaacaactcgatcgatctcttacgaggtggatgagacatactgaagataaaaaaagaaaaatactactgtatatatagctagtagcggcgccagaaattattaaagagtaggactaaagtagaatttaaccagtgagttttttatttttttcttaaatttacaagctgatttaagataatttagtcatgattttttaaggtaggccaaaggttcaaacccttttagacatgcctccgtcccggtatacagtatacactcgacatattaaaatataacaattgttagctatatatatggataaagatacgttcaaatacatatagcaataaatcgttatattttaaaataaagatggtaaaaatgataaagtccattgacacgtacaggtaggaacaaccgtcagtacctctaatgattcacatctactactccgtccaaaaaaacgaattcctagctacctgtatgttcctaggtt

SEQ ID NO: 64532 - DNA, 19674 bp, Oryza sativa
ctttcttaaaacgctctcacgttgccacttggcgctctaaaaaattagagaaagtcctaaaaattctaagaaaaaagcaaaagatctagccattgattttcatttaaactgatggacccataattttacaccgttagattagattaatctttgggcccctctcctgccaaaaccttatccacgcacctgcgggcacatagctgccacctcccgtacgcccctatttcttttttttcctttttattggtggttattggttaagatatttaatggcctattttatatagaacttaattaaattctcacttctctttttctgacgtgaaggctgagagcggactatgcaccgcttgcatccatgcacttcgcatgcatttgtggtttctactttttgagttggtccttttaaaaataaataaacagtattttaagtggttatagcttttaaattatatataatcaatttgtgatcgatttgaaccattctatgtatttctttacttaaacgatttcaggcgcattgaactatatttcagagtaacagacaaaaattacatgttagtcccaagaccactaattaaagacgatcattaaaaattctcaaactttttttatggaactatatgtatcttttgacggaaaatgatgggggtaaaacatgcaaattttttaccgttggatatgctttaagatccatgcgtggaagagagaaaaaaaatcaaatggcacatggataccaaggatcacaccggcgatcgacgctgtacacgtgcgcaatcgatgcgcaaaacactagagcatgtgttcactaccaagctttgtaactttttctattttaccataataattacatctttcttgtactgcagttacatatgagttacaaatataattcaactgctattgtacgataattacatttgtcagatttttagggggattttctatcgaatgttagataggcggtctctatttctttttaaatctaaatgacaatgatagaccgttagaaatatatgcaatgccttcctctcatttgaaatatacacaatgcctttcttccaactgtaccaccacccctctcctcacctcctcttacctcccctttactccttatttttatagtagttgagataataattttaatttatcataataaatctcaaaaaagtaacttttaggttacccaaacaattattattcgttcacgccgttatatttattacaattaaatttctttgttatctctattttaatttataaagaaaataaatattattttggataggaccctatgcatcatatctaagggaaaaaagaacgacaacatatattgtaatatcatctatcgctgtacaaacatgcgtaactaaattagctgtacaatggttgaaacaaagtttacaccattgcattatttaccattaaattatcaatttatgatctatattgcttgtattttaatttgtaaaataaattatgctttaattcgtattttgaatctttgcctgaaatcccaacggacatgaaaattatgaaaaacatgacaatataaagtatatcactatataactttaaccagaataaattaaatttataatgacaacaagtaacatatcctatctttatctttagatttataaatatgcttaaagtatcagcacaatttaccaccatgtataaattctacattttggagactatattaactccctaaattataagtaaagaacataggagtacatgttttctctttgatttctattaaatatgtatggtatgtaggtattttatactaactttggttaattattgaacacaaatcatactaaacttatattagtgcccgaactaataagagaatagtagtgcatatcatgtcatttcctatgtgatttctattaaatatgcatggtatgtcatatatcctaaaatacataatgacgagtatagtagagcagaaaaaattttagcaactccaaaaacaagatatggtaaatattcaaaaaaataaaaacacacgcaccataaaaaccatagttccataggagccaacaccattgctgtgctatcatattttttctcatgaattcaagattgtatggttttaagtaattttagtttagaatttatatgttgcaagagtaatcaaaagaaatccatagccaacattcagagtaatcccatacaaattattggccaaaatagacttagaatagagttattgaatatttcaagaaaaatccacctacatagaatcattattttaagttaaaacaagtgcccatgcatattggagccacaatcgcatgtgcgtgggctaccttcctagtttagaaaatactccctatgtcccctaatataagagattttgacattttgcatgcactgtttgaccacttgtcttatttaaaaaatttgtacaaatataaaaaacgaaaagttgtacttaaagtactttggataataaagtaagtcacaaataaaataaataataatttcaatttttttaataagacaaatgatccaacagtgtcagcaaaatgtcaaaatcccttatattatgggacggagagtaagtggtataccaaaataaatttccttgctatataacaatttcaaacactagaataattttgattgctatcataatttcaaattaatttgtaatatatcaaaatttcaaactaatttgcaaaattgattagtactcattcatatatatatagacactactcgtacgtagaagaatgatgctcatatatctactacattaaaactacactacattaaaaatgaaatcgtcctcctttcttctagcacatttcttattatttggatctagttagcaaggtttaccaaactattttaattagggttatcatcacttcatgtttaacgataatcacgaggtatacaatagtttcaaacactgagaaaattaccgttcataagctgtgttcagtttctaaaattaggaaaaagtttaggaaaaattggtagtttgaaaaaaagttaaaaaaagttgagaatttatgtgtgtagaaaagttttggatgtgatatgatgtgatgtgatggaaagttgaaagttgagagaaagtttggtgtgaactaaatagggtcctaataatctacggccggcgtgttagtagtatagaagaacaacgtggtacgtgtcactgaccgtcatcaagcgacaaaagtgaagtgcagagtacgttgcttctgaaactagatcaatgattaaaaaaagctgaattattaatgtataggaaagggactgcagaacacctttgaagtcacagggctactgtttgtacggcaagaaccaggaccctttttgttaaggcacaaccatcaaaatttggcttgtgagcctgccacattaccattatgggccgggaattaacatggcaccacaatagtacagcccatactgagatttcagtctttgctactgttgccattaattggtggccttcatgtggagactgcagaggacaatatacattagctccctctcagctcaaactttttttatatatttgtttgatttatatacatggagtaaatttcacgagaccttttataatatgtagttttacaatcaaattgatacttaaacatatagttttgatactacctacatcttagaatataacatttttttagagttaaacattctattaaaaaaaggaaaaaaaattgggaaataccatcgcaaagatacgtgagttgcaaaataccatcgtacgtgagaatgacatgtggggcctagacccacatgtcaatgacacatacgatggtattttccaactccgtgatttttgtgatggtactaggtaaattggcccttaaaaaagtaagtggaattaaatatgtaaaggctgtgctaggttacgagtagaaaattgatgggggaatttgaactgtaaaagaattatgattgattaaaaagggaatatgtatacggagaaattattatattttcagactgagtgaatagtaaaaatcatgatagcaagttgactacactaccacactttaacgcttcccgatcgatataaaacaaaagatgacagagttaagttaagatatgttgcaaacttcatcggaataacaagtattccctccgtccaacaatataagggattttgagtttttaattgcaacgtttgaccactcgtcttattcaaatttttttacaaatataaaaaacaaaaagttgtgcttaaagtactgtagataataaaataagtcacaaataaaataaataataatttcaaaaaattttgaataagacgagtggttaaatattgcaagaaaaactcaaaatcccttatattatgggacggagggagtagcacgtttttttagtttgattagcttatacatgtgggctggaacctactccttcggtctcataataaataaacattgtattatataggagtctattgtaactcactgtactggactacactatatttgtttattttctaatttacagtactgcaatacactatatttgtttattttatttggaacgaagggagtagcatcatatcaagcgccaatgaataatgtaggtgtcggatcctacataatatcacacagtgcaactgcattttcttctcatgtcctatctagtgatgaggtttttaattacttcatgcggcaggccaccaaactgcctctgcacttgtactacagccaattactacactcttttgccagcaattcatagtagtatgaaataattatttgcttgtgatttatattaattggttcctgtgaaattttccgatccaaatgagtattaattattatatatgattaaagtgtaattttgggagcaaataagattcgctaaaattatagttaagataacattaattattcagataaatatagactaagccatatctgtgattaagatgtagagcctcatcggtttgtccatatatatcccctaataaaccaaaacgatttattagggaataaaaaataatttatagttaaacttttatatttattcatagcgacttaaaagccaacgctaaaaagaaattttgttgaaaatatcttaaaataaactttaaaattaagtccaaaaattgaaattttggcttttgctttggcatattaattaggccaactgatggggctcgtagattcaacatcggttttcgttagctcgtttttcaagcggttaaatggtatgtttcatgcgaaaaccttttatataaaaattactctaaagtattagaaaattttgattttaagtttataataattagaacttaattaatcatatgtgaataactttctttgttttttttatcctaactatatcttctagtagaaacgaacaccatctcaattgatcagccagccgttgaggtgtctgaagaaaaaggaacaagctagctagctacaaacaaatttagcagctgcagacacaaatggaagatgctgcatgatatatgcattcagctacacagttgtggcgccaaagaaacggctagtcgattcatcagtaatgtcaatcaaatgtgtcaagcaagcatgcatgtgggcacagggaattgcagtggcgatatgatggcccaactaaaaacagaacgacgctgctgaatttgcattaacagatggtaagctgcctcattagttgattagctatctaattagttacatcgtcgtcaattagttgcacatcaactcgtagaaatcttctcacctaatccatgcaatctaattagcctgtaaattaacggcacaccactcaaatttttttaaaaaatatacttttttcattggatttacgtaaaaatacacgtttagaaaaaaaattgtagaagtataccattacagaacgaaagtgtgaaatcatgtgttaccatgcaacttcgcgcggcgagtgcacgacttcgcgcagtgagggcacgagactgctcagtctttgcacgacgagtgtgtgagaccgcgacttcgcatccctaactaaagcgctcgcaagagtaatagattaattagcattattagcaattaattaattactgttatttctttaattattcaggagaccatgaattttttttatttttaagactttttatgttttaattttattaatagaccattaaaaaaatattttcaaatctaaaccttttggcgtggccaaataactctgtcacgccgcatgcagcgggcatgacagttttgtcctgccacgccagcgagagcggcgtggccaaataacgctatcatgccagcgatgccgccgtggccaaataacgtcgtcacgccagcgagtgcggcgtgatggccaaaagtttcagatcttgaaaataaattttagatgggtttatttttaaaattaaaattaaaaggttcaaaaaataaaataaaaaaatttgagaccatgttgttggttggccaagcagattgtgtggtctctcgcccaggcttcgggagaccgcggtgggtcccgcgatctcacggcatggccaccggtatcgtcacgccggtatcatttttacacaatggttaagtaatatcgtgtctttttcacactcccactttatgatgatggtatatttatgttaaaaatagttgcatcctggatatttctgaggaaaataaatgaaaagtgtattttcaaatttaaatccataccactcactacaagaatccgtttggttgccaagatatattttcttggtggttttcagactacccttagcggttgttggctgccaaaaaaaattacagattcttgtagtgactccacgtcaccacgtgcgtacatccttaattaccatctatcgatacttccacatagctagagagggagcatgctaatctatgtagtaagatatatctaagctaacatattttgataattaaatggataaatctgaactgaagaaagatgccctacttttctgagtcaaaattatgtgtcatgcatcacgactcatatgcatgtacaggcatgcatgtacatctctgaacagattaagctgtgcataatatattagtatgctgaacagtacaatataacgtggccaaattaactacctagctagtctatcttgttgatagaagacgttgatgcttaatcagcttttgatgccatgcatggtagtaaaagttggtaactggttctagtcgacatgagaccttaatagtgttgtctttgttattttagtcagttgtgttctaattttacgcgtgcatgcagtcctgcattgtggactctgtgatcgaagtacacatcatgaagtgaacattgcacctagtatgtaatgtcttagtacaaaaaaatcagttggttaattaccatcaaacatatatattagagtcatggattttacgcacttcaactctaaaacataacaattaattgaaaaacaacagtttgtgcaaattattaattacttggcttactgaatttgatgcccatatataaatattgcttttttttcattattaaaaaattaaaagaaatatagtatatgttcagtttagctgatttatttttaccaaagtttcaagttaaatcctctttggcccacaaattttactttggatctctcttttacatttactttaacacatttttgctgtcatctaagcccaagaataacctgaaatataaaataaaaggatgagaaaaggaggtctaaagtgaaactttagtaaaacaaacttaaatttacataaaaataaaataattatcttctactggaaattttatattcatgtacgacattcatctactggatcaatattgatcgagctagcgataaaaaggttggagacagtatcgtctttatggtaaattaaagattcattgtcgatcggtcaggaatttcaaaatttaccaattaattatttagtgacgattgcaatacaattttgaaataagttattaaaaaaatatggctaaaaacaaaaaggttcaagatgacaccagttttacggaaaaacgatgctagatccgattggaatttttcatcacccaaactgcctctataattattatgataaaaagtgtaaattaattggtagcaaatataattatcatgtttagaactgcaaactaatacaaatatctgaaatacaaattaatgaaagatggcattattcaggtaactgtacattcagccgttgaggtgtctgaagaaaaaggaacagatgtacatgcagctattagagacacaaaggacagctgctgcatgcatatattgagctagctagctcccgtgtcactcatccatggcgccaaagaaacggctagtcggtttcagtagtctctcattcatgtgggcacagggaattgcagtggtgatggcccaactaatgaaaacggtaccttcgctgaatttgcattaacagattataaagttgtcgtgttaatcttcctgattaattgactgcctatctaattagttacatcgtcgtcaattgcacatcaaaatcgtccaaatcttctcacctagttccatcaaaaatcttctcacctaatccgtgcaacccaattgaggggagaaccctaaaattttcatattctaatccgcaccgtttctctctgtttaaaggtttttcgctctagctttaggaagtttcactgttacttgtttattattgatttatcaataatgggtttgttttttttatagaatttttgttaattttttttaattagtgtgtacagtgcatacacgataaaactttgtgtgcatagaatatttttactatatgcaatcatgcatgtatctaggttaattatatgatgcgtctttttctagcacaagcatcttttggtaagcacactcatgcatgagcatcagcatatatcgaaaaaaaaaatctatactatatatgctgagtcacacattaagcgccatgcatatccacagagtcacatacatctgaagattaataaaagttgtgtattgagcacaacatatataatgtggctgggacgtacgaagttgatgcttaatcagtatatgatgccatgcatgcatggtaactggttgaaatcgacatgagagaccttaatagtatgtctttgtcatttggttaatagatgagccatcactaaataaaggaacgttgctcgtgcagtcctgattagggatgaaaacggagtccgctccggacaaaaacagatacggataccttttggatcggataattctcggatatttcggatacggatacgaatacggatattttctcccggatacgaatacgaatatagtatcagggtttccgtcggatacagataataattcggatatccggtgaacagtgctattcggatatccgcaggacccatgagacataccccatttctttctaactctataaccttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtctgatcatattcgattcttattcgtattcgagataatccgtatttttttccgtattcgagctatccgtattcgttttcgtatccggtaaaaaatatgaaaacgaatatggtatgagcaatatccgtccgtatccgctctgttttcatccctagtcctaatcaagtgtgtgtgaaactgttaattaactgtagtacaacacatcaagagaagtgaaccctgcacctagtatatatgtcaagtacaaaaaagatggagtaagttgttacaggcaaaaacagattagcgacgcatcaactctaacatgaactaaatgcatgcaatggttacttagtttaaacttgaatctgatagccatagacatatatattggatttattcatttccattgtctaaaaatgctgtattattatttatattttagacaatgaatatatatatccaatatatgtttctcgataatcaggacaaagttgtaaatttagggggcaaatgagattatctgaaatataaaataagatgacattattcaggtaatttttattttgaaacttcttaattttcttaccttttcgcgcttcactttgaatccattgtcctcaatattattgccatccatctctaggtaggctaggaacgacaataatgtggtggtcaaggctaggaggagatcattgtgatacaatgagtctaacattgacaaaaggagtaaatgggctccatttgggcatccaaagaggaaaatgtgggttagaggtttaacatgaaactttaataaagatgaggagtccaaattaagtccaaactaaaatttacacaaacaaaagaaattaactctcttttatggggcaagtcatggaaactcatagaagtgaaaaaaaaatccataatacaaagatgcctcgatcgataattaatcaggacaaaggtgtaaatttaggggcaacgattatctgaaatataaatattaagatgacattattcaggtaactgtacagtcggacagccgttgagatgtccgaagaaaaggaacaaattaaccagctataaacggtgaccaaaaagcttcagacacaaacgacggatccaagctcctggatgcgttcttgctgcaacgttatggcacaaagaaacggctattcgatcgatttcactagtgtcaactctcatgcatgtcatgtgggtgcagggaattatattgccgtgcgatgtcccaactaataaaacggtactccatctaacccagttttccatctaattaaaatcatccctaaataaaaaacaccaaactaaagacatcaaaatattcattattctgatattaatcctcatcgatctaggtgatctctcgcttcgtgtccaacagaaattaattcacacattaaataatacatgggttgcactaatagagattaattttgttgcctgaatgcattccacgatgtgcatttactcttttgtaaaaataaacaaagagacacttgatcatatgatgattatttttggaaaatccccaaaaaattaggtgatgatacaatgctgaatttgatgcatgttatgctggctatctaattagttacatcgtagtcaattgcgcatcgatcaatttatcaaaatcttctcgcctaatccatgcaatctaattagcctataaattaacagcccacaccactccatatacatcttaattaattacgagcaatattgatggccgctatttttttcattagattgaagacacaaaaatactctctgtcccacaaacatttcacacgtacttaaataaacaaaaatatattttattttctgttttttctaaataaataaaatgtattttcattttacaatgctaaattaaatactcatcgctctcacgcgtgtattttttatatttgttacatgtgggataagttaatttcccttgctctaggtggaaggagagagagtaccagacacagagactttatttatttataggcattacaatcaataaaactcgttcgcgtttaattagagcctagataatacaaacaaggcaacattgtcatttcccgtcactaacttttttaaagaacggctagaaataaagtctttccaagacggagggagatcatatcaccgcccttacctgcgcataggcacaattgcaccccagtaaattcactactacgacacaaaccagttttgaagacacaccatatttatatttacaggtagctagacttaaaaaattacgcctgtaaaaatatagaaggtctctcggcaaggttccttagcgaaaattgattttcagtactgatgggtctcttaaaagtaccactcacaaaaatcgacttttggaaagcaatcaaccaagaggacctcatgtgaaaactaatagatgcgcgggcggatccagtcggtggtgatggatccaggtgatggcaaacgaatccgaggcgacggcagctaagaagagggctgcgacgggtcttgggggcagtgtagcttggtgcaacggagctcagcagtggtggtggagctcgttgaggagaaggaggtggtgcttgttgagaaggaagtggatccgaggtggtggctattaacaagaggggcggtggcagtggaggacgtcggatctggcctcctacgcagtgcgaccaccatgacaccggtaactgctagctcctccactctccctcccttccctcttttggatcaaacgaggacaggcagaagaccgcaacaataaccgctgcgatgatgatgatttgtgaatgctatgtgatttgtgaatcgaatttgggaatttttgcggattgaatttggttgggggtttgattgagagttttgtggattggatttgattggaggatagattgaggctatcaccaagaggagcagcgacagtggcgctgaacgatattttcgcaggaagacaacataggctgcaggcagccggacacccgtatgtgaaaatacactattttcatagacttcaattcgtaggcagcatggctggctgcctacgaaaattattttagctacctgtgaaaatgtttttctaagtgattgtttctattattttaattcttgaagacaatttttttattaattattttttagtgtcaaaagttacaatggatggactgttagttagcatggaatttgctagatgaagaagcaagcggcagtacatcttgagcccaatataatgcgacaaacggttcatgaagatgttgatgcttaatcagtttttcactgtcatacatggtaaccggttctgatcggcatgagaccttaatattgtctttgtcatttggttaattagttgatgttctattgctaattaaaggaacgctgcgttgcgtgtgcagtcaattcattttgtgtgaactgtgaagtacgtgctgtgaaatacacatcaagaagtaaacactgcacctagtatatgtctagtacgcaaatcagttggttaccggcaaatggacatataagcagacattacatgcacatcaactctaaacacatgcatgggaactgaaagcaatggttacttgtgcaaatgataacttagtttctacttgaatttgatagtcataattaaaggtgagatatttttcagattagttaatttatctttacgcatcaaacaatatttgggattccaaaagtttctttgatggaagattgaacaaaagaatcaagcaataggaggcaaaaaacttgaaaagatcaaagtaaaagggttaagacaagaaatgtccaatacgtcacatagaaaggtaaattgcatttgtagcgcctgaactgttcagttttgtgtattgaagcacttgtacctgaattttttttatttgagaccctaaactaatccggagcgtaaatcaagtctttccgttatgcctttcccttaaattgcaaatgtgcatgtatgaagcaattcagaactaagtatttatatattgctgtaggtaatttgccattttcttggagcatgatttacaacaagcaaagaatctgaaattgattttatctgtgtttgaaaagttgtctggcttgaaaataaattttcacaaaagtgaattattttgctttggtcaggcagtggaatattatgctcagtattctaatatttttggttgtaagtttggctcttttcctgttaaatatctcggtatcccaatacattttagaaaactgagtaataatgattggaaagtcattgaacaaagaattgagaaaaaacttagtagttggaaaggtaaacatttatctgttggaggaagactggttttgattaactctgtactttcaagtttagctatgtttatgatatccttttttagataccgaaaggggttcttcaaaaaattgattattatagatcacgtttcttctggcaaggggataaccataaaaaaaagtacagacttactagatgggatatcatttatcaacctaaagatcagggaggtttaggggttcataatttggaaatacacaataagtgtcttttgagtaagtggttgtttaagttgattaatgagaaaggtgtatggcagaacttattgaagagaaagtatctttataaccagtctataacccaagttaataggaaacagggcgattctcatttttggtcaggtctcatcaaggtcaaaaatactttcttaaacatgggttcttggattgtgaataatggggaacagataaggttttgggaggataaatggctaggaaacctggcttttaaagacaaatatccatctttatactctattgtccgaaggaaaagttctactattgccaatgttatgagatctgttccacttaatgtttcctttaggagaggtttagttggtcagaatcttgaatattggcatgaattatgtgcttctattgtacatattcagttgaatcaatcctctaattgttttagatggaattatcaccagaatggtagattttcagttaggtcaatgtatctagctcttattaataatggttatattgagagaaataagattatttggaagcttaagatggcgcttaagattaagatctttatgtggtacttgctaaaaggagttgtgctaactaaggacaatttggcaagacgaaattggaatggcagtttaagatgttgtttctgaatgaaaaacgagaccattcaacatctttttatagattgtcattatgcgaaatttgtttggagagcagttcagttctcatttggtttataccttcctggaaccatatctaatatgtttgatagttggcttttgagggttgaaaagaagaagagtaaactcatacttgtagaagcatttgccatatgttggactctgtggttgagtaggaatgatatggtatttgacaaatcaccatctatctcatatttgcaggtaatttttagggcaacatattggctccggtgttgggcacagctgcaaaagtatgaagatgatggagagcttatgaaggttgcatgtcgtaggcttgagacgacagttatgcaacttttttgcaaactatgaatggggattcacaaatagacttgaataaatgtgtactccttatctcggtttggtcttttattttgttgggtgtgtttaatttcattttgaactacactcttcgtttgagtgatactttgtaataattagctgtagctttgatgagcaaaggccggaatgtttcattccattatcttaaaaaaaaggtaatttgccatgacataagtatttactagaatgcactggaacttttctcatgaatatcactatatcagtgtaccactcccaataattcctcttcacagcatggcacggctaatgatggaacttgattagtagtatatattattattttgcttgaaactaatctgtgtgtccatgccgtatagcctctttttggctagcatatactgatcatcaataagggttttttctcggtaataaaaacttttattgaactaaacgaaattcatcgagagagaaattaaattatattgagaaacatgatatgccttaaatgcaaatgcggtaaacatatatgtagcagttaattgttcatggagcgaatgttttgttaattgtttgatagatatgtagcagcaaaatttgattttgaaattgtgcctcttgtcagaatggtcggtttggaaccatttcttttactagtaatatgcatgtacatgataattaggaatgagcctggggatgattgaggatacaacgttggatccagaggttactttctacgtacgcatgcgctgtgcacggtgggaggaggggatgtaagaagaacgactccatttttaaggtacgtagtagagacaatgggattaatttcagcctttgccaattataataaaagttttaggatgaatgatcgtgaattacaaaatcacaatcttattaaaaagagaaagttacttagaatactaccttaagggcagagattatacaacaacttacaagttacatatagtccttatcttcctcaaacaaaaaacataatatcctaaagttacaagtatatagtgtttatcttcctcaaacaaaaaccataatctcctaaatcagtggttgatcattgcgtcgaacgaatttgcatatatcaccatggatgactaacgtcaaacaaagcggaagataacgttaaagagttactgagttgtaaatcagttattcacctagatcttgccaccgtcgtagccatcaaagccgatccgattccaaggacgcccaaccagcaagtaacctccaatgtgacctctccaacaagcacaacatctacgatgtcaccatcactattttgaacatctagaactaaattttcacccaaaagatccaccatgatgcacaaaagtgtgggagatgacgtcagcaacgctgcctataggaagatgtgtggcgcccacatgctgttagaataaatgggctaggcccgataataatactaccatgggaattaaacgaggagtatctcaacttaaatagggagttattggaggctccctgttgactggttgaggtggggatcggaaagccacacgcgcgcgcgcgtgccgatccggccggccggcccgggccgggccgggcccaacgggtggatatctctcctgtgctataaggaaagaggcaacccgattagatcctcttggttactttccaactggtgttcttcctcctcctcgcgcgcccgtgctgctactgttctgcttccccgcttctgatcgcttgcgcgcacaagagatcggaacgagcagggcctccgaaaccacaccttcgcctaagatctgcaccgagtaggcgggtgatcaggtttttggggagtgcttccgcacgattgctcctcgtcttcgaccgtacgtcttcaccatgtctgccgccaccactgccgcacctagagatggcacgccgggagccggatctagcgctgcgaacgacaacaccaacggaggcagttctgcctcacgatccagcggagggacattcacagggtataaccttctacgcttactgttatttcggtttttgatatctctgttagtcgcaattctattgcgtacgatgtatgatgatgatgcttattctaccttaagcatgctcctgtttatgtttgattttatcactagatcatcccacattgttcatgccatgattattgtcttaatattttggattaaaatatgccgatatatgactatatttctaacacatgcatctcccatgtcaatgctcctagcattgacagccttggcctcggatctatggcaatctgaactcaacctccatctcggtgttgaatgtcgccaacagttttcctaagaacaatggcaattaatggtggcagccggacccgaaccggtgggaggtggctagcgatgaggtgcccgaacctctgtggtcaagatccatatggtgctgatgctagaggagatattcaaaggtggaggaggagccacctccccatatttccctgcctccaatgcaccagagtaaccacgtcacctgactgtagataggtgcaaagacatgccgacttcccggcaccgccctccttgctcgccgcatggattgttggcagcttgctccggcataggggagaaggagggttgccatcgcctttgaatcacccacgctgtgtgacacggaaaccatgttcctatgccatttcttcttcttaaacttagtttgatcactttaagaattcatttcacgaaatcacgtacttgggtttgtgcagattatgaattatcacagaatcacacttccttcaattccctttgtcacctagtaataattacttattggactgaccctaccagtcagcagtcctaatgcatcttcctcaataatcatctctattgactgtacttgccacgcaagcacgtggtaagctgccacacctccattttgttcagctacatgttctttctacaagcagcaattaacgaatagtgatggcgatgagaggaagttaatggtagcatatgatggagaggaagacatagtaatactggacaaaagaaagagcacgtatgtatttattatgaacgcattctcaatagcggcagaaagatggaagtgcatattgtatgatcgaaaataaaaaccaagccaattagagtggggtgaatggttggaacataaaaaccaaaacttttagcagaaataaaagttactctcaaactggattaaaccgcacttgttataccgctggatcaatgccggtctgaccgccgccggttcgactgcctccttgccgccggtgtgaccacccaccgattagactgcacaatgaacttcggtcaaaccgtcggatctagaaaaacatgtatcaatgaagctcttgaaaatagatcaactttattatatcaatatgttttacaaagtgcatctaatgcattactctctcaactcccgaactagtattgaaacctcgaagcaaatcgtaacttttctcccccaaaatatctatctcttttagcctcgacccctcttctattttccataacgtggctacccctagccatgaatccaactagaactaggactcctaatcacataggaaacttaccaaaccaaagaaacaacatccccatgcaactccacactctaatcttttcaaacttggggcttcaatccaaatttgactcatctttctataagcacataacataacgtatatgccatatgaaaaccttcacctccacaagcattgttatctagcgtgagcatcccgcatgatattttgaccgtatgggcctcaacttctccgaagcctaatcccgatcgatcaccggctatactcctatggcttcaagcaacacttgcacataaacaacaaagaaacttcatatccaaatataagtttgcactaacttgactcacatcagcacagaatagtatcacatatgaatagaaaccatctagaaattccatgaaaataacccaaaactgactcccttccggagattgtcggtctgaccgtcgggctacccagtcagaccgccccaacaacaccggtctgaccaagcggcacccgcccggtcggaccggctacccaatgtcgactacactacgcaccgagcgaaaacactacttaccttggacaatttgttcatcacatagattaaatcaacaccttgatttcacacatatactagtcgtgtgtacatatgtgtatttcacataattgtaaaaacatagtgtagttttgtgatacatttgttacatcagaaatgatagttaaacacaaggacgtcatgtccttgaagggatgaaggtattgaatttcttcatatttctcatgaaaaatattaggtcttgtgatgaaaataacacaattgccaatgactatataacaaaaaagtagattttgagttatcttcgtaaactagttgggcatacgatggcttggtatataccaagagcacactagttggtatatatgcattttgtgtgtgtgtgtgtgtgtgtctgtctagttggtatatatgcattgtgtgtgtgtgtgtgtgtttgtttgtttgtttgtgtgtgtgtaggtacttctttatctacacacctatagttgacgtaacatataagtgt

SEQ ID NO: 64533 - DNA, 9555 bp, Oryza sativa
tatggattggtttaggttggtttttttaagtagtagtaagccagagggctgctgatatttatcaataactgaaggagttaacaaaaacgaaagggcaataagataaacaaaaagatagaggtgttgtaggactcacaactacttcctccgtttcacaatgttagactttctagcattgcccacattcatttagatattaatgaatctagacatatgtgtgtgtttagattcattaatatctatatgtatgtggacaatgctagaaagtcttacattgtgaaacaggggactatctatcaggttttcaagcaatgaatacttgcttattaaattttatactttgaccatttcttcttgcattagttttgtgcagcgtcataaatataaccatataacttttattcatgaaaatctaattaatcattcaaaggtaacttacggtcatataagatgacaataataattaaccgtgttaattatttgagaacagagggagtaggaattggatgattttactatgtttgagtgtactccctctgtcctaaaattaaccaaaatcgtactaggagtacaacgagattggtctattttgagacggagggagtagatggtaaactaagagctcggctccctgccggcacaacggaagctggctgaaggccaggccccagctgagcattattgagccagtaaaactattgtacaaaggcgtttcggatggcaatatatccctcagggcagtgaagcagcatgtggccacaactcgatcgtgacaaatcaacagagatgttcgtgctttcagataacactagatggggctttgccgcgtcgaagtattgatgggctagtccaaatagcttcatcgcttagaatcttctttttttaaaactcttagagtcagttttgaaatgccttatgggagcagtaagctacaaaggggatggccattgactaccggtggcactatctcaattcaactagttgataccccacgtgttgctgcaggatagctatatcgtgaatttggaagatgtaattctagaacttttgactattggtatagtatcattacacagaagggaacatatagttgtaaatttatcaaaattgcatgatcaaaatggttgaacgttcgatctttacattgtattgctatatgaatagaaatggcatgattccaattaagatactcccaattcgaagaaccatgaacggtaagcaaacgggacactatttttatgatgtagtaaattgacttaacatctcatttagatattttaaacaactaataaaatatttctttttgagagaaaacaaagagaaaatatggataatgctgcatgcatatgttggtatatgatcttaaaaaacaacaactattgggtgcatgaatctagtaatttcaagaaaaatgttcacctataagtaaatgggaggaactgtggagaacaaatttagtgattgtcggtatgaaaagcacaaagatatggcatagccttttaatcaaatgtagagagtcaaatgtgagagtggaccaatccctcaatacttaaagttataaaaaattgaagttaccatagttgtgatacattggcatatgaagcttggtgataaccgaaaaaaaatcagatataaaaagaagcaagatcatgatagagtaccaaaaatcaatcaccataggagataaacattcttgcaattggtaaaggtcatcgagtgttgtaatctgtaccaacaaattttcgatgtcatctatgacagtgacaagccaaatttcattggacaattgacatttcctccttagatgattgaggaagcacgttcaagcataaatattccaagaaaatccattggatcaacctagatatggctagtagatgcattagaaaaattaaagggaatgagaaagaggtagacacaaatgtagtggtgtgggctttcgggtgggagatgtattagtggttagtgataaagggagatgtaatgatgcatgaggtaattaagaggaagacaaaaggcattgttcctctcagatgccatcggatgagaagaacttgatctaacggttgatttgcatagacgcaagatgatctaatggtcaatataatcttgatgatgcggcctcacagaatttgagctttatagcataaatgacttgtagtgggtaccaactatataggaagaaatgataggtgacgtcaacgcaacatgtacaaaagttgatgatcaattgattcatgttagtacatacattattcctttttctcagccattgtgattttagttgagtgcaaatcagtacataaactatgttgcaaaacaaaagtgccatgctacgaaactcaacaggcaattaaaataatctaactatctggttctcgggcagtgagcagatattagcacgttatcactgtccagagagcttcaagatgatgcgttcttcctagctacgtaaaaacaaagtaaacttacgggcggttcagattgatgccattttcaaccataccattttttttggtaaagttatcaaaaatgtgtctatgtttagtttgttaccaaattttagtaaatacataagaaatcatgcaaaaattttgtcaatattatctacgtgcaaaaattttggccaaccccaaaatttggtaaggtttatttcggctacaatcttaacaagcccttattcttgtaggagcatactgctatatatttggctctatgattgagtagaaatgatattgtttttgacaaatcaccatatatatcttatatgcaggttcttttcagagcaacatattagctccaatcctaggtacaactataaaagtgtgatgaagactacaagcttttgaagtctgcatgtcgtaatcttgagacgacagttatgtagctttttgtcaactttggattgagattcacaaatagaattcaataattgtgtgctctttatcttggcgtttatgagtttgtgttcgctttatgtttggaagagtttttttaagttctctttgagttgcactcgttttaagtgatttcatgtaataattggctgtaactcgtttgagcagaggccgggatggatttctattccattatctaaaaaagttacgtaaatctggtaagcaacaatgttccacaactgcaacggcagctgtaactgcaaattattggtacactatttgcctccaactgtcagtcatacacaaaatcataaatagcttacttctcatagatttttttgtcttactaaacctgtgctcttactgtattctgtagtaattggcatgatggatttgtacaagagacaaaggcaaatacaaaaacacactttagagcagaagagtgacactaacttacctgagacaacgatgaggggaacggttcagaagttgacggtattgcctatatgctttaccatcttcagtctctcctgttcagaagtccatttatatgaatgttatatgacatggttgatattaagtgttttaccattaggcagcataaacaaccatgaccttgtgcataaatatatctctggcatggcgtgccaaaaattggcaaatgattctcagagttaaataaaatgtcaaaaaattcacaatgaatgaatattgtatttcaagcttagtctagatataaaatctatttttgatcttttaacctgaacaaagatatcaagttgcagaacagaactattacaacattcatgctatcattatgcttcaggaatctggactgattattgtaacaccaagcaaatcaaaatactcaattacctgcaatcatagtagcatatgtttttgcacaccataaaccaagctctagtcaagtcacaactaataacatctttttgttgtactgtatagacattgttcatatggtcattctccgggatttaaaactgtacgttatgtataatattatctcatatgtacacatcttgatctatcaaaaccttaaagttgagaattggatatcagactcaattttcgttgttccaggacataacagtacaatatatgtatacagtaaaattatttagaaaatgacaagccttctaaaaagaaaattatgactgcgcagcatggcagacgatataaatatgttaatgcagcatgacagacaatgacatggaaagtttgtgtgcttgactactatgaatcagagtgtgtcaaatgacttgaagcaacaaaattcagatgcttttatactaattgggcaatgaagggtaacattttgatcacggtggctgatatattccaatgttgtctgtaacaagtataatttgtctacagcttgcttcataacgggatgaccatcaacacaattctctaagtgataaaaattctgcattcttattttgggaacaatttttactgattttccatctcaacgctgactcagaaattcagcattgaaccttgaattgtttggtggttaaccaatccactggtaacaattatcaaaatccaaggtaactgaaacataacaagatcggcgaccccaacaccaaatatgtgaaagaagtgaccatagtcaataaatgaattgtcaatggtgttatgcagaagcctggcagagaggaccgttgcattcgccccaatcttcgctagcagcatggctgtctctacacaatgttccaactatttatcgccacttgactgggtctaatcacagaaacatataacaaacataacaagatttagtgactcatacagaaacagttcaactgttgtagaaccaatagctaaagatttgagctcgtggaatgagtatgacctgaccagggtgaaccttctcggacttgaagaaggccttcacgatgagctcctcgtcggaagatgcggtgtcaagcctaggcactggcaaagaagacgagaaggaggggcgggttggaggagccattgaagcccgggtcgtcggcaaggactcctccaaggatggcgggcggcggggacgtgaggccggggctatgtgtgaccggccgagggatcgagaacggttttggggggtgagtgtaacttttttcttataatagaaaagatgcccgtgcgttgtaacgggtaaagactctttttcagtgatatattaagagctaagtaataaattgaaatattgggatcactatacactataattgaaacagttaataaaaatcttaacattgggatcgctatagattataattaaaaaaagttaatgaaaatatttcctgggtttttggccaaaagccttcctcctaggctagcccgctaccttcctccatttggtctgcttctcttcgaccctaccatctttaacttcccgaatatgactaccatcttcaacctcccgaagataatcccgtgcccgtacgtttgccagagcaaatctcccccatcaaatccggccaaatctttcttgggtaaccaaaattgttcgagggtttttgatccactcgatctactctttccgttttccccaaaatcagagcgtaaaactcgggataaaaatgaccggggaagatcactgtcatcatcggcaactgcagaatagatattaaatccagcaattaaagctgaatcgaagggtaaatcattgagaaaatgatgagagaggagtggggaatcgatttttacaatcaaattggaggagaaaacacacgatcgatatggcggcggcgcggcactaggattcacctcaggaggtgtgcggcgaacagatgggattataaaatcggatgagacaaacaaaaagcgcatgggagaaaaaaccggcgataaaaaagattgacgaaaaaaactaaaagcacccgagagagacgcggtgaatagatcggattaaaaaaaaggtaaaaaaccaaaagccttagcgtgggtgcataaaaaactcttatgcgtgaaaaaaaaagaaaaaaataccggtgccaaaaaaaccaagtggattttttttaactgggaggattttttttctttttctatagaagtagaacaagagatgtttttttttactgactacgacggaagctttttttttttaatagctcgttaactgatgtttgaaacgcatgcgtccaaatgcgaaacggaaagggacgacgtaccaaaatcccatggcaaaaacaagttaaacttttataatagtagaagataaacccttgtaactttgcatattacaatgatatccatagcagcgatctctcaccgtagatctgtgatcgtacggctgccggagggggagaaagctgtgccatgtggcagggctttttgcacccgaatccttccagaattcggtattagagattccactatacatgtttttttttatttttaaaccttttgaatttttaattttaaaacaaacctttctaagaacttatttccaagatctaaatcttttaaattctatacggtctaacatgataaaactgtgatgccagctgtggatgatgtgcagttttgtattaccacgttaggcgggctggtataaccaaaagattcatatataaaaataagtttgggagtattcatttttaaaaaaattaaaaaggtcaaaaagtaaaatctccaacacagaccagatataaaactttagcatgccagtctgaccggaaaaaaattctatggcaccgggtgccacctagcaagtatggcacccctgttggatttaagacacgtggctatacgaatctcgaaaccgtccctctcgtcttcttcccctaccgtgaaatctatgaatctaccatacaacgatgaagtgagttataccttgtctcttcttccatgaagaattatcaggactttcatttgcaccaaattaaatcaccttacacatgcgagaagtgaattatctgaactttctttttacaccgttacttgattaatcggagattaaatgacttgttggatgtagtatattaagttcggttgattaaactaattacctagcgttttggttccatgtattttcatagttcattggaagtaatggaggaacaattaatctgttttggatgaacaaggccggctgatggactactactactagtatcgcctgtgttgtaggacgagagcaacgcgtaccctcgattctgtgccggtggattagatcattaattaattagataggaagaagagacggaggagcggttccatgcggggaaattaggagaagcgtttcgaagcctgattccttgccggtgattagaggaagggaaggtagaagatgaagttgtaccgagatttgtgcgcggccacgtgtcttgaatccaacagggatgccatagtgagttactctaaggaattctttttttaagcaacgcttgcacagtacacatgacacactcgcacaacctggagtgtgcgacacatgctcaagaaagagagccaacaataaacttgtgaacatctccaggaggccagtttgataagccaaactcattacttactctaacagtttcttcatccgcacttttcattctgactctacgacactaagacctatatgtcaccctctaccacccttcttcctcctctttcccattattctttctcttttctctctctcttttcaccccgatggcggatggtgacagcaacagcagatggctaggtggccggcagggatcctggtggccattgactccctcgatctcgcccaaaggcagcgcaaggaggagccagcggagggggctgaggacctcgtcgtaggatctccgagcaatggggacagacgaggcgagcactggaggcaacgcagacgacgattgcgacggatggcggtgcagaccacgatgacgatggcagccgcagcagtggctgcgtggatggcgggccagacggacttcagcgaggacaacagccgcaacagtggctgcgtggatggtgggctcaatgataaccgcagcgggcgagacgaccacgagaggcaacacaaacgacagttgcgtggatggcgggctcgaggaggcggcagctatagggcgaccatgaacgcctcgtacgagcagagaggggagggaaaggaggagggtgtgaaggtgggatccactagataacaaaccggtttagctagccagatttggcttgcgcgtacccatgtttggttagctgcatggtaagactgttggagtgcattttttttatcaaacttgtcaaattttagcttggtgagccattcggtaactctgttgaagatgctttcactagccttgtttacatattaagcattatcttgttgtaagttgctcacctgggtaaggccattaatcactgatatttcttatggatcttctttataaaaaaaaaagaggaaaagacgatggttgttggagcaatgcagaacaattcaatccaagaagaatcttcctctcattatctgaaaaaaaaggaccagtcttaaacgggccggtggatgatcgaccctacaagaaaatttctcaatccattcctatatggaaaaagtacattcggtccctcaacttgtcgtcgagttacaaatcgtcctctaaccgttcgcttttgatcctaaggtggttttaactctggttttatccaacgtgacggctgagtcagcatgggccctacttgtcaggtgcccacgtcatcaccctctctctcccttcctcctctcactctgctccggccccagcccttgacccgtcgctgcacccgggggtccgtgtccggcaggtccacagcgtggcccctgtcccgcggcggcaccttcaccgcccgcgtcggcccggccaatgtcgacgccggcgcagcctccgccgctgtcaccaccacgacggccgccgccacggcgaacagcaacagcagtgaaaccctcctccgtattgcaatgtggcgggagatcgattggcgggtagtactatgaggaatcagtgcgagtttggagggaaatttataggagccgaattgggacaagatgggtggcggccggcgtgtccgctctgctcaccatcgcctgtttggaatgagaaagttgatgcagatatgtaaatatgtttagaattctttttgcaggtggatgaattcatctcgatttatgcgaaattcactaaatatcctcctgttttcagaaataaaagaatggattcagcagagatcacagacgaagacagttgcaatttttgtcgtgtctgaaatggataatgtcgttccctcgaggaggacgtggtcgctcaacaccttgtagcacgcggcgaggacgcgctccgtcacctcggtgcacacctcgatgccgtgctcaccgtcgacgaggatctccggcccgacgatggggaccagcccgttctcctggcagatgatggtgtaccgcgcgacgccctgcgcgttggtgttggcgagctgcgacggcttggacgccggctgcggcgagcacggcgacgaagggcgtcccgtcgcgacgaggacgagctggggagaagagcggcggcggccacctccgcgctctcccgcgcgtggcggcaccgctgggagtcgctcccctccgtcgacctgacccacagccgaggcgtcgcggcgtccgacgtcgacgcggtcctcctccggcgctccgtccccgtctgcacct

SEQ ID NO: 64534 - DNA, 5388 bp, Oryza sativa
  unsure (1)..(5388): unsure at all n locations
cctccccccccccccccccgccggcgtgcggaaagaggcgaagaagaaggccgccacggtggcggcaacgaggatgcggatagcggcgttgcctccgccagcgcgacgccggccgccggacctcctcctctcccctcccccacggcagttctccccacccatcggccgccctgctgaagagcaccgtgagagaaaaaggatgaagaaaaggaggggaaatacgagagaggtgaacatatgggattcacgtgggttccatgctaactcagccgccacgtgaaacaaatccggagtcgaaaccaccgaagggcgtaaaatgaacggttttgttaagttgagagatgtcatatatctagttttgtggttagggacgattttgtaactcgatgacaagttgagggaccttcggtgtactttttccttcctatattaagatggcctagtaggcagtgatcttggaccaataaattttcttcataggtaaagacatcttgataagaggcctaatatacagtggtctatgggccaaacaatgcctagcaacctgcaactagacctccaccttgtctgttttaatggatcattctaatacttcacacttcacagtttacatcnnncgtnnttnnnnnnnncnnngncccccccccccacccccccccctacatatggagtaacttgagaaatgtttatattgttttgttacaccagactgtaaaatctatttgttgaagtccaaaatatacaaccagtgtgaattcaggttggactgggccaaaggtatgggcttcatttgtgttatacattggcaaatatcacttcgaaataacagctataacaattttgattatgtgagttaacatgagggctcctttatagcattaactctcccaactagctaagggaaggatttaaacttttaccactctaatttataaggtttaagaatatatactatactatagtaacaaagtatgttgcatgttaaattgcaaccgtacatcttatcaaagtctgataatttaacagttactataagtgagtaaagttaaaacagtattagttattcccaacatgaacaagtatctgagaacaaattaaaagagatggtgcctacaagataatagtatctgatgtatgatggcagtaagcattccgaccatggtatatgacggcaaactaaacacgagacgagaccgagagaattaattttgtagttcaaccaaatgatcaagtcaaatccatttcctgatgttttgtgataccgtccacatcttaccttcaaatattgatatatgtcttgttacacatctcagtgaaatgacacgattgtacttggtcagcactgttaggctgccaagcatgtgccttgttcaaggaagtatctgtcaggccagcaacctccagccatgtcctctaatgcgcatctatctgaaattcttgtgcaatcgtgtcaacaattctcatgcaacctggttggcgccacatcgattttcttccctgcatgtgtagttctgtaaacatgaataagcctaaggccctattcttttctgattttggatttttcattttctttttcatgttttaaagctttaaaacggtacattttcatgtaaaaattttctatatattatttaaaataattcctaaatcaagtctcagctttatagtatttaatttattcgtttatattctcaaataactaaaagaaataagattatccatcaactttagctatatcaaacgaagcattagtagaagaaaagttcagttttatactagttcggagaaagcgtgcactttgacaccataacctttttgcattaataagaacaacaaatccaaccaaataggagtaattcacacaagcttgaaaaattaacagtttaatttcaaatgattaccaccaaacctcgcaaaactaaacatcaatgtgacttgcaagttgcaaataatcatactccatgtgcttgtcccactattgagacaattgtgagttggtgacctagcagggacaagagcataaatatagctaattagccacacaaacaagatggatgacatcgatagcaatacacgagattaaacaaccatttccacaacttggaagtaattaagaaccaattgtactcatcagcttcttcccttgacaggccaagaattcttccagaaagccttagttgaagcagtagtagggaactggtatctcaactggtcagcttcaaagtcaactgccggtgagtggcctatgaaatggccaaacctttagaaaaccgaaaagagtgctccatttcattgaacagtctgcatggaagaagaagattaagaatattctgcactttcagttgttcagtctttcagacaccgtgtgtaaaacgtcatgacacaaatgggagaagcttcagaaaccattgaggtccatgtcaactacccagtggagcagaatagacgctctccataggcacaaacataagtgacaattgacataacattggttccaatcactaaaacacatggtttccagggaaaatatctggcagaaaactggtacttaaaacaaatagtcagtggtgtctaaatagaccagacattatctgtaagctatagttccagccttcaagggaactgcctgagaactgtgatacaagttgcccattttctggtttggacaaacattgtataccacacaaagagagaaacaagcattccgttattagctttaggtaagtaatgaatgatcagtggcattggtgaggaacaactaaactcatctcccaactagaaaccaaaacacaggtcccaaaggaaacaaacttgtcacaagtatgcacacaaaaaaacaagcagaagaatcaaacctaatatttggggtgaaaagaatacatttatttgatatgtaccagtaagacataggtgacaccagggatgcaagtattccacatatcaccacccagggatattcagcagatgagaatgtaaaaaagaattggcacccccaggtgttattccttgaataaaagctcatgtaatgtagtccacttatgcacttcaaacagacaataataacttcattgtttgtattatgcttatgtacaagaaatacatattctccatgcaatccagcaccctatcaaatcagcaagaacataagaaagtatccgcatttagaagagacgaaatgaagaattaatttccatcccagtatggtgacatcttgaatgagtggaggaggaatatcccctgtacatgaaaatcacaaatcacacacataatataaacagagcatcacgttcttctgctacatggcttggttttatcatacttaataatcaatttaaaaacagatgcaagtgactttgacttaagaaattgatgcatcagtgcccctcttcaaactaattttttctctcaaatacacagcagatctgtgtatcattatattaagaagaagaattaatgggtaggaaaaccctcgcgtacataaccatccacacagtcgctaagctcttgggttacatgtgcgcctatgataaaaagaaaaacaactatgaccacaaacatagccacaacttcaaactaaagttttcatcccagatgtcatactttgattgattgctaacaataattgtttcttcttccttgaattgaagtaatgatttttgttcagaccttgaaacaaacatgggaagctaagataaacatgaatcaaattgcaggttttccatatcttgtttccaaagaaaaaggctacctaaaataagattgcgctgtgctattgcatccatccctgctattaaaagcaagaataaataattaagtatcctgccaacataaactggaatttctataaacaagccgatcaggaagaacagcatgttaccatcccaaaagacaaaaacatcggtcgcaacgaacaacataaattaatgtaacatacaaacatgaaagaatgaagaagctaatggagcaaccaaagcatccaattctcatgactcataacaactcacacgcggccgcctccggaacatggaaacagacaagctccttgacataaaagcacccatccgtgctttccaccccgatggcctgccgctgctgccacaggaaaggtcagggccccctatccgatcatccaaatcgtccggcagggtgtcgctaccagcattctccaggacaccactctcatccacgctcctagcatcctgcaattcaccagcaccacctggcgtgtcaacattcacagcaagggctccgttgcggctagcccgaagccgctcagcacactctggcgtcactccctgacacttcttcaccttcaccttgacaagacgtgggcagccttgagcgagcttatccattcctgcatcagaaacagggcatgccttgatgcagagcttccgcaacgcagcacatttcgtcgcgacgcaagatatctcggcatccccgaacgtatcagacccgcacagtgcgaggcgctcaagggcagggcagttggcagcaatcagttcgagactggcggacgtcaaattcaccccgatgagaaccagttcttgcaaagcagcgcatttctgtgcaacagccgctaggccgcggtcaccaatcctgtttgctttccatccatcgacgtgcagcttgcgtaggcgtggcgatctggtggcgagcttacccaacccaacatctgtaacctctggcgccttggcgaggtagaggacctcgaggcccgacaaggcagagacaccgcggtcgctgacctgcagcttctcgagatggagctcggccagcatggcgtcctgagggaggtcctgaagcacgggatcccagtcgccggagcagcggatgatcttgagcgttttgaggttgggcgagttggtgatgagagaggagaagcactggccattgtagagctccttgaggcagagggaatggaggcagaggctggagacggcgacgggctcggattgggcgaggccgcggaggcgcttgatggagagctcctcgagatggaggcaggagcggaggacggcctcgatccccttggcgccaaaggtgcacgagccgacggagagcttgcgtaggttggtggcggcggcggcgagcgcggcgacgccgtcgtcggtgacgagacggatggagcggagcttgaggcggcggagggcggggccgaggcggtcggcgaggagggcgagcgtggggtcggcgacgctctcagcgcggcggtcgcacttgagggcgagcttggagacggcggggaagcgggcgaggatccccgggagggcggcgtggagcggcgcccgcgcgtcgagggcgaggcggaggcgcgaggcggcgtcgacggagagccagcggcggcagacgagggagcagcgcttgcggtcggcggagccgaggagg

SEQ ID NO: 64535 - DNA, 7060 bp, Oryza sativa
ggttgggtgaggggggaatgggggggcgccgcggacgtgaggacgagggcaacccaaacattaaatcggcttaactcctccctctctctctagactctctcagtttctctctcctttcggggggcgcacgcgttttttcttttatttttctcttctccatccctcctttcgatgctattcaacgcatgcccgctagttatcccaaccagtggactgaccaagacctgcatcttgttttaagggtacttcctccgttcaattcacaacatatgtcccgtaaagcttatcattttcgtttgggagggccatttcttatttggttaattggatcctgttgaagaaaaatctgcgtccgatcaatggtaccaagcctgcgttgatgcgaaccatatcgacgaacacacaaagttctaggagatctgcttaatttcagtgcaagtcctaaacttgataagatgcgagcgtgccaatcgatttgatcctactactgacaaagatatgtaaacaaccgatcggctgacaagccgatagagagacaacaaccaatgccgatggggttttgagcaaatgattgtatgtccaatgtagagtctgaaacatgaatgataatgtaaaataacaataatataatttagtagaaaccaattggccaataatgatatgatagaataagcgccgatccgcggttaaagtatacatcggctgaaggtccgatgtcgttaaatccaaacgattagataaacagtaaaatctttgttgcgatcggcttgcatataatccttataagtcgatgcaacatccagataactcatcagctgaaactctgatgaaacccttattggcaatcaaaaacaggctagagattatggatctaagcacgacttagtaggtcaaacccaattcatgcagtagtaagtatgaaaagaaacataatatctagaccctaagcctttgactgattttcagggtggtcgatgaaatgatttaactactatcaacaaaaccctagagaagatccggccgatacaggcaaactgaaacatcgactcaaattaattaagatatataataaataagtgtttaaatcgacaagattagagtgtcgataccttagccctaccgatggaaatagccataacaagtgttacccctcatcggatattgaagccgatgcagcccaactcgaaacaataactcatcgagaaagacgaaaataaaaagggtggtgatgtgtcgaagctgtattgatcgacagatagattatagtgaccctggatgtacatatttatactcatgggtatatagtagtccttatcggacacgacacatatttcctaaagatgaaaggaaagatacaagtcctgatcggacactaaataaacaattcctaaagataaaaggaaactaactgactatgcctaattaatagataaatttaagctgccattttgtggtcttcatgactccctctcgaactcggtctcttctgaataagttttccttaactgaatccactaaaaattaccaaattttggtgttaacacatacctcccaggtattttggagtatgggaactcatgcttcaaaaatctcttctgccttgccttgattacttcaaaattgatcctttgttgcttcttgtcttggctctcataaaccaatactgtctgcattagatgaaccagactgtcaaactcatggcgaaagaatttgtcattgataagtgctgacaatccttgaaatgcaagatctgctaactgctcatcacttagacttaaactacaacatcggctgcgaacattacaaaatctttgaatatattacatagtcgattctccctcttgctgctcaaccgatattaagtctaaggggatgtttggttcatggccacactttaccacaccacacttttggctgccattgtttgttaggcatgtgtttgattcactgccacagttatggctggccacacttttttcaatagcatgtctcacatgtcatatactcatttttttgccacatttgccacactttatggctaccaatttgtccaccacacttttgtgattgccacaacttgcctaacgttagttgtggcaaagtgtggccggcaaccaaacacaccctaaaagcttcatctcattgattctagcaaaaaaaaattcatggaattgcttttcaagatcggcccatcctctaaccgaatttgatggtaatgatgaaaaccatataaaagccgatccagtcagagacaatggaaaaaaaatctaactttcagaacctcttcagccgatgtttctccacattgtgctaagaatcggctgatatgttccaatttaggcatatcatcttgccatgaaaacttggagaaatctggaaccttgtcaaaccactcaggatatgacagccgatacacaaaaatttgctactttgacttaagtccaaactgctactatactaactttgcaattctattggccaaatcattgttatattaatactctttattaatgaaattcttctggccgatattgaaatgactcatcatgctgatattgattttcttgtccctcgtgctgattctgttgttgccgatgattatgaagatgctcatcgatttgcaccccaagttaaattctttgagaaattaattcatcaaatttttccttgatcaaattctacaatgtattcatcaaaactcttgattgatcagaaaatgcacgatgaactgcttcatcaattgtatcttgacgtgtttcaaccaacggcttgggaaactgaaccttcttggcattgacttcctcttcagacatgttggtacaaaatgtgtgtcccgttagacgtgccaaaagggtgttaacgaaaaatccatgtccggcagattgtaccaactctgcgttgacgcgaaccgtgtcaatgaacatacgaaggcctgggagatctgcttaactctagtgaaggttctaaaattaatgagatgtggcgtgccagtcagtttgatcctgcacctgacaagatatgtaagcaacagatcaaacaatcgatcagttgagaagccaatatagcgatactagtagatgtagcccaactcgaaacaagaactcatcgagaaagacgaaaataaaaagggtggcaatgcgccgaagttctattgattgagagatagattatagggaccccggatatacatatttatacccatgggtagatagtagtccatatcggacaccacatatttcccaaagataaaaggaaagatacaagtcctgatcggacactaaataaacacttcctaaagataaaaggaaactaactgactctgcctaatttatagataaattcaagctgccatgttgtggtcttcatgatttcctctcgaactcggtctcttctggataagctttctgttggctaattgtgctctttccttaaccgaacccactaaagaatcttaccaaattttggtgttaacacatatccccttattttggagtatgagaattcatgcttcaaaattctcttctgtcttgccttcattacttcaaaattgatcatccgttgcttcttgccatcagctctcacaagacgatactatctacattagatgaactagactatcaaactcaggaaggaagaatttgtccttggtaggtgctgacaatccttgaaatgaaagatccgctagaatggctttcgttctttcataacttgacattttttacattacatcaagatatgataatgaaattataatgttgtgaattcgtttttaaatatctagctagagaacaaataaggatataattctcatgtaaaagtctagatagtttcttttctggcgagaaaagtatcctcccttcctttcataacatctggcaattttgactaacacttgctctagtttgaccactaacatcatttaaaatcatttgattatgaagaatgagatttatatgttcatatttacagtgtatcaaacttcaattacatgatatatcttttaaaatacctatgagtttatttctaaaataggagcggtaaactaaaattaggcaaattttttgaaaggaaaaaataaggcaaattcaaaattgccaagtactatgtgtcgacgggggatacccacagactggataaatggggtactggggtacgttggtacacggatctacacgatacgacatctaaacagacaagagataaggattatactggttcaggcccctcgtaaggtaatacccttaatctagtttatatggaatagatatggaagaccatggaatacaaagggaaccaatgaatccgacaataccggcgagatccttgtcgagattggtcgacgagatctcccggcggcttcggcttgaatccttcggcttcgtaaactatggcgagtgtgttggtgctatgattcgatgatcctaaacccctccaggggtacgtcttttataccgtgagttgccttagtctcccagtgaaactcggagacaacgaaccctatacgatatagaatagtcccattcctctccgagtgggactctaataatctccagcccgtgaggatattttccatgttatctcgtatatttccttattgcatacgaaaacatatcgcaagatatgaggtatgccaatctggtatatttggaaaatcgtaggataggaggtatgccttatccgtaaccctgacactatgaaaatggccttgtcgccatggctgcaaagttttgaacatattatcggttgaattcgttgtatgacattgaacaataaacaatttgggcaacaccagctttgctttgtggctcacatgtaatggttgtggaatcctttcctgtatggatgctggccccccaaactataagggtcaattggatccttatcactgcaactttacccaattaaaaaaataccactactattcacgatatcggctgggtgccatcagtattttgtaaaaatttaaccatgccattatatacgtctcgaatgaagttggaaatggtttttgcattttcgtacagaccaaaatgcctccagctcttaaagtctcgtattttcgtacaaaccaaaatgcctccagctcttagagtctgacaagtgggacccaccttgtcatacacatcttttgaattcttaatttggttgttgcagcaagaagcggtgacagcaagcagcggcgatgggatggagcaagcggagcaatggcagtggagcaggcagcaatgtcagccatggagcgagcagtaagttgcgtcaatggcataggaagcgacaacagtggtggtggccagtggggaggcggcggatccggtgatgattcaagctagcgaatttggtggcgacaataggtctggccgtggactgaaggaagcacatccagtggcggcggcgaggcagtggagagctcgtgctgcagtggcaggtctagcaacaacacgagcagatccattgacggcggcgggtccggcagcagctcggcatggtgtggccactactggagaactggtctttatccagatggcaaaaatcacattagtcctagttcgaatagtaaccgggactaaaaaaatatttttaatcccggttcaaaagcccaacggtactttttgatctttagtcctggttggtaacaccattcgggactaaagatcatatatttagtcccggttggtatcatatattcgggactaaatatctctctcccgcgtcattggcatctctagctctctctctcttccttatctcggcatcggcagctgcgtcttatcccctcctcctcctcctcccctattcacgccttcttttccacctccactcctcctccccctcccctctcctccgatcccatcctccccttcccctctccttctccctctccctctcccatgtccatggcgcgcggcggcgataccctctcctctgctggatccggcgggaggggaggcgacaggcgcacggcaggtggaggcggcgcatgaggcggtgggcggctacctcccctccactagatctggtgggaggggaggcggcgggatgggaggccgggcggcggcccaacggaagcagcggcggtggcacccgggcggcatgctcctcctctccccgatctgtcggttatggctgatttgtttttagattttgttatagatttttttagatttgggaatgatttgtggattgtggttgattttgtggatggtggatgattttgtagatgggcatgtgatttgtggatgattttctgggtaggccagtgaattgtggatgatttttttgtggataatttgtggggatttgaggatctggcgttggtgatttcagctcggaatcaatagatgcaagtagcaaaaaaaaaacaatggaaaaaaagaaaaaacctttagtcccggttggtgttgggactaaagatggtagcgccagcacgtggtaccaaccgggactaaagatccatcttcagtcctagattcggggtcccggtttgcaacctgtgactaaagggggttgcaaatcaggactaaagattacttctctagcagtgggcaagagcaggcctgacggcggtgagccccatccccatccttatcgacaacgatgatagcagcgtatggccgcggcgagcttgttgatgcagtggcgggtttggcagcagtgcaagcagtcctagtggtggcggtcgcggtgagcaaatccaagggtgcggtgggtttggcaccgcttcgctgtgacgcggtgccaataggcccaatggcaacgttggcggtgaactccatcaccatcattctcaaagatgatgacaacaacacgaccaagactaataacaagtttaatagtatagccaaatattagctccaaatcatctattagctaatataatagctcattcatacaatagttaactataaaaatatactacaacattaatacccgatcccacatctcatacacacataacgtcttaaagtccgtgttgcagttggctacaaatatgtagcccactttcttctctctcttctcttttcttctcgatatgggattatagctgggggctgcaggaatt

SEQ ID NO: 64536 - DNA, 9416 bp, Oryza sativa
taggaagggttagagaagaagatgcgtatgacaaagtgggttccacttgtcagcctctaagggttgggagcatttttgtatagatgaaaatacagcacgtaaaaacctaatccaattgtgttcaagacgtatattgtcatggtttaaatttaacaaagtaccgatgacacccaacggatatcgcgaataatattggtattttttcaattgaggaaatttgcaatggcatagattcaattaaccattgtaatgttgcatttatgggtatcttccaaataattagtaattacccaatgaaagaggcacgatatatatatgaggtacacagcataatacactagcaaaattataaaaatagatgtcatgttcgtggtagacttggattactaagtcatagtagacttgaattatcaagtcggactgcatttatagctttcacttgcattattattaagtttgctgccaattagggccaaggttttgatgggcaggtcaccaaaattgaagttccaagaataaccgaataagcatatttcaaaagagaacattcttttcaatacccaacaaacaaaaaaaggtaaagcaaaagcatagaaaaagtagagcatacaccatccccatgatgagcaattcagcttcaaaaggtgggaatggtagagactagaggagagcagtggaggggctaaacgttgaccactagactgaagaagacaccgtcattaggtagccgctaattcactttcggtgtcagtgatgtaacgaattagtggccgaaatcagcatcacattatagacaacaacaaagttgatgccaaattttggaaactacgtccatatttgtaaataaaaataaataaagttgaatggataacatgcatcagatgcatatatggttagtgttggatggacaacatacatcggatacatatatggttggtcaaattgaaccaaattcttgttttgggttgcttgttttcttgtgacctggcccctacgtttatgatggattttcatatgtctaatgtatacgacaagaaatttgagatacgctctgttttggcattttatttgttcatattaattaactgatcatttgctaaactcttgatttcaacaagcaagattttggtgcgtggtttccttcaaaattctagcattcctatcttgatcggcagatcattgaatagacaatttatgcagatttatcctttttaattaggcttcagacacgaatgttatatgcatgttttactgattgagtcctacaaactaagaaatgtgccatacaggtaccagtaaaatttgtgaaatcaatgtcttgattattgtttttatatgaacaatagtcatatgatttgattatattggttttgatgatggtgatttattagatgatgtgattttgctctctataagagggtggccagatcatatagggagaatcattgttaaactgctggtatactagcggtcaggccggccggcccaacgaccaaactggcagactctgtgtcgaagttggttttaggttgattttttgatttacgatgattgcttcatgtttatgacctttagataatttttgtgctaatattgagtcaaggtgataaagaacttgtgcttagatatagttttttggtttgttcatgtgtaaggctgcgttcggtaggacatgttaccaactcctcctccttgttttcgcgcacacacttttcaagctactgaacagtgagtttttttacaaaaattttctataagaaagttgcttaaaaaatcatatcaatccattttttaaaaaatagcaaatacttaattaatcacatgctaatcgttgctccgttttttttgtgccggtgacgcagcctaagtggctcttgaggccttgagagagtattgatgatgacttgtgggaagttgatttccgaatgatcacgagatcatgcggggcatgtgtggtagctagagaacaatgcacgagattctaaaaatttcatatggatacaagagggattgtgtgagtatgaaaagtggattcaaatttaaatggagtccaaatttagtaagattagagtttaaattgtaataggataagatggatatttatatgggtgagtttcctaagggattaggactgcttatccacgttgggttcatagctttgtgcagccacctcaagatatagatagaggagaggtttagtttcttggtatcgattttgagagggaatagtttttgagaaaaattagggttcgatttgagttcaaaagttgagagagtagtgatttagttgcactttacaaacataattagactctataaagttgatctagttttaagtgcatctttaagttatgttttccgggatcttgacggcttgaccgatagtagtattatggtcagaccgttggtggccagacggttagaccggcgatgaaggctcggtcaaactggtggctaaggcaaccagtggcatatcaaaccggcggtagtagagaggcggttagaccagcgacataatgttgatcggactgatggcatttctgacagttagaccggcatagatactccggtcagacagaattttattaggtttgaaggttctttgtattctgaaaaaagatttcggtttttggtgttactatcattcacccccactggtagggtgtggtttttgtgttcgatctacaaaattttagttcataatttacatagattatgaactgaattagtttgttgtatggagagtatattttaaaaatattctgttgaggttgagccgatatatatgattttgcacatatatgccaataaaaggaaattaaggatggcgtctgcttggcttgacaaagacaagcattatgcaaaagcgtcacatatagagatgtatgcatgaacttttgttcaagttacacattaaatgtacagaaatccattttgtaggggtgaaaacggagcggacattatccgatccgatccgctccgaatccgtccgatgtgagaatatggtaagggttattatatccgggcggatgcggatgcagattttatcatgcggatgcgtatgtggatgtggtatgaacgatatctgacggatgcggattatgcgatattttaatcggattatccgatgtactgtttggcggataatccgcaaatctcaggccacacaacaactttcaagcccaactagctagcccaatagcccaacccggcctaacctaatcctctcctcctcccccagatccgctgctcggctgcaggctgctagcgtcgccgccagctgcaggctacaagcgccgccgccgccgctcttcctcgcagtgcaggctgcgtgtagcactactgcgtgctctactgctctatgcttgttgtatgcctatatggcttgcctcatgccgatgacttttatttttacattttaagcaacgcagtgaccagtgaactattaaacagaacacttatattatgtttttgatggatcatggatgtatcttggattattttgactagtgaactattgaactgaacacttatagttatactattactattgaattgaacgcagtgaactaatgatgttttgctattgtattgggcctaattgtattgccgccatcttattgtatggattgaatacaaacttgacatctgataactttttgtccgtttccgaaccgagtccgcaccgagtccgcaccgaatccgatgtccgaaataatccgctccgcatccgcatccgcacgtcatccgcacccgctccgcatccgcttaaaaaatatggtttaggatatggtatagttattatccgtccgaatccgctccgttttcacccctatcattttggtcttgggttggaataggtcttcggacttgggtacaggattcgcaaccgacacctgtcagactaagttcgtttgtgtgagatagagtgagaaagcacctcattttccgcgcgcacgcttcccaaactactaaacggtgcgttttttgtaaatattttctataggaaagttactttaaaaatcatattaatccatttttaaaaatttaaaatagttaatactcaattaatcatgcgctaatgggtcacctcgttttaagtatcttcctaatctcccccatcttcttctcctcaaacacaccctcagtccgcaatgataaaacgctttatatataggacataaagatgctggttgtgatcaagaattgacaggttgttacagagttgtttccgtccgtgtgtcatgtattatcaaacatgcaaaaaaaactattgtgagtccacttataaacataataaatttcatattttttttcttgatatatcattgaatattttcaatttccagaggttaattgttgcagactgtgagtctaaaactctgaagaatcagctgtcctgcaaccaaggcaactgaagacatgaagtaaagcgtagcaaaacaaaaacatcgtactctctccgtttctaaatatttgacgccgtttacttttttttaatatgtttgactgctcgtcttattaaaaaaattaagtaattattaattattttcctatcatttgatttattgttaaatataagtgtatacacactactagaaatcccaacattaacgaccagtagaaaattgtaatcctcgttatcctctgaatacgagtggtgaggagctgattttctaatctgacgaccactgaataactcgtcattaaaatttgctgctacacggtcgttaaaattgacgtgaaggaggcccatgactccacaaaaccaccaccatccatcccaagcaccagcagcccaacccactacacaagccgccgagggtttagggagacctccaatccgtgacggtagccgccgcctgccccaattgcgtcgctggctgcctacctcctgccgcgcctgcactgccggccgtcgcctccagttccacctgcgccatctagccgccaccaccacgtaagtgagcacaagtgaggctgggcgctgcaggggtgcacctcgccgtcgaggggatcagaggccggttggatcttttgatctgcccatgttgacccgatgaccccaacatcatctccacgtcaccatctattctcctcgctagtcgccgccctaattggtatgcttgaaaatctctactgatctgccctgattgatgattgatcaacatcccgaaccctgtatccaaaattagtaacttaatggatagtgtagatatatactgattgctttattttatctacagttactagattattgtctggtagcatcgtaattttttcggagacatcttgctgtactaaaggatttcaagagaatgttttttatgagaactcgagataattgaatagcaatggagaggcagcttgatctggcaagaactgacgggtgcagtactgcacaagacagtaacctcttttttatgcctttctccattcatcaaaattcatgttacatattggacgcaaataatgggagcatcattttgttctcaaattattctattggttatatattttgacagtttcagttcaaatctattttagtaggaaccaagatgaatacactccattggcctgactaaattatagtcaggtagtattccaagttttcattagttcctacaagatcagtcattgatgggcttgattttttgcccgcaaggccacaacaagttggatgcaacacaagagctatttccatatctgtaaagctattgctgacacactatctaaattggtacgagctactgtacattgtgggttaattactccttttatttatttgttagttttcttcaggttaattactccttttatatcattgcaaaatataaatgtagtaaagctctctaaatttacaggaatcatatgaaactagatggtgacaaagcattcctcattccttaaacaaaatttctggtaagttcagtttcttttcggaataagatattcatttatattactactacaaaacataagcaattatttgaacatcaccttttaggtttaaattttaccagtcttcatttatgcaaattattctattgcactttattttctccatggtcatgcaattattctatgaataatatcaaatgtgcacacaacatgtctgcaaatattggctcttctcaacattatatcaaattttttacactgaatggaatggaagtgatgtgtcattagaaagacatcataagagataaactcatgtgccttaatgaattttatgtatgaagtgccatagcttgttaaacagttaatatcatttttgtaagttgtataggatcaatggtgagacatatgagactggtgcatctgaagacaatacctgcgaatgttgatgggatcatcatcgtataacaaaggaatttgtccactgcacctccaagcacatacttatagatcgagtgtttaattttgatagacatcgagatgttggttctgtttgaatgacttaattatttagctggatgcggtgaacaaatttttattatgtattgcaatgaataaatgtggttgattgtctacgattggtcagaacataatgtaaatgttatatccatatggtgataaacatggatgttaattccaagagccggtgcagattgcaattatgtttctctactatcaacaatagtgtaccgtgttgtgtaccatgtggtgattaaaaattggatgttaacggaggtggttaaaaattaacaatggcgcaatactactgtcgtcaaataactaacgatgacacaatatcatggtcgttaattagaattaacgatggcaaaagaacacggtcgttaataagataacgatagcaaaaaaaaagcaccatcgttaatgaaataacgacgggtaaagatcgtttggtcgttaaaactattaacgacggagcctttaacaaccactgacgaccacaaacttagtggtcgttagtgacctttaacgaccacatttggacttttaacgaccaaatctcccatcgttaaaagtcgtttccctagtagtgacatatagttttatatatttaaaaaaattcgaataagacgaaccgtcaaacatgtgctaaaaatttaacggtgtaaaatattttaaaaacggagggagtatatatattcttccctaattcccatatgcagtagtcgtagcgcgtgggagggcctttctcaagtcaaaacttagatccaaagggatgaaaatcgatggatgctgctgcatccggggcggggttgaaagtctctggtagtggtagatatatatatcaaaagaagatgattaaaaagataataaataggtgatccaagtcgttggtcacagatctaccatgcatattcctaacgactgcttcagaccaagtcctaactacaactctgcttgtaatatttgctcagcactgactggactgactctggactagtcctgccactactctttttctgagctccaagtggacagtcagccggcttgatcagtggcatctgccaaatttccatgtatttccaattctacttacctagtagatgatataggatgatgatcgcgtatggtgatatgttgtagcttggtgcaaccactagtacagatccttccatctgtgatggcccataacaagactggaatttgcgggccgtcacaaggaagtaatctcaatcgggctgaagtttcgcccgattgagatatggtcgcacaggcatggtatatcggcataaaaataaagcccgtcacggatgacacttatctgtgacgggctatagttgaggcccgattgagatgagggttccatatctcaatcgggccctaaaaaaagcccgttacagatgagggtcatctgtgacgggctccaactagaggcccgattgagataagtttagtgcccgtcacagatgacacttttttttacggccttttattaaggcccgatagagattacttgtatgcccgtcacggttgattgttttagggccgttacagatatttgttgcacagtataaataccccccaccacctagtgtaattgtatcccactattcactattttggtgggaggctgtagggggcgattttttgtcctttttccaaggaaaacagaaattaaattcctgtaggtgatcaaaatggatcaatcaagtgagtaatattaatcattaattgagcaatttcatcacgtcttacttttgcaataatgatcttataatatgtgcctctaatttgtttttttttattttgtagcaattgatctaagttggatgtatgcgaaaaatttgaaacgtcattctacggagtacagaaagggcataataaattttatgaacgccgcggaggaggatcggataagaagaaacagtgattacatgtgttgtccttgtgcagattgcaagaatgagaatatgtttgatagcggagaatacgtacacggtcatctgatacaacgaggattcatggagggctatacatgttgggtgaagcatggagagcaagaatcaggaagtggagcagcagtagacagaagtggtgcgcataatcaggaaaatgaagatgagcatgacatgtttataccttctccattgggcggtgaaatggttgatgtggatcacgatctgctgcaagacatgttacgtgacattgaggacccagcccagaatgagagagatggaatgaagttcagcaggttggtaagtgattccgagacgcctctgtccgctggatgcaaagcaaaacacactaagttgtcagttaccttggacctaatgaagctgaaggcaagtagtggatggacagacaagagtttcacagatcttttaggaattttgaaggctatgcttcctgttgagaacacattgcccgagacgacatacgaagcaaagcaggttctgtgtccactggggttagaggtccgtaaaattcacgcttgtcccaacgactgcatattgtaccacaagcaatatgcggacttggatgcttgtcctgtctgcaaggtttctcgatacaagcgaaagaaaagtgctgacgaaggaaataagtcaaaagaggggtggtccggcaaaggttgtgtggtatctacttatcattgattgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgctgccgaccctagaaacatgaggatatgtctgtgtacggatggcatgaatcctttcggtgacatgagtagtactcacagcacttcgccagttcttattgcgaactataacctcccaccatggttatgctttaaatggaaatatattatgttgtgcttgttaatctaaggtccaagcaacccggcaattatatggatgtattc

SEQ ID NO: 64537 - DNA, 2506 bp, Oryza sativa
ttaatgactaccctgcactcggtaatctttccggacaaactataaaaggaaagaaagcatgctccgattgcaaggaacatacacgaagccggtggctgaagaaatcacgaaagatggtatacatgggtcaccggaggtggctcccgctacgtcacgcatttagaagaaagaagaaaatttttaacggtaagagagaacttcagcctgctcccaaagatttgtccggagatgaggtgcacaatatggtaaaggacataagtaatgagtttgggaagaaaagaaaatgtagaaagacaaaggagaagggtatgtggaagaaaaaatccatattttggcggttaccttactggaaagatctagatgtctgtcattgcattgatctcatgcatgtagaaaagaatgtgtgtgagagtttggttagcctgatgctgaatattcccgggaagacaaaggacgggttgaacgcgcgccttgatctataggacatgaatattcgcagtgaactccagcccatacgagatgcagagacatgtaaagtgtacctccctccagcctaccacacactgtcgaaggatgagaagatcgcaatgttatcatgcttgaaggatattaaagatccattgggctattcagcgaggataagtaagtatgttaaattggacgatctaaaacttgttggaatgaagtctcacgattgccatgtgctaatcacacaaatcttgccagttgctatcagaggcattctaccaccgaaattgcgtcacacgatccaacgtctgtgcgccttcttcaatgcaattggacagaaggttatagatccagaagatctagatgggctgcagaccgatattgtgaataccctctatcacctggagatgtttttcccactgtctttctttgatataatggttcatctccctgttcatctgatgaagcaaacaaaactatgtggcccggcttttctaagggaaatgtggctgtttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcccgcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacatagaacataattctcggttcaacaaatggttcaagaatcgtgtgacaatgtcctcggatgtcccaaatgagacagtacagttgttggggatgggaccgtcttggaccgtagacacatggcaaggatacgatataaatggatacacattttacaccgtcaaacaagatgacaaaagcacagtgcgaaacagcggcgtccgtatagatgcattccaggatcaagttgggtcaaacacatactacggccgcattgaggagatatgggagctaaactacgtcaagttcaaggttcctttgttccgctgccgttgggtgaatctacgcactggtgtcaaagccaacaaggaaggtttcactttagtagatctatctaaggtgggatacgccgatgaaccatttgtacttgcaaaataggtcgagcagatattctacataaaagacccttcaaacaagaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaaggcataaccttgtgactgatgcatttgtacttatctattgaaatgaatgaagtattttgttttattgcaaagacttgatatgtgtagtcattaatatggctaattttgttttattacaaatgaccaaaataaaagttgtagatcctgatgagaggatcaactctattgttgaccatatttccatttgaaatcatttagtattgacaaaattaatttcaagctgttgggaaaaaaattatatagaaaatcatttagtataaaatgaattattacacaacagctatatattttgcactctcaacaaatgaaagatggaaaatgagtcatcgttgacgggccaacgtttacggccgatagagattaatctatcttaatcgggctttgccgtagagcccgtcacagatgactcatcggtgacgggctccatactaatgcccgattgagatgacattccagcccgtcacggatgactcatctgtgcgggcccaaagataatgcccgatagagatagattaatctctatcgggcttgaactaaggcccgtcaccgatgactatttttccatttttccagataag

SEQ ID NO: 64538 - DNA, 10353 bp, Oryza sativa
attgaaatcatttagtatttacaaatgctgtttagatttgtcatattgacaaaatcaatttcaagctgttggaaacaaagttatatagacaaatgaccaaataaaagttgtagatcctgatgagaggatcaactttgttgtttaccatatttccatttgaaatcatttactatccgaaaatatattatgactaataaaatgaattattatacagcagttatatattttgtactcacaaatataaagacttatctggaaaaatggaaaaatagtcatcggtgatgggccttagttcaagcccgatagagattaatctatctctatcgggcattatctttgggcccgtcacagatgagtcatccgtgacgggcctgaatgtcatctcaattgagcattagtatggagcccgtcaccgatgagtcatctgtgacgggccctacggcaaagcccgattgagatgactcatcactctactatatctagatcgaaaatttttctaagtcccgctacagtttcccgcctccttagaaccctagcgccgccgccaactcctacttcgccgtcgtcgccaccgagcccgccaccgccgccaccgagcccgccgcctccaccgagcccagtgccgcctcccccgaccggcgatgccctccaccgagccaggcgccgccgtcaccgagcccgccgccaccgccgtcgtcctccctcgagcctccacaccgaccggaccggtgtcggccttcctcgttgttgacgcccgtatcctcaccgacgcacgtcgccgacccccaccgagcccgacaccgcccgcccggcgccgacctaccaaaccggcatctccaccgactggcgccgccctctaccgagcccggcgctgccgccgcaaactcctccgttgccgagcccgccaccgccgccaccgagaccgctgcctccaccgagcccaacgccacctccaccgaccagcgacgccctccaccgagcccagcgccgccgccaccgagccctaccgaccgtcctcaggtgagtactccatcgcgctgccctatgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtggttaattttattactgtgagatgtgcaatttcgtttatttatacatggtgcattaatgaattttgtaaatagatgaaatgtggttcgttttattactgtgagatgcgcaattcagtattctgcaatttcgtttatttatacatggtgcattaatgaatttagtaaatagatgaaatgtggttcgttttattactgtgagatgcgcaatttagtttatttatatgtttcatttatttttctaagtgacattaaattcattgtaatagattgtagcactcaattgtgtatttttgttattgagaaaaaaagtatacaatgtctcagcaaggcgaaccaatgtcgacgacaactaatgggtcctcaagggcacgtactcctaggacagggaacaaaatccctaaggaacggttccgcataacagcggtggacgccgtagggttgccgacatctccaaggaaaatattgagccgatttaggtctatctgcggggtcatagggaggcagaaattcagtattctgcaagatgacatcaagctcgtgccggccgcagagaaggacattgcttggctaacgttcaaggagagctttgattatcctgtggagcatgagtaccgtctcaggcgggctgctttcaaggttatgggcaatgcttagaagaacttcaagactaagctagtcggcgagttcgtctacaacccggcgaatccagatccaagagagaaatttccttggatcacggaataggtctgggaggaattccatgcgaaaaagtcgacccccgagtccagagctagaagcgaggcatatcgcttgctccagaccaggaaccagcatcggcaccggcttggcaccgccggatatgccgataaggaagaggaatggcagcgtgaggatgaagaagcggaggaatcgtgcacaccgctcgtgttcggcgatatcccacaccctcgggctagcaactgggctagggctaggtaccagaagaattatgatggcacaatcttcatgccaaatgcagaagatcaacgagtatacgaagctattgtaagtgtctagtcaaactagatgttcgcattgtttcccatcgtgcagtttatttaaacccactaaattgtaatgcagaaggagttggttgccgagcaacaagcctcgcaagaggcctgctctcaaagacgcgaggacgacctcctcacgaaagcgttgggcaacaaggaacatcgtggacggacacagggcgttgggtcttctgttccctggaagtatggatttccagactacgcgtggcagtacaagaagcggacttccaacaaggcggagaaagatgcacgccttgaagccaagatccgggcgtcgataagagctgagctgacatctgaattcgacaaaaagctcgagtcgatgagggccaagattaggcaagagatccgagaagagcaacagaacccccaggccgccgctgctgctgcgcacaaagagttaggaagtcctacccaaaaacgaagcagttgcgcatcaactgagttggcggaaaatccaacatcggtcgacagcgccgtcgaccacataacggtaaccgtgaacttactcaatacatgaaagacttaacgaatccatatgatatataatattctaaaagaattgattaatctatcgcaggaaccgacgagctgcaccctcatagttagggtgatgccgaccttcacggttctagcagccgagggacttgcgtacaagccgaccccagagacaagagtgcatggagcgcaactcagggccgattgtgcaaaagttcaagtcgattcggtgaagcccgaatacgagctgttccctctgaagtatccaccgaacgacgaggtcctctcactaggaaatgatcatggtaccttcatccaatggcccaaggacctcattgagatcagggttacagtgaggccaaccactacaccaggcggtcgtccaccaaagagacccgcctcttctctttcagcccctcctgctcaagatgtcatgcacaatcttatgatgtgcagttgcagtacgacacggatcttggggaggaccgaacggaggccgacagcaaggcgattcatgaacccccaccgatgaagaagagcaggaaggcacactcttccccttagagaattactctcgataaacccgaagcaaaggggagaggaaggggaggaaaggtgcaggcctcgcttctagctccaaggaagctagatctgggcaagggccaggaagagactaagagcaaagaggtcaagaagaaatacgtcactccacaggagttccaactaggcatgccattggttggagatgacatgcttgccgcaatgggcaccgcttgcaaggaccttcacttatactacatggagaaatctaacgccaggaagccaagtaaagctaccgatatccttggagagcacgatggaaagtcattccttggtccaacaaattatatcgtggtcgacttcaaggatcttttcgacctctacaggcttcgagcggtggacacaagcctccttaagtgctactccttgtaagtattgtcgcccaactcaatctgttaataacaatcggtttaacttgcttacaagatcgtttatcctgtgtgtaggttaagttagcaatggtgtcagaagcatgcaccggaagttgccttccttgatccacaagtggtcactgtcacaaatctccaaaatgaccgtcaaggaatggtcaactacatctacgacaccttgtggtcccgccgagacaaggagtacattatgtgcgcctataatcaatagtaagtgtgttaactagatatacacaacagcatgacacattacttgagtacttaattaactttcactatattaatgccacagtgcccattggatccttctggtcataacacctaagtggagtacatgtcactacctgaactccagaattgataagaacgcatatgattggaccccaattcaactagcgatagatgaagggtgggcccaatacgtgcaaagaggaggcctcaggaagacaggacatgacaccctcatccacaaaaaagacttcccggtgaagcaacaaataggtgaccagtgcggattccatgtgtgccacaacatgcgccttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggaggttcgcgaggagatagccagcttcatcctccgcgaaataattaaccccaaaggaatgtttagacttaaactaaaatgatgaacaatgttgaacttttatgtttaggcaatgatgaacacttattatgcaactgtgatgatgtaactgtgatgtttatatttatgtatatatttcatatgtttatgttaagacttgataaataaatatttgatccaattaactcggttttgcaggtgaaacatgataaatatttgaatggatgttaaatatgtgaatggatgtgaaatatgagatggctgtgaatgtgtggttgtgtgaaatatgttgatgtctgtgtatgtgaatgcatatgtatatgaatgggtgatgctggggagctggggatatcggatatctgtgtttgtttctgtcatttttgcagcgggcatggctagcaaaggcctgaggctagccaaaaaaacaaattttttttgtgtattatagtcatctgtgatgggccataaataaatgcccaattgagatgagttcatctgtgatgggctctagtttaggcccgattgagatcagtagtcatatgtgacgggctctagtttaggcccgattgaggtcagtagtcatctgtgatgggctctagtttaggcccgattgaggtcagtagtcatctgtgacgggctctagtttacgcccgattgaggtcagtagtcatctgtgacgggctctagtttaggcccgataaaggttagtagtcatctgtgatgggcgctagttgtggcccgatagagataggtcatctgtgacgggctataatttgactggtcgtctgggtcaaagctatctgtgacgggctttacttagggcccgattgagctatattcattcgtgacggccgtttgcccgattgagataactcttcacatcagtgacttctagcctgtgacggacgctgtgcccgattgagatggggcttaccgcccgattgagatgagggtatccgttctagtgaactctttatttatcagtcaaaactgaagaaataaaactagaagaacagtggatggttgtcgcggttgtagcaatgtagctgtgtattcctccaatatacacttcccgaaaaataaaactcttaattaccaaaaagaaagggcagatttattctaaaatacactattttttttgaagcactgtacaaatacaagcacccacaacatgcgcacactcatctttatgaaggcacacgcacacctcatctctatgaatactttcgaaagactacgacggcacatgttgagattcacgaagttatcacgtgcgcctcgctgtcgacgggtacaccgaccactgaaaaaaaatagttgtaaatgtgagcactcgtgtttagtctaggacttgaattcggatgggctagttccaccaaaaaaatataaccaattgagttacacttacttttgacggtcgttaagtgtaaacttgaaccatcaactcttgctcctgcatcaaagaatataaaatatactgtcaaacttagtggtaggggttgattactaaccatgtccaatagtattgataaatattagtatgcaagtgacttctggatgaaaacacacccgtcatgtgacaaaatatacctcttaccaatcatatgcgagcataaggattgaagggaccacatgtcagtcaaaaccgattgaatttgagtacatccactgccaaccgccatagtgctcacctatcatccactaggcaaagttggtggccaaaggcagtggaggtggtttcagccgaacaagccttggcgccctcggttgcctccttgcacgtggcagctgcccattggttggtgatggcggttgtgggtgaatcgacctccacaactgtcattccaaccgtcttaatttgggggctataaaaggaggaccacactcacttccaaaatgcacaataaagtggggtatcactcacttttttaattccaagcatcactttagtatatgaaactatatagagagtgaggggaagctccgaaatgagtgccccaaatatcggagttctctccatggagatcctgaggagtgtcgggtttgacaacattcttccattggaacttcggagaagcgccagagttgtcggctttcttctctcacttgtaccttggcggatgcttcttttaaagtaagtattcgagacttctttatggtatataatttacctgcttaagtgagattcccattgttaggggtttgtgcttagtattattattaagtgctctagtactatgactctgggtaaagaaggaagtttctgcgctaggctagagtaataatcaataacttagatgtggtgtctaagttagtggttacctttgtttgttgtgtgctccacggaaagtgaggtaagtggcaggtggtgatatccctgtccgttctttgtatccctccacgttcaggtacatcataaagccgtaggctggactcagtttggtagatcagaggagagccaatgcctgaagcaatcaattgggtttacctttaacttaaatatattaaattaacctataggaatcctcgctagtcttagcctaccattctttttgaacgactcacaccaaacagtgcggagttctattgatagagcaggaaaaaaaatccaagattacaaccctgggaggtcgtaaccaggaaaacgaaaaaagtataccaccacccacacaccgacagcgccaacatatagacctaggagaagactagcatcggactggccgccactaagcgtgaccgaccgccgctaggccaacaatggaacacagccgagatcgcccaaaacccgacccttacaaccaacacaaaaccctactctatccaaatctttgggattgagggagagagggtgagagagaagaatggaaccgctttccccctaggccctccaacgtggccaacttgcagaagctaggccgccaccacaagaggatatgaatctagagtgagcttgtattaatttcttgggaggtttcggcaaggggatgcctagacgacgtctccaaggagagaagcgacgaaacatcgccgccgccatccatcaaggtcttcaagagaaccgagaccaagctttcacccgacagccacacttgagggggtgagacagcacgacaacgccctcaggaggggagtgacgctcgaacgccatcgttgccggtccggccaaggccgggttgggtttcacccgccgtcctccgtctgccgatctaccactgatgtaccattgccccaccgccatctaaccctccgccggcgcgtgggcaccactgcaccggcgcccctcgccgtccagtctccgcacactgccaacggtcgcgtcctcccgctgcaccagtgtcacgccctgaagtttcccctttcttctttctttaaaagttggttgaataaatcgtccgaagaaattatcttaattaacctagagctaaatccctaattaataaatgcaattgataattggaattagcattgtgggatttttcttgggttccacatgtcgcaattgattaacaggatttttagtggaatttttagagccctataagtaattttaaccaattaaaattcgcaaagtgcaatattttaaatcccagcaaaaactttttccttttgctccattcctttccctcctttttctttgtttgaccgttggcccatctctctcccgcacccctccctcttgctgggccggcccaagccgcctcctctcctctttgggacgctgacaggtagggcccatcggtcaggtcgtccccaacctccatccacccgcgcaccgcggcaaccaccgctcccacatcgccgtccgcatctcccgcgcccactccgcgtccacgcgctgcgcccacgtcgtcgtccgccgctcctccgcctttcccactcgcgcacgcgcccgcaaatgggcgggattcgatttgaatcccgtcccctctctctctctccactcccccacgtcgccggccaaatagggggccaccccggccatttctgtcctttcctcgcccataaaaacccttccccgagccccttcttgcatttcccccattcgccgcgccctcccgtgcttcctaccgcagccgcgccgtcgcaccgacctccgccgcctgccaccgtactccggccgcgcgccaccgctgctagagccgccgcagtcgcgctcctcggccgccgcttggttgccgctaatcagccccagaaccccatctccctcgcgagccggtgagctcctccatttccccgccttcggtcgacatcctcgctcgccatggactccttctccccctctaaactctatgttttactctccctcccgcgccggcgaaaccccggtgaggcctcccgccccctcttttcccctttcctctccttcctcccgctgccgtcgcgccgccgcccttcggcaatgcgcagccgcttccgcgccggtcgccgccgtctcccgcgccgccggtcaccgccggtgaccacgctcgccgccgccgctccccatggccggccggccggctttgtgccgagccgagccgtgcctagccgccgcctgcgccgtccgattggccacgggccaatctggaccatcggtcccgtggaccggcggtggaccactcgtgtgatcccggtccacggtggaccggccgcctcatgccgctgacatgcagggcccgcttgccggcgccgccccctctcgctgacatcagcccttggctttattgcgcaataaattgattaaggacttttctttattagtaaaaacacagattatcttctaaaattcataagtaattcttccgagctccgtttaagtccattcaagtctcagtaaatcaagaaaaatgcaaagaatccattaaaatggttttgtttcctgtttcagtagtcttatagcatgttttgcttgtgtgctttgtttgtcgcgtagattttggccgtttcgtcgatccgctgtttctcgaagacgttgctgtggtctcatcagtgagagagcaaggcaagtcatgcattacaattgatcatattgtacccaatttacaaatatcccgcatttctattaaatgttgcattcttttacaatgtcatgtgggatgggtcctattactcatccatatattgtttaccttatgccgttgattacttgggtatcaaaataactagatgttggtttaggaaatgcttagccatgcttagctcaactagtacacaaatggggataacattattacatagactttgactattagcatagctttggattgatgccaccgcaatggtgttagttaattaaaatacactgaatggtgggctgtgggtgtatggttttgctggtcgcacccatgacagttaaggaccggttcacgggaaaccctgggagacttaccgtgcttaccacaagagggagtgggtaactgcttgatctgaagtatagctcgaccctttcctaggcaccggtcagccggggtgtccgattgtccaactgtcgaattcaccgcagcgcaagagggggccgcccactgccttttgaggggtgggggtgaaaccttagcgtggtgtggatggttaggggagggttatgcggagggtcttgtcacgatttccccctttgcagtatcatagtgatacttcggggcatggcgatatgtgtggaatcgtgtcttgtgggtacagttgtacacctctggccagagtaaaactattcgaatagccgtgcccgtggttatgagcgatcaaccagattcaccgtgattagtctcacccctagtttagtttgatgaactggtgtagttcaggtggttggttgggccagttgcaacgtggtgtagcgttggacagtgattggttaatctggcttaatct

SEQ ID NO: 64539 - DNA, 6023 bp, Oryza sativa
aggcaagtcatgcattacaattgatcatattgtacccaatttacaaatatcccgcatttctattaaatgttgcattcttttacaatgtcatgtgggatgggtcctattactcatccatatattgtttacctatccatatattgtttaccttatgccattgataacttgggtatcaaaataactagatgttggtttaggaaatgcttagccatgcttagctcaactagtacacaaatggggatcacattattacatagactgactattagcatagctttggattggtgccaccgcaatggtgttagttaattaaaatacactgaatggtgggctgtgggtgcatggttttgttggtcgcacccatggtagttaaggaccggttcacgggaaaccctgggagacttatcgtgcttaccacaagagggagtgggtaactgcttgatctgaagtgtagctcgaccctttcctaggcaccggtggcgagggtgggcgtgatgtagttgggtcggccggggtgtccagttgtccagctgccggattcaccgcggcgcaaaaggggaccacccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtatacctctggccagagtaaaactattcgaatagccgtgcccgcggttatgaccgatcaaccagattcaccgtgattagtctcacccctagtttagtttgatgaactggtgtagttcaggtggttggttgggccagttgcaacgtggtgtagcgttggacagtgattggttaatcttgcttaatctactacatatgtttttactgctttcaactactgtttttaaatgcctgctttattgcaaatgaaccctaagcctcctttggatatatcctgcatcatacctcctcttccggtatgacttgctgagtacagtgggtagtactcagtcttgctctcttttcccccacaccagagctgaagatcttcctagttggagctgtcttgtcgaagttggtttcgtcgctgccatcaaggattgcctgtggagtggagtcgccccgctgcagaagtcaagcttccaagtttagctcgcttttatcttttccgctgcatttgtaatcttttctatttttataagacgtggatctgtatgtcaacaattgtcgtttgtgtaccctggctggtcctagacagggatttaatgcacattcagcttagaaattctggttcgtgaatttctgggcgtgacaagttggtatcagagccaaccttgcccataagacaagccaactggaaacctaagagccctctcaaccccttttcatctgcatatgttctttgcactaggattagtttcgggaaaatttggggttttggctctttggtttgagggagaaatcttggtcgttcattcggatcggatctttaaagttagctcagtctagggttttagaaaaattttatttggagtttattcaacagtaagtcggggatttatcgggtgatatgcactaagtcgtgtctatgttcgatggggcaattttatgcgtatcattatgactatgcatctattttatgcattaatttattgtttagtcagttgcattagtgtctttatctgggttcatgaaaaatgttctatgcataataatcaccatgctcagttatttgtttgagtcatttgttgctttgttcaatttggatttgagcatgaattggttcctatcccttgtccatcttaggtgtcagacctgttcctcgatcgcaagtgtcggtccgagcttcagagtcgccgcccttagctgtatcatcttcttagttttgtttgcttgctagtttctgtgcttaggttagttgcttgtgggttagtcgacggtcgatatcatgtgtcagtggtatggctgccttcagtaggagttgtttgcttccttttcagtgtttttatcaagattaagataattgcacttaaatttataagaaagattagtttctaagcccctgtttttcttccttttctcatatttctacctatccccctccagatggtgaagacaaggaatggttcccgtgactccaacaacgccagcggcagcggagagcaaatcaatggaccacgtgccagcggtgcatctgacagcagttcatctccaccgcccgagaacccaacgattgctcaggtgttggacaatcagactcagatgatgacaatgatgatgcaacagatgcaacaacagtaccatcaggtgttgcagcaggtgcagcagcaagcacagcagcagcagcagaacatttagtttggtcttccacctccccagtctaagctgttagagtttctccgtgtcaagccaccgactttctcaggcaccaccaacccaatcgaggccaacgactggcttcatgctattgagaagaagctgaaccttttgcaatgcaacgaccaggagaaggttgcttttgctacacaccagctgcaaggtcccgcttctgtttggtgggacaactacatggtgacccgtccagctgggacagaggttacttgggcagagttttgtaagagtttcaataaagcacaggttcccgaggggattgtggcacaaaagaagagagagtttcgttctctgcaacaaggaaccagaacagttatagagtatttgcatgagttcaaccgccttgcgcgctacgctcctgaggacgtgcgcactgatgccgagaggcaggagaagtttttgtctggtcttgatgatgaattgaccaaccagttgatctctagagattatgaggactttgagaagcttgtggacaaggctatccgtcaagaggagcaatgcaacaaaatgaaccgtaagaggaaggcagctcagctcaggactccccaggggaagagtcagaagccttgcttcacgatgggacatcaaggtgaaccttccaccatgattatccggcagcaccgtccctaccacccgggtagcttcaacaagaactacaagagtggcagtcacagcaacagtgagcagcacagcctcaaccctactccaagtccactaatgattccagctcagtcagttcagtcagctctgccagctcagccagaacagcccaagaagtttggagaaaagcccaaactctgcttcaattgtaacgagcccggacacatggttggtacgtgcccgaagccaagacgtgccagactcaagttcgttcaggcccatgtcaatcatgcatctgcagaggaggcgcagtcagcaccagaggttatattgggcacatttcccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacatctcactattgcccatccgtgacagttgaaattcaagggttgatttttccagccaacctcattcttctcgaatccaaggacctagatgtcatacttggaatggattggttgacaaggcacagaggagtgattgattgcgctagccgcaccatcaagttgaccaatgcgaaaggagaagtggtaaccttccagtctccagtgccgcagaagccagggatcagtttaaactaggctgctggtgaagaacaagaggtaacagtggagaaaaccactaagaagttggaggatattcccatagctagagattatccagaggttttcccggaggatctaacaacaatgccaccaaaatgggatatcgagttcaagattgacttggtacctggaactgcaccgatccacaagaggccttacagaatgggagccaacgagttggcggaagtcaagaagcaagttgatgaacagttacagaagggatacattcgcccgagcacgtcgccttggggtgctccggtaatttttgtggaaaagaaagacaaaaccaagaggatgtgcatcgactaccgcgcactcaatgaggtcactattaagaacaagtaccctttgtcaaggattgatgatctgttcgatcagttgaaaggagctattatgttctctaagatagacctgcgatcaggctatcaccagttgaggatccgtgaagaggatattccaaagacaacattcatcactcgttatgggttgttcgaatgcacagttatgtctttcggactcaccaacgcacctgccttcttcatgaatttgatgaacaaggtgtttatggaatttctggacaagtttgtcgtggtttcatcgatgacatactgatctactccaagtccgaggaagaacatgaacagcatcttcggttggtgcttgaaaagctaaaagagcaccaactatatgccaagttcagcaagtgtgacttctggctaaagaaagttcagtttcttggtcatgtcgtaagtgctcaaggagtggctatggatccaggaaatgtggagtcagttaccaagtggaccctaccaaggacggtcactcaggttcggagtttcttaggacttgcgggctattaccgtcggttcattgagaacttctctaaaattgccaagccaatgacacagcttctgaagaaggaagaaaagtttatctggtctgctgaatgcaatagagttttgaagaactcaaacgacggttggtgtctgcacctgttttgattctacctgatcagacgaaagatttccaagtgtattgtgatgcatccagccaagggctggggtgtgtgttgatgcaagatggcaatgtggttgcgtatgcttcacgacagttgcgtcctcatgaaggcaactacctgacccatgatctggagttagccgcagttgttcatgctttaaagatctggcggcactatcttatcggtaaccgttgtgaggtatatacaaatcacaaaagcctaaagtacatcttcacccaacctgatctgaatctctgacagcgaagatggttggagctaatcaaagattataatatgggaatacactaccatcccggcaaggctaatgtggtagcagatgccttgagcaggaagagctactgcaatgttgcatgggtagaaaaactatgttgtgaggttcaacgcgatttggaacacctgaaccttggtatagttgagcatggattcgtggctgccctagaggcacaacccacacaggtggagcaggttcgcatagctcaagcaagtgatcctgagatagcagaactcaaaaagaacatgagggttggaaaagcccgaggttttgttgaggatgaacaagggacaatctggatgggagaaagattatgtgtacctgaaaataaggagttaaaagacctgatactgacaaaagctcatcaaactcagtattccattcatcctggcagtaccaaaatgtaccaagacctcaaagaaaagttctggtgggtcagcatgagaagggaaatagctgaatttgtcgcactctgtgacgtctgttagcgagtaaaggcagaacacaaaaggccagcaagtctgctacagccccttcagattccagaatggaagtggaaagaaattggaatggactttatcaccggcttgcccaggacttcatcagggcacgattctatttgggtagtcgttgaccgactcaccaaagtggctcacttcattccggtgcatactacctactcagggaagaagctagcagaactttatctggcaagaatcatgtgtctacatggtgtacctaagaagatagtgtctgaccgaggaagccaattcacctcaaagttctggcagaaattgcaagaggaattgggaacccagttgaacttcagcacagcctaccatccgcagacttatggccaaactgagcgagttaatcaaatattggaggatatgttgagagcctgtgcacttgattttggtggatcatgggacaa

SEQ ID NO: 64540 - DNA, 971 bp, Oryza sativa
aggaacaagcaagttcagatcacatcgaaattcaggaagatctgacgtatgtggagaagccgactcgtatccttgaaaccagcgagagaaggaccagaaacaaagcaatcagattctgcaaagttcaatggagccaccactcagaagaagaggccacttaggaaagagaagatgagttgaaggccacccatccgcacctcttcgccagctcttccgaatctcggggtcgagattccggtaggtttgtcacgccctgaagtttcccctttcttctttctttaaaagttggttgaataaatcgtccgaagaaattatcttaattaacctagagctaaatccctaattaataaatgcaattgataattggaattggcattgtgagatttttcttgggttccacatgtcgcaattgattaacaggatttttagtggaattttaagagccctataagtaattttaaccaattaaaattcgcaaagtgcaatattttaaatcccaggaaaatctttttcctttttctccattcctctccctcctttttctttgttgggctggcccatctctctcccgcgcccctccctcttgctgggccggcccaagccgcctcctctcctctttgggacgctgacaggtggggcccacctgtcaggtcatccccaacctccagccacccgcgccccgcggcaaccgctgctcccacgtcgccgtccgcgtctcccacgcccactccgcgtccacgcgctgcgcccacgttgtcgtccgccgctcctccgcctttcccgctcgcgcgcgcgcccgcaaatgggcgggattcgatttgaatcccgtcccctctctctctctctctccactcccccacgtcgcctgccaaatagggggccaccccggccgtttccgtccttccctcgcccataaaaactcttccccgagcccctcttgcgtttcccccattcgccgcgccctcccgtgc

SEQ ID NO: 64541 - DNA, 13428 bp, Oryza sativa
ttagaaatagctgaaattcggaattaaaaaataaggatattaaaagaggagactagagtccatatagaaatacaatttagaaatagctgaaattcgaaattaagaaataaggaatattagaagaggagactagagtccatatagaaatacaatttagaaatagttgaaattcggaattaaaaaataaggaatattagaagagaagactagagtccatatagaaataaaattaggaaataactgaaattcggaattaaaaataaggaatattaaaagtagagtatagagtccatatagaaatacaattaggaaataaccgaaattcggaattaaaaataagaaatattagaagtagagtatagagtccatatagaaatacaattaagaaaaaaaatagaaatatggaattaaaaaataaggaatattagaagtagagtatagagttcatattggaatttaaaaccaactaaaattcggaataaaaaggagcctccatgttcgctctcatggcctagaaattctcacattaatcagagaaaaagaaaaggcagagtctcagagaaaaagaaaaggcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttataataatataatgagaaaacatatatgcttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaagattcttgatgagcaacagcaatatgagctagtaaagttctgcaaggacgaggaacttgttcttctggcggatgaggtaaggctagtcatgttcaaaggtgtcagtgtgttgagtgatataataatgttaacaaagtatgatgttaacaaacacaagagaaaactgtccagataatcgttttttggggggtgttgataggtataccaagagaacatttatgttaccaacaagaagatcaactctttcaagaagatagcaagatccatgggatacaatggagacgatttacaattagtatcattgcattctgtttctaaaggtgaaatcccatcatccgcctttctttctccaagtacattgtaactccttaccacatagatatttttttgcctgccatcaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggtgcaataacatatctgtccttacacgaaatgtaattgccaatatacactagattcataacacagagagaccatgcatattgtgcaggctggggacgcatcttatgacctctacgaggaagagaaagacaacatcctaaaatctttatctcgtcgtgcaaaggtgtgtggagtttacttttaacagattcacttcttgctatctatgcagacacttgagctaagacatcattttgtctggaatctggatcacaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaagtgagctactttctactcttgatctttgaaccatagtgatatgtgctgtctgaatcccacagaatgataagtgaactgttttggggaacggctgaagctcacgcagcacaatctatattcctgaagagtctggtagtagtagtagtctcgttctacaagaacagatagcaccaattaaaaaaaaaacaataacagatagcaaccgttttttctaccatttcagatcatcagatgttatctgttcacctgcaattctgaattcctgaccactcaagtttggtcctttgtgaaaggttgcagggacatggcacgtgagatgcacgatcctgccgcaggaggagaagataccttcgatgatctcccgcttcagggaattccatgaggagttcatgtcacagtatcgcgactgatggactgaactcataaggcttcgccatccagaagacgagaaataaagcaaaacgccgttaatctgcgatgtgttaacggaagatgtgcagcaaccttaatctggaaaacttgagcatactcagtttgggtcgtaaagaattcacgggctgttgcatcagtgtttgcccggtacaaggtttgattggattagcacgatgaatgagtgcagggagacctgcagctaaataaatactccctccgtcctataatataaagtattttgaatttttgattgcaacgtttgaccgctcgtcttattaaaaaaatttaaaattattatttattttattagtgacttactttattatctacattacttcaagcataacttttcgttttttatatttacaaaaaaaaaattgaataagacgagtgatcaaacgttgcaagcaaaaactcaaaatcccttatattgtgggacggagtgtgggacggagtgagtgttaatgttagtagttgtgagttagtgactcgtacctaaaagtaatgctacgaaataaaaatgtgttgagagagtatcttacattcagtaaaggttttccaatcgagttggctatcttgaaacggaacgagaacagcagctattgttttgagctctgaaatctgaagcaggcgacacggagcagcagtctatagcgaatctcttcttgaagcgaaactcaaactcctcgcgatcccgttcattggggcgtggtcgcgtagattcatcattcatgggcctcgcactcccgcggctaagagcaagaacaatagtaggctttatgccagctataacaagaagaaaagagaagagagaaaaaagcgggctataaatttgtatccagctgaaacatggacttcaagacactttgtgtgtttgagaggtgagaccgagtattaattgtgtagtatatttttatagataactatttaatgaatgagctattagattagttatagataatttgaagctaacatttggctatactattaaacttgctctaatcgggccatgtgggctgcaccccaaccatccgggctctcggctctccagcagcatacgacctctcgggactcgggagccctacggatttttcttaattttaatttttatctattaaaacattttctaaaacattcttaaagtataacagatctacacctttaacgtcctctatttttacgacgtggtatatgttctaaaaaaaattaaatcctagctactaacctaaacatatatgtgtctaaattctcatattaggattggattgagttttttatgaaacagaggtgtagctgttaatgcatgttaactgttgttgagaggggagggttgcaccgtagtgcttgtaaaatagccagccttactttacgtagtcgttagcattaaccaatgactatatgtatgtcacgttatataaagaaaaaacgctaacacttttccacgaggccacgttgttgccgccttgtctgctactacctcgacattttggtaccgagaaagtaccaataccgcacttccaccacctgtagccatatggacacgatgcagtggctggcatgttggtagtggcaacgcagggatatgtgggtattggttggcacatgacaaacggcgtcgcccaaacacgtgctgcacgcacgggtacgtcgtaaacgtatgtgcggccacacaccagccgtcgtgctcacgcgtcccagttttaatttgtactttttcctccgtctctttttaggtggagtcataattttcgtgtttaactttaatcatctatcttattaaaaaaatttaatcaatatttttattgttattatatgataaagtatgaatattattttatacgtaacttatttttttattttttaaataaaatatcaaataagagagacgattatggttgcgtttaaaatagaatgcatggagtactagtgtactacatcgagcaggagcgccatagctttgcggcgtccacacaacacacgccgtgccttttcccggagtggcaattggcaaaggcaataacatgcccagaattaagtatgcaaagcggttgctgccaacgccccgggttgtgcacatgggctatttggagaattggattcgcccctacgagtagtagttgctcagctagggttgctgtttgtttgccaaagatattctctgccactccctcctgaatgtttaacgcagttgatttttttaaatatatttgaccgttcgtcttatttaaaaacttttgtgaaatatataaaactatatgtgtacataaaagtatatttaaaaattaatcaaatggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgctgagtacattccttccttcagaataagagatggaatactcccatattgtcccatatgcgcaaggtagaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttggagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcacagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagtttactgcaactatgcattttaacattacgaaatcaaaagctgatgttttgccacggcgaagtcttaactctaaccgttaaatctcttatcttcacagtgaccgtagcagagatcacacattcacatgcaaaaacacgtctctttctctatacttcactttcacctcgataaaaaagataaataatccacatggcaggtgagaaattaaactattatcccgattatgtggcgcccataaagccagcagcgcaagcccatgtcatgccaacacagtagagcattgcacgcgctgtattcaattcgatcgccatgtgtagcatgtgcgaatattttttatcattagaaaaatatataatcttttcgaggttttgacaaggagagctatagctttcagctggcccaataataataataatcaaataaacaaggaaaacaccacatgtttcactgtactagttgagctctgaccactatatataatcacactgccacacaatctgctagcaattctcctccccctcttgcaatccattctgaattctctgatcttgaattcttcatcttctctctctgcaagaatctcgagatttcaagatcgaggagaacttaaaagtttttacgccatgattccgagagctccgagcctcttccatatcgaggatggagctgtgggtgtcgcggcgtcgacgaagaagccaatgccggctgactccggcgagctcgtcgggctccggctgatcatacagcagtcgccgaggcaacggccgccgctgtccgtgctcaggcggtcggcggtgaggccgtcgccggcggcgacggcggcggcgagtcaggatgaggctggtgctcctgcaggccgggggttcatggggttggggttcttgaactgctgctactgctgccacaagaagctctacgccgacatggatgtgttcgtctacaagtaagacattttacacaacaaatcaagaactccgccttaatccacacttcaaatagaaactttatttggtgattagtgatcatgatcgagctgaggaacttgtggttaattaattcttggatactgactgactgatttatctgtggttttttttgttttgggcagaggggagcacgcgttctgcagcgcggaatgccggagccagcagatggcgagggaggagaggcgagagatcgagatgctggtgaggcggcgccgcgacgcgttccaccgccggcgagcttcgccgccggccaagatcggtggacacgcgaggctgcagatcgctgcttcatgatttatatatacatatgacagacttatcgagatcgaggttcatctccgctagtttctgaacaatttttcaggagaaattagggaggacaatacaacggagacgtacggctactcattctgtcacagattttgttgtcctcgtctacttcacatgtataaattgtaattgtatttttcgatctcttcttttcgtctataaccagcggtagtagtgtagttgctgcagggtgtagatgctgcaaattaagttaagagtgtacaagaaagtagatgaaactgatggacatttgacaacgtgtttacggagtgtttgagatagattaagatgaaaataaagttagcatacgtaaaacaagaaaaccattaatatattattaattgagttaattgttataaactttaaaaatagatttatttgatcttttaaaacaacttacatacatcaagtttttcagacgtaccatttagcagtttgaaaaatatgtttacgaaaatcgagttaagataagtatcctaatcgaaaagaacgtgataactctgaagacatattcacttgcgtggacttaactgatggaatgatcgagctgagacccggaaaacattgtccagatcgaaaataaccatgaaaggttccttaatgcttttcccgaatttcaatcataaaatggcgtggacgttcagtatccgcatagtgcaaatgatctctcaccatggaagcatgagatctgggtgctcatccaacaaaggcctgtcgctttgatcaggcagcgactagctactccctctgtttcagattataatatgttttgactttgatcaaaatcaaattggttcaaatttgaccaagtttatagaaaaaatagtaatattttcaacccaagataaatttattataaagatatatttaattattaatttaataaaactaatttggtaatgtaaatattactatatttgtctataagcttagtcaaacttaaagaagtttgattttgatcaaagttaaaatatcttataacgtgaaacggagggagtacataacaatagatttgcactgtgacaaactatgaacagctagctgcagactgtcatctaaaaaacactgaaaaagttccaacaggatgtttatattagtgtatttgaggaagcttccgattcaaatgtgtactctcttgtgatagaaatcaactatcagggaatctgttagtagtaaatcaaccatctgaactagtatttatctgaaaaccatctgaactatccacggtcctgaactttgcataatgcccccgtttctgtcgctaccaatgatagcgaaaatttttgcataacacggacaactccaaaacacgcgagtacaaaatgggcctttagcccactcgcataaatgggcccccaagtcctcaacgatccttccgctgttactttgccgatgggcctcgtaggccagccatgttagggttcagtagatgggctttgacgatccaatagttagttggtcctttgcttcggcgggcaagaattaagaggcccaactctgaagatgtactggcagacctgaacttactacttcgagcatgttcagattgataccattttttaaagtaaagttgttaaatatgtgtatccatttagtttcttaccaaactttagtaaataaataagaaatcctgccaaaacttagcaatattactaaattgccaaaatttagtaagatttattttggctacaatctaaataggcccttcaactacgttggagttcactgaacttgttcgtaatagatatctcgaacaagaattaggaagtcctgagcattcagctaagtatttttttagcataataaaaaatgactgccagcctaggagaagcagccgctttggggtgggctggttgcctgcggccatggcaatggatagagatgccaattgtgccgttcaacgcacaactgaactggaactggataggaaggctgccaggctggaagggattcctagggtatgtctgggaagtttctacattgtgcagcttctcatgaaatcaaaatcttctctaaataatttagcttttgatataaattctaagaagctatagtagtaaaatgcagaaaatgaattagaaatcaaaagttgaaaaacctactacctcaaaaaattgcatttctagctctaaagctttgtcccacaaaaattgtatttctagccatgtggggcccagcaaattgattcatctagataagtttccttctctcagcttgtaatttaagtatgctaattatatgggttaattatctcaaacttatttttaatcatttgtatatatggaatgtgtgcatgcaatgggttcattaaataaggtcattgtggtcattttctaatcctactgttttatcctaaattagctagaaatgtaatttttatgagacggagggagtagctttttttataatctcagaaactgaccatctacgagctgtttgttactccaatcttaagcttctcaaatagacccatagttgaagagatgccctgtgttgctgcatggtctctgcaccgcacggcaggggagatgtgccgcttcatcaattggccgctccgcccacatgcaagatgcaacgccaacgcccagaaagtaggcgagagagacacatttcttcatttttcttgactatgaatgcgagacactgaacctgttctgcctctggatgataagaaccccacacgttccaactacgcgctgcttcaatttgtagtactgtagtactgtttagagcaggtacaatagcaggctacaaaccagctgcaaatatattttaagaagataaataaggagagagagaagcagcgggctacagatttatagccacctgtagcacggattttaagacgtattgtgtatataacatgtgggaccatatattaatagtgtagtatgtaactatagtataaataagctattaaattggctatagataaattggagctagtagttggctactattgaacttgctcttataacccgcaagttgccgtcgcctcccgccatctcgcatgattaaaagtttaaaaccgaaccaccaaaagcgcgacggcaaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctaggacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcccaattcatccctcatcagtaaatatttattgtagcaccatattgttaaatcatgacgtaaatagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatatatatatatatatatatatatatatatatatatatatatatatatatatatatatatatatatatttgctactcgtagtactagctttgactgtagctgcatcctgctgcctgcgacccttggttgctaccaacagatgatgctgtattaataaacgagaaagtgagcaggtcaagttggcaacttgacaataccggaattccaagaaactggggttggggagaaagttttggtattcgcaggcgatgcagccccgatctccgtggctcacccgtgtggccgtgatgccgttggtcgcacacgtttgggtgaggggagtccatggtgttgcggaggaaggtttggtaggaaggatcggcgagctcaaaaccggggaaagctcttcttcactgtgttgtttggcttgttgggtttcggattcgtgtgatgatactccagtttgatactacagtaaaatcacatgaacccgtaaaatgtactaatagtacggtcagaattttgaatggattttatagggttgatatccatatagtctaagagcaattttaatagtatagcccactactaagtctaattcatttatagccgatataatagtcaatttatacaatagttgtttactatactattaatatatgatcccacctgtcatacatatattgtgtcttggagtccgtactgcagctgactacatatctgtagcccgctactcttctctctcatcttttatctcattaaaatatgttcatagctagctaatagtctgctattgtacctgctctaagagcatccacaatgtagtccaaaagtgatccataagcaatataatatgtcattcaaccacctagtaacattgtgaaattagtacatagcaaaaaaataacaaaagctacccataaacatatgggctggaggataaaatatattatttgtctctacttcttctctccttctaatactatttgctatctatatacattatgaatgttacaatagttaaaatccatacatgtgggtcccgtctatatggactacttttgctatacattgttgttgggcccctttaaatcgtagaattgataaaacgtaggaatagaaaaaacgtaggattttgatagaaatgtaagtgtaaaacagaggattgaaaaaacgcaggaatgactgtttgattgaatcataagaaaaacgcagaaattggatgagagagatatactcaaaggaaagttaccaagaggttgaagctcttgctaaatttcctccaaaatctatataagattgttcatttcataggaatttcaaaggattggataggatccaatcctttgtttcaaagtgtttcttaggaaatttttctataggattgaaatcctccaaaattccaatgtttttcctctaaatcaaaggggccctaactacatgtagttagtaacacttacttcaatcaaatcaagtttattttaagttttgttagcacctgtaaccacatttcaatattgaaaagacttttgttgcttttaggttttctcatcttagtttattttagagcctttgtttctaaatcactaataatatatatatatatatatatatatatatatatatatatgaaagttttattcataaattgtttgtttgcaaatatgtcgtgggtctcgtttaagggcctgtttggttggtgccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaagcagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgacct

SEQ ID NO: 64542 - DNA, 4904 bp, Oryza sativa
acctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagcgcggccgcgccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaagatctttttggctgtgcctttgatgcaaaaatctgagtttcagttaatcaccatgtttatgttgtctgatgttcaagaaatcaagacaggattaatatgttcaagaattctttggttctttcaacatgattgatgaatcttttgaacaagaagaagatagtgttaggccgaacgcagcaacaactggtatgctttttgaacaaagactagaccattagttactgctactgcgagtgcaaaggcaaaattatctgaaacgcgctcctattcagattcacatgaaaggcaaaattagattcgaatatggatgaattaccccatctatctttacactgcttcacattcagatgcgactctaccaacgagaaatcaaatgacccaccagcatctatcaggctgtcgatcatttcggtggcgagtttatatcaggtcgcttcaacgaacttgctgtcggcagtagcaactatcatggcctccaaacagcgagaaaagatgctgctaatcttcgatcttatccctacactacttctactagtaccttcattgttccattaacatcatctccgtcaaaaaagaaacaaaaaatatacagagaaagaaagaaagaaagtaacttcaaacagttctgaattcttgaatttccctgtcgtgggatactgtatcgctgtgacaacacggtggtgatggccatagccatgccgtgtttgtctgctaatctgtttgttcctgtcactgattcccttcttgtgaaggcaaagctttgacacagccgtgtcaccgatggcacgaaacagatctttcactttctcatgcagtgaagttactttggctctcgacggcgacacagaacgatctctctctttcacaaggcgaaagaggatttgtaattgttcgtctcctctggtcaccatgaattatataaatttataatatgagtacaaccctattgagttttcatttttctgttttggactatttcatcaaagtcaattgattggagatggcagcagagattgttcgagcagaacgagtaaacaaaaaaggacgagatatatacatttgttaagcctcaacttgactgcgaggccacatacagagcccccaaaagctaggaaaaaagtagtgatatttcccccatgttagagataagggacacgaataaatatttgctatgtctagaagccgtccatgcgttcttggcagagaaacagtgaacctgttcaagatgctttctcaagtaggtagagttgagttgctcaactagcaattccagcatacgacaaagcaaatcgatcacagcaagagccagccaacttcaaaaagaaaagttttttctttcttttttttgggcaagttgaatcatggatgggaacacgcatgacagcgccatttcattgcattatacaaaccgaaacgctgcaatcatgtatggactctgcctgcacaggcccagctgggcaccattcctctgcttcttgcataccaaactcttctcttatcttcagagttcatcactgaattaaaatactctgttgatagtgctaaccattttctcctgtgaccaaataattgtttctgaatttcttctgcttgctaactgcccagggactagtaagggcctgtttggttcgtgaaataaaaaattttggatgtcatatcggacgtttgaccggatatcggatggggttttcggacacaaataaaaaaactaattttataactcgtttgaaaaccgcgagacgaatcttttgagtctaattaatccgccattagcacatgtgggttactgtagcacttatggctaatcatagactaattaggctcaaaagattcatctcacgatttcttccctaactgtgtaattagtttttcttttaatttacatttaatgctccatacatgtccaaagaatcgatgtgatgtttttgggaaaaactttttgggaactaaacggggcctaaatatgttccgaattcagaagaaaaaactgtcaaactaaatcataaacggcagaatcttgagtttcttttaggaagcaaaaggttgcaagtgaaatgcgaatcatgttcagttggtttctgttctattccatgagtgtccggactttttgtgccacattttgtttgggggggggggggggggggctaccagttgtgccccataccgctgtctgcatacctgggcaagaaccacggttttgtgtgcttgctgtgtagtatggatcatcagaaagagttcttgattagctaagcgatgacaaatacaaaccaggtttaattagtgcaagtgtcataaatctcaaaaagctagtcctaggtagtacttaaccggtcaatagaaataacaaaggagataggtattactagcatcacagtttatgatatgaaaatgaatggttagtgtcagaactggagctttacaaattttgttggatcagggagaggataagagtgccaactccattgcattggcttgttaaatactactagtagccactaattaacatgaaccctccaattgtatggagctagcttttaagtacctttagctaattaaacacccacttgttgatgcagcctactggcaaaactggaaggccgtactccgggaacggtttcggtatcgtgagatcgttgccttgttgtactggtaactgtgagtatggacgtcactggtaaattactgggcttatctatatcctgcagttactgaacccttgtcaaaagggcaggccatgtgcaaaccagacgatcaagaactcaattcccgtttataacattggagttcactgttcatcgcagtaaatgaacaactagctcgtacaaaatttctgcatataattatataaaataggattattgaaaaatttcacaaaactgcagatattttgataaaactgtcacaaaatcacatgtttaagttgttgtgtcacaaaatacgcatttaacatcgaatttatcacaaaagtatagatctaagctatggtatctcgtaaaaagcacatattaaacacataattaattgcaaaagctttgcaaaagtatatattgtaaaagttatcttgatgaaacttttaaaatacacaaagttaaactgggtacaaagcgataaatctgtagcttcgtgatatcatttcttaaaaatatagttttatgataaattggaccacgttgattatgtgtaaagctttaagtctgtaattactatggtactccctccgtcccaatatataaaaacctagaaccggataggacatttcctattactgcgaatctggacatgccgctaggaaatatcccatccggtgcctgtctagattcgtagtactatgaaatgtcccatccggttctaggttcttatatattgggacggagggagtagttttcaatgaagggtaaacggttttgtgaaatttactcaaagggattatcctttttatggaacttcttacgaaattctaacccaagggtaaactgtgtgtcaactgtcaaggagtagtagtaggaactgagcatccaggctgggagtttagaaattagaccaggttcaggttctgaaaaccttttggtgccaagcggtggaggcgacgagagagaaaggtcagaagtgtactcggttggtgcaatatgccgttcctatcctcaattcctccatcctcccacccacgacccttgagcgcctcgcaacgtcgtcggctcggctcgactcgtctcgtcgcccacgaattttggagggtcgcgtactgagctcgtggcccgcgtgaccatttcttttattttctccccctacttttcccgcgctgctttcccctcgcgccatccaagcgcccgcctctatatatgcgcgccgccaccatgtccagctccggcaactagctactgcgaagtgcgaactgatcagatcgtcgagaggaaacccaagatccaacgacgacatgtgtggcggcgcgattctggctaacatcataccggccac

SEQ ID NO: 64543 - DNA, 2704 bp, Oryza sativa
ctcctccaccgccgccaccccacgcccccgcaagtgccgccccaccaccgccaccgccacccccaaggcgacgacaccgaacgtcgtcgtcgtcgtcaacctcgtcgacaaagaggccgaggtcagcgagagctccggtgccagcagcagcgcgctgccggacttctcgtggcagggcatgtcggcgtcgtccgacgacgacgccgcggcgcagcaggcactcctcgacgccgccggcggcgccaagaagcgtccccggagcgagccccacgtcacctccgacgacgaagtgctcccggcgtcattcgacagtgacaacaacaccgccgccgccggcctgctcccgctcgacgatcctttcttgttcggcgaccagttcggcgacctcaacggcggcgcgttcgcctcgctcatggacgggctgttcgccgccggtgaagcgaacgtcgccggcgagagcgtggggctctggagcttcggcgacgactttctcaacgcgtcgtactattagctagggcttccatagttcttgtactttacttgtactgtactgtattgtactgattgttaacgttgccataaagcaatcttgctagtttgtaattctgcgtgtgtggtcgaaattttcatgtttgtgttgtttgaatctgtagttgtcgtatcgtttggggtgtgtttgatttgaacctgtgtcccttctgaccttgattcacctcaagcggcaaaggagccctttaacatgtgaaaattttgacagaaaccgggcctgatggactgcagtaaaaacaagagattcagcgtgcatgtagctgtagaaaactatgatccaacaggcccaaacaacccaattaatctgaacattcagaaagacaaatatggtcaattatccatcatggcagtaaaaaagataggaaattagtcccatggtgttatgtgttattatacttgtaggttgtaattcgttccttctttattattattgtattcaaagctacttggcttcgacttgcaacattaagggcttattcgtttttgaaggattttaacacacatgaataagaaaatgtggaggaataggaattcatgcacacttcagtctatatgaattttccaagagatttgagtggataaaaaattccttaagtttcttctctacaacttgtaggaaagggaaatttcctttggtttctatgggccggttcaaatcaacaagctgctatttgtggctaagaaaacaggtgaattattagcacatgatatatgtgctattataaattttaaaaatatatttatttgatttttttccaaaatacttttacatatatttttttacacaaaacacattgtttatattgatctagggaacgtgttatttgaaaacgaaaaacaagaaaattgttatttcgagctgccgaaaacgaaactcatacttcttcgttttcatggagagatagatcagagagtttcggccacaagttccatggagctcgtactgcttgtgctgtgtagtgtgtactcctacttattcaattagggcctgtttagttcgcgaaaagaaaatttttgggtgtcatatcggacgtttgaccagatgttggaaggggtttttgacacgaatgaaaaaactaatttcataactcgcctggaaaccgcgagacgaatcttttgagcctaattaatccgtcattagcacatgtgggttactgtagcacttgtagctaatcatggactaattaggctcaaaagattcgtctcgtgatttctcccctaactgtgcaattagtttttaaatttatctatatttaatactccatgaatgtgtccaaagattcgatatgatgtttttgggaaaaagtttttgcgaactaaacagcgccttagtagtacaacttgcgacaagttcttttgctcctcaagtacaggcccaagttgagtcacaactcacatctcacaagttgcgtggccacaagaaaaaaaaagcgtcgggaaaaaggtagtgtctagtgctaacgacttggagcagtaatatgcatttatgctttcacgtcggtaagatgtaatgggtgcctaacctaggccgtgctaatcctatctgttagtttggccgtctttagattcaaaattttttcttcaaacttctaacttctccgtcacatcaaatacttggacacatgcatggagcattaaatgtgaacgaaaaaaaaacccaattgcacaatttgcatgtaaatcgcgagacgcatcttttgagcctaattacaccataatttaacaatgtgatgctatagtaaacatttgctaaataacggattaattaggcttaataaattcgtctcgcacattacaggcgaaatttgtattttgttttgttattagtctacgtttaatactttaaatgtgtgtccctatacttaaaaaaattttagcacacgaactaaacacatcctttatctgttgactataaaccattttgtgccttttgtgtgtgcattggtccatgacacatggatgaccatagtgagattagtactgctgaaattgtgttcatctaagggggaaagagggaaagaggttgttgatcagagtgagaggatggggagtctaactgtctacgctctagtacttccttcgcatgataagttaatatagtacggaatataatatatcccagtactataaatctggacatacatccgccagattt

SEQ ID NO: 64544 - DNA, 6236 bp, Oryza sativa
  unsure (1)..(6236): unsure at all n locations
tgcgtcgttatgtaaataatattagggtatcgtgtttcctaccagaacaaaataattatgtaatatgtgggtgtttactttccagctcatcatatgatcaagcatcacgttatataatactaaatgattgatcttttttatgagaaaccacaccatcatcatttggaaaaccaaggttgaaacagatgttgcggttgtgttgatggatttgggggtcgtgcacacggtgatcgatagatgcacgtcttcacgcgctaattatttttggtcaagactcaagagagccaagtatagaatagccgacagaggcatgtttggcttaattaggctgagaccatgacaatttttcagagagtttgctgatgataatatccgtcgttttagatgcggtaatatggtacttagtaaaaaaaggagccgtggatatgatgatattatcaaaagaagtgagcctcttaagctccgtagactagttagtttcctgacatccattaatttgctaagtcgatgatgtgggagaacttagcaccaaattgtctaatttagagttttgactacaacagaaaatgaagtggcattttattttattccggttactttgtttatcattatctctaagaataatttattgatatatgaaagttatttcagtacaatcgtcaaaaaatattttcaatattatgattttactagtttaaaataattactcggaatccacgcggcgttgttatagtacatgatgtggatggacgtgtgcgtatatatcgacacggtgcgaaaattgcagtagttggtagtagtatgttttaatatttagaaaagtaaataaaatatcacgagaatagaatttaaatgtctaagttctggagatggcaccgtccattttcaaaactttttcataaacattatgctgatcactgtcatgtcggttagctgtacgcctgtactatttgtctattttcagagtgttttaatggcttctagtactattttttttattttcctcaaaagtagctcattttattaattatactcgtaacatattttagtcaaactttaccagacaatatcctaacttcgcatttctagctatatgatactatacgatgtgattttcggaagaatacactcgataaaacatgtgggctgacatgacacggcctgtccagtgaaccatatctaatcgggcagtgcccactacccagacatgcatattattatttagggttatttgtaaaatttgtccatatttttttaattttgcaagatgctactcgaaagacagttctagtagtatttttacaattttttagtggcagtgttgcaataataattaatgatttaaaccagtggcaaatttgtaattgcctttattatttattatccaccatctcaatcatatactccctccgtttctaaatatttgacaccgttaactttttagcacatgtttgactattcgtcttattaaaaacttctgtaaaatatgtaaaactatatgtatacatataagtatatttaacaatgaatcaaataatatgaaaaaaattaataatatttagaaacagagggagtaataaataaaatcatgcaattccgaataataaaataaaataaaaatctaccatcccaaaggtgtcctatatgttccgtttggaaaatagaattaagctatggatactttcttttttcagatttgcaccgttttggagggggataggatatgcagattgagagtgcttggcgaaattactaaattaccctcgccgtttttgacgtattgttttcgtgagttatccgttagttcgcccgccgccgccgccgccgatccccatccatcccgcgaggcgcgagcgagcagggcgccgtcggcgccgtcgttcgtcatgctgcttccgccgcatccaggtgagcacatcctccgccaccgccgcctgcgccgattcccatccatccatcgctcgagcgagcgagcggggtcgccgtcgcttgtcctgctgcttccgccgcatcccttacgacgcacatcctcttgtctcatctccctctctccacccacgcaattttttttctcgaatttgcgttaaccctagcttcgttgtagtagaaatttgccttaaccttaatactaacaaatgtttgttccgaaaaaagtttggggttggggggggggggggtggggttcaacttaacccctatgtcccatgtcagatccgccactgctttattgtgtgtggcgcattgtctcttagctcttttaaggaaaactaactatcgttctctatgaaatctggctcgcattttctttcaaaaaatctggctcgcacgcactgctggtgtaaatatgatgatacattgtaagaatgaaatatagagttattaagtttagtttctttagcaagttattaatgattcatacactgtttatgagtgtgccattttacccaggtttccaaaggctgcttgctggcacagcttggagaacgtatatggttagaacagtgaaaaaggctttaaaaccaaatgaattattctgtttcctgtcatttcctttaaatatcacgcgatccaaacttctagccctaagtgtggtaagaaatcactgtaggatgatgcatcctcacaagccgtagagcagcttgggaaaaactggaaatttaaaactgtcttagctaaaggaattcttgctgtccgcatattactttcatggttaatttggtgtcaaattacatgcttatcagcatttttagtgctatatgtctggaagcactatatacacaatgataaatgaggtaggtagtataggctactagacctcttgttgatgtctagttccattttgtcatgaataggaaatgctagtgcatcaggatagtgaatattcctccgggagagatcagacggtgacatcttgaggtagaagaatgataagtgaaatctattgaataacacatgaatagaatttcactctattagggtccactaagccaaggctagatatgttcttttccatagcagcttgaaaacaccagccgttggttatctgttatgtactataatatatactgcctctgtaatgttggtacctccatttgtaaacatgatggtttggagatgggtggggtccccaataataaaagactatgtgaataactcaccttttatgtgaaactaatggtatcaatttcacatcaccatcttaatagaactttatatatcagtggttagagttaaagaagtatatctgtggagattctaaatcatcaatcattaactctttgtactttgaaaacagacatatggatgtgtttttgtgcattgaaaacctgtttgaacttaattagatgatcggttggtactgttcttgcaagtttccttagccccattcttcttgatcaaggttttcatctacctctatcttccaggatgcattgtattgaaaaaatgtttcaaatctacttctagttaggtaggtagacttccagcctttattttcctctctttttgctatcatgtttaagaactcaaagcacaatggaacttgtggctaaaactcacagcctcactggcagcgtgatagaaggctaactgctagtgcaagtaatgctgagagcaaacattatatgagtgggcatggtatgttttaccagagtaatgcgcttgattaatgggctgaaattgtaatgaaccttcacatggacatgaaacagaccagctgaaattgaatggcttcttcttccctaaattgctttcttgatttccctattacagcttcctctgccctgcattcatccagataggattaaattgttaaggcacatagcaggtctacattaaatggcccatacattttatccaaatcttacccatatgggtcagatgtgtatgattgtatgctctgatctgtagcggcttatatttttccttttagttaattgtaccgacaagctgggctccacatgatatttatatgttttggtaatgcaaccttttcgtaaaagagaactattcgttattttaacatacaaacacatcctttttcatttcattttttagaagttaattacgtgtgaatgatcatagcaggtcatgtatgtgaacactgctgactcaacatgaaactgccactgataaacaaatatagaaagaaggaactgcttatggcactatgatttttttaaaaattttatgcactttatgtacacttgttttcgcattatgggaatggggtgaagtggaaaaagaaagttgtgccatggccatctgtatgtccaacttctatgtatctatatatcttgtgtactgcgaacccttcaatctgaaacatttagttttcgtccttattcattactatgctattgtttcttgggtttcaggcagaacattaccagcctatcatggagacaacagatttcttcttggagcttgtttcctgagtaaactgcctatgctgcgcccaatgaagttgtctttggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctggacaagcaaaagcacagggtgagaggggcagtgttgactcccttctaaatctgcttaggaagcactcagtggaccaacgaagaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcanattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaaagtgttccaattnattgatgaatctncatgatacgactctgaaatcttccttaggagtcctgatttaagcactttgaaggtcacagaactaagagaacttgcgaaatctcgaggaatcaaaggacattccaagatgaagaagaatgacctggttgaactgctgagcaacatggcttgatccatcagcagccctgtcaacttggctctgttttgtcccttgttagtcacattgtcttgggcatatgcactatcttgccattcctatcttatctagatgaagttcttttaggtagaaaactgtaaatgagcaaggtaaacaatgttctgttctggttttatcgttgccctttctgttacctagcctctagttaccattgtttttgcgtaaatccttcatcagaattgaaccctggattggccataagactggcaacgattcgacgtcatgctgattatgttctgatgtgtagtgttctattcttatctctgttgtttctcctttctcatggcagctcttgtctgctgttgcatggtttctctcgtttacatccatggttgttactgaacgtttgatgcacaagtcttttgtgtgttcatgaaaagaataagcagaagcaacctataatggatttctttggtgttcaatcgtttactgtctttgttcagagccaaggtactgattgggaggatttcctgggaattgtctgcctcccgattatcaattcaacaatcagcttcattaaggaaaacaatgcaggcgatgcagctgctgcactcatgtcccggttggcgctaaaaacaaaggtttttttttctgaacagaaatttaaaaattgcaagtgaatccattgtgctagtctgatcttgttgtatacatggatttgctaccaggttcttagagatgagcagtggcaagagcttgatgcttcca

SEQ ID NO: 64545 - DNA, 1378 bp, Oryza sativa
tgggatacactctttctttggcaaggcagctcatctagtggactccactgaggttgttgggcattttcagaaggtgattcatcaatctttagactgtaataagattataagaacctcacaagtggatgtgctgtaagctgtttctaaccactgaattttctgattcttacctccataggcaacttctgtatctactcaatcgccattggtgtgattgttgaggttataatcatgttcccaatccagcaccggtcataccgagatgggattacgacttccctctgtttatggttctgatcatagccatactaaatgatggtgacgatcatttctctctgaattttactgtttctgaagcataaatatataggttcggcatctgctttgatcaggaactatcatgacaatatcaaaggatcgcgtgaagccatcaccaagcccagatacttgcagctggagttgtcatcgtagcctaccttgcattggtcaccatgctgttctatttgtaactcctcaataggcttcatgtctgcacattaccagaagcaaattttcagatgattgcataaaatagataacaaaacaaagtatgatgatcagcaaggctgatatcaggtaagcatacgtttaacttcgtttgaagggaatgaggtgaatggttgctgctgttcaaagtgttcttccattgcagctttgcgttttcttctccttatcacaaagaatgcaaggactgccccagagcttccaccaaaacatgaaccaccattgtcttgacctgggctgtttggacggtttggtggaggggggagctgtatatgatggaggtggtggatttccgtcaattctgtacacaaggatcataataggtcagtgtacaactctcatttttgcatgttcataagccaggagaactcactgtagattgtttaacttcttaatttgactaggaatccagccagtgaaatgattttttgcaacattcctatataggaaagcaaagatatgagatgtggtactgcacgtgcaaataaaatattaattacttataggttgatttcttacagatcatcaagggagagattagcaaggacattgatataaccagtaaatttattgttctgcagatatctgagaagaacgagtatgggatcacaggcatatcactctaaaaagacatatctatgagataaaaataatccaaaaataatcctttttcttacaatgcctgtaatcccatgctcgtagatatgcctgtaaacccatattcgtagaaatatctatttttatctcatagaaatacacacacacatacatatgtacagcattcattataagaaacgtgataacaaaaaaaaaagaaagtcactttttcgagttg

SEQ ID NO: 64546 - DNA, 26526 bp, Oryza sativa
  unsure (1)..(26526): unsure at all n locations
ggtataacttgcgacagacgttcttttgctcctcaagtacaggcccaagttgggccacaagttgcgtgcccacaagcaaaaaaaaaaaaatcacctgtgaaaaggtaatgccaagtgctaacgacttggattggtcgctgtaaactcacgaaatgcatagtaatatgcatttgtgctttcacgtcagtaagatgtgatgggtgcctaacctaggccgtgctaatcctatctgttagtttatctgttgactactgtgcatcattttgtccaactttttttagaattacactattttgtccattttgtgtgtgcgtgcattggtctatgacgtatggatgaccataatgaagttagtactgttgaaattgtgttcatctaacggataaaatggggaagaggttgctgatcagtgagaggatgggggagcctaactatctactccctccatcccataaaagaacaatctaagatggggcatgatatttcttagtgcaatgagaaaacgtcacatattatcctatgttgtttttttgtggacagagaacataagaaaactagagtaggaagcatattctggaatcttctgcgagaaatgtggtttcagcggtttttggtgtggttttacggtatgtgcacgtttgtgttattatgtaaataatattagaatattttgtttcctataaggataaaaataattttgtaatgcgtaggtgtttacttttcagctcatcatatgatcaagcatgatgttatataatcaaatgatatacccttttttatgagaaaccacaccaccatttggaaaaccaaggatgaaacaaatggtgcaattgtgttgatggatttgggggtcatacacacggtggtcgatagatacatgtctgcacgcgctaattatttttggttaagtgagccaagtatagaatagccgacagaggcatatttggcttaattaaactgagaccatgacaatttttttatagagtttgctgatgataatgtttgtcgttttagctgcggtaatatggctcttagtaaagaaatgtaccgtcgatatgatgatcttttcaaaagaagtgcgcctcttaagctccctagactagttagtctcccggcatccattaattaatttgctaagtcgatgatgtaggagaactttgcaccaaattgtctagttttgagttttgactacacaaaaaatgaagtggcattttttttatcccggttactttgtttatcattatctctaagaataatttattgatatatgaaaattatttcagtacaatcgttaaaaaaatgtattttccatattatgatttaccaatttcaaaaaaaaatactcgaaatccatatgacagtattctagtacatggggtgatgtggatggacgcgtgcttcatgtatctacacggtgcgaaaattgcagtagttggtagtatttaggtttccatatttaaaagagtaaataaaatatcacaagaatagaatttaaatgtctaagttctggagatggtactctccatgttcaaaacttgatcataaacattaggcttcagggtgtcatattggcccctaaattgtttccatgaagagcgctgatcactgtcatgttggtaagttgtgctatttatctatttttacagtgctttagtggaatcttcttctagtactattttttattttcctcggaagcagctcattttattaattatatttgctgctttgccaagtaagtggagcgtggtgaccacgagccacatattttaagaagggagcattgaacttaccattcaaggatcgatcgcgatcgattcctaaaaaatagccataagtgcagaaaagcattgggaaggagacatgcttaaaaaaatgcggatggtggataataacaatgctaattagcctgtcgtctgctctaatccctttagctttgttgttgatctgttctctagctaccttaaactgaatttttgttgttattggagagcttaattgttagtatttgtggaagtgtgtgacatcattgctgagtaatcaacttaacctatagcatttaggatcctttgtggagggaaattagtaggcttgcctgaagtgttaccccctactccaccttctagctatcaatcattagtttgttttactagtaaccacgcactccatatcacttggtttttctctccaagttaaactttatttactacaacacctaaccagtttttattaaatgtatattaagaatatttgtcattatatttattttcggttagaaataccgctacatctttatcctcacaattaatatgaacagaagtagttgtcggtacctgataaacctaattaaagataacatgtatagcattagcttgtttaggtttaccggattattattttcatcgtttatttattggcttatcaggctaaagtaaatttaaaattataacttaatcttagagatgattatttttgggtcatttttcatgttagcctatttattagccctttgtttttagactgccaataataacaccgatataaaatttttacttataaattatttttcgatgtttaatgaaacttaccagagcagtactctttaattaactacctgcctttcttattacaagatcaactaaaaattttctccgcgtaaagctaaagctcagtgctgaatctacagtgccatgatcacgcagaattggtgcgggataacttcgtggggattcgcatgcaaggtgataattagttaagacaaaaaaaaacagaaagcaaagttttagtggcacacctagggtgtatttagttcacgctaaaattgaaagtttctagctttatatgtgtaggaaaattttaatgtgataaaaaaattaaaaatttattgaaaaagtttggaactaaacaagtcttaaacaaaggctaaccttatctcgcgcgaagacgcaattaggcgtcctttttagagttgattaatttttggggggccaagccgagcggagtggaccgtgacgaggacggaggatgcatgtgtccgccacaagccagggagaggaagagaagagacgccgcgacacgacacttgcctagttctcgtcgtctacgcatgcggcgctcgtaaaagttgggcgttctccccgagtactggcattatatatcagcagtaatttttaggtataaattgttttaaaatatcagataaattaatttgtattcatatatctttacattctttaacgtatgctaaaaagaatttaaaaaaaaagacaagcaaaaatatatttatgtgtgtgtaatatctgtgagtagcgggatttgaaccatgatagatagtcatgcgagcacaactctaccacctcactattagtgttttctcggaacttttctttatacggtgtcgttcccaggttcttgccttcggttacttcggatgtcaaggatcctcggatttggccacatggcacctgtagttctagctagagttgaaaaaaaaaagagagatcgagagaagagcacaataggagtagggtataaacggctcgaacctatataaactgcttgcctcccgctatgtcaagcatccaggacatagataatatgatttatctaattaactaccagatattttcaacgctggaattcctaataatttccgaactactataggtatatagatttgatcactatatcgtttagatctttcaattatgatgaacaagatttacatgtgtttatattttcatgtaatttgcttgtttagatttttgttagtcttttttaacaaaatatgagcgctcaaactaaaattacgtgaaatcaaaattgccaagtactatatgtaaaacgacgaagggagtaccaagtgaatgcttccactaacacagggacccaacgatactacgataaattcccaaccttatcgctacaatcaaataagtacttgctccgtttcatattatcgttccactttttttattgttaaattttattgtgtttaaccaagttatagaacaatttatcaacactcaaatatcaaatcagtttcattaaatatagcattgaatatattttgataatatgtttgttttatgttaaaaatacctctatatttttctataaatttgatcaaacctaaagaaatttaactggtatatataaaagccaaacgacttataatatgaaacgggggagtagaaatttaactggaatgatcttttttttttcaagtcaatagatcacacttttagaacaccatgttggtcaccattcacggctgcaggcagggcatgcattgcatggaccagcaaaataatatcttcccacttgggttgaatcagtgcagtgtacgcatatgcatgcatgagtctacaaatatcttgccacttggacagaagattagttcgtgtaggccacgcatctatccatccgtagttaattatcatgtttgagctggcctcttgagtgtgccgatatagatctctggtctatgtgaatctaatgagaggttgagaaagagagtaggtttgaaggaagggagctctgctcctatgattatccattcaagtgcttggtgtgaaagaggtgctcttctatgagctgatcacttcactgtaactcaattggggaataagatggcattgtattaaaaaataaatcaagacatatttctttgcctcaacggcgaagccgggatttagacatgagaagggactactccatccgtctcaaaaaaaaaacctagaactggataatatacattataatacaacgaatctggacacattatagtactatattggttttttatggaacggaggagacctaatacaccattatttaggttaattaattaattagttagataactatgtcaaaaaaatttgttggaggggacagaccactccgcaattgtttgcctgttagtatattactagaagaggtaaaaaaaagtcatcatactatttgttatgaaggtttaatgtcaccattgtaatttttattttaaattctagctcgtccagaattgcattataaaaaaccaccagtttatctttgtatcaaataaaacaaaatgtcatatgcgctcgagaggagaaagggtgatactgtgagaggaatatgtagtgcaggtgcatttggtgtgtgttgggctgatgagttggccgagtgggggcatcatattttgtttagtggaagctcatctttgaagagtggatctgagctaattatgaggaataaatatataggtgacctaattaaaggcactaacataaaatcagagagtattttatacgctatcaagtttatgacattgaattcgtctctctctccctttatacaataacttaccagattaggcatacaatatgtatgagcggcacttacttgacaacagtcatatattatcgagcaaaacttcgaagttgtgggcataaaaagaacataggcgaaatcagaacatattacacaatcagagcaaacttgacactacataattaatctatatcttttatatagttacagccactaagcatcaaatgatcaacatgcaagtacaataatatagtacatattataacttaaaatacaactatactacatcatttacaaattactaaaatttaaactcgatatataagcctggtaaatcatcatacttattatatcattttcacaatatttgaaccaaaactcatcaatcattctacaaaatttaagatgtatttatttgtatatcatgcagcaaaatacgggatgtcatctagctttttaaaaagttgacaccttgatgctccaaggacatatatgtgccattgaaggagttaattagcgtagctacgttgtccacccgcacttttttccattttagtaacaaactttcaactcaaaccatacaagtgtttttcaagaaaccaaatcatacgaattataacttaaaatcatattaccaaactcctgactatggcctcaaaacatccatcaagaattacacaattctaaactaaaactccaaaaacttttatcagaaaatatgtgccgaaaacacagctgcgctaaatagcaatttcggataaataggtggtgtttgaatctcctgaagatgaagataaagacaaagattaagtgttttacgtaaaacgagatggtaataacgtgtgattaattgagttttaatcattacaaacttgaaaaatggattaatctgatattttagacaactttcatatagaaagttttcgcacgaaacacaccgtttagcagtttgaaaaacgtgccacatttatgctaaagtttatccaacttttatcggagattcaaacagaggcgagacatgacgtggcacgtcagcttgggggcatctgtgcgcgacatctggcatgccagtacgtcatccgccaactcatccaaatttgtgtttataaatgtactatatatatttttttccctccctcggttacaagaacaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtggtaatgttcgtcgcgtgcgatctcgtctaggtgttcgatcgtgatggcgatgagttcttggcttgatctcaccgaggaagattggtttggtttggttttgttcgtgcagtcgtcgccgggcacgacgggcgcgcggcggctagggcggcgagcaagaagaagcgggggcggcacttccgaggcatccggcagcggccatgggggaagtgggcggcggagatccgcgacccgcacaagggcacgcgcgtctggctcggcacgttcaacaccccggaggaggccgcacgcgcctacgacgtggaggcgcgccgcctccgcggcagcaaggccaaggtcaacttccccgccacgcccgccgccgcgcgcccacgccgcggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgtaagcatctgaattcacttccattttaatggattcagttaaaaacttaaaatccatctgttcatcaggattatatatcttgatcagataccatgccatttcttggttcaggttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgcaattttgctttgtttggattataactgctgaaaaaatagagggagagaaagacaggtttttttttatcgtctgaatttctcatttgccaaacagcaatcaggtagatgatcagaaaaccattgttcagtattcctttttttctgaaaacccgtacggttttcctatctgctggcaatcctgtttgccacaacacttgatcagttcatatcatgttttatgttgcagcttgcaaaattttttaaaaaaaaatctgtcatgttttatgttgcagcttgcaaaaattaaaaaaaaaataaatctgtctttttcagcaagtttttttattcaggaacagtaccgctactacagggatgtgaaaaccgacgcgcgaaacggtgggcgccttatgaaaccgtggttttgcgatttgattagtgatattttagtcggcaatttgcgcaaattgctcttatctttcttacctagatgaggccatgacagtgactttgctcaactaaattccaaattaagttggggttgcaggattctcaagcaaatataaaagtttaggtgcgcacacgcagcaagcaaaggcaaattacctaatgaggatgagcagagaacttggcaaggtctgcagggactagcattgtttaaatgcaagttgagtgtgccatggcattatacaccaggaccattacatgctatacctaatctcatctccttcagaaaaaaaaaactactagttgcacacttgcatgattgcatctattatactatgcatgtagtcgtagatagctcgggaagatagcccaattcggtggtccatgattctccattgaagattggatctaccattcattgttcatttgttcttgatataaagttgtgttgagtttcaaatggctacttgaacctgttccactatctgaataattttccctgcagatcctaagaaaaaaaaaatagaatcttcaattctcttgatgataattgttttcatggcttggagggtttgcacaagcttttcttatcctggcatagaactttcaggatcaatagaagaaactgaataattagtaccatcataaccagctcctaacttcttttacttggagaactaccagttggccatgcttatggttgtggaattgcaaatagccctaaaaattttcctctagccattttgtggaattcggattttggttctgaattccatcaaacagatagaactcctccaattaccttcatttccatcgaaaaagaccggtagaacgtgaccaactgcctattcacaacacacaaacattgtgcaagaatttgttagtactgagtgctccgttaacaaaacttcaccaaaagcaaaagaagagtatagatgaacactcatatacgcttcctttcaaaaacaaaacagaaatcactcacatatgaaaacatagatcaccgatctctgctgaaccaatgcaccctgatggaaacaacagccttcagagttcagagttcagatttcagttcagacacccacattggacatcatagtatgcatctgaaaaaggagagaaaacatgaaatggatcatcaacttgggatgctataagtagcaaagaaatgacatggtggggttacactgttacgcttgatggcatgaaatctaagggtttctaaccctttctgcaaatgaggacaaacggctggtcttatactagtgttactcatggtttgatgcttccaaattctgaactttatgcaagtctgtgggagtataaccaaccctgggtaaacactaaagacaggctgtgggctgaaagaagagcccatggtattctttcctactgttttgtgctatactaaagtatactcttttcatgacagcatctacaccggttcacattagctccaacctattctaacaagattttgacagtatcatttggagggtatattcagaaaacctttctttgtgcacgtggatatgattttgagttttgtcataatgctcacatgccagagagagagagagagattaagacatcactgtgtgttttgccattggacattggacagtgtttgggcgagctccacatgttagtgactagactaagagcattaagatttacaattgttgtatattcattcatatcatcaaatgctccttgaataggactcctttggattaaaggcacttcaaaggaaatttggaggattttatttcttcggaaaatttccgtatactagctcatttagaacaaagggatgccattggtccatctctcataaacacataataagatccatgctgcagctggctacaaatctatactctagtatgattttcttctctctctcttttcacatgcgcttgtagttactccccccgtcccattttaattgcagtagaatagtgtgggtttctgtatctaacgtttgactgtccatcttattttaaaaaattaaataaaataagtcacaaataaagtatcattcatgttttatcatataataataataaaaatattgtttataaaaatatttcaaataaaacggatgataaaacgttgcgcgcataaacccacaattacatttaaaatgggacagatggagtagtttatagcatgctattgtatttgttgaacccttaatcccagaaaatctccacatctactgaaccttataggtgtgtttggcaaatgagttatgagaggtgtgattgttaaagggaaatagatgaatggctataattaaatgaggtgagaagtatggatgctagtgtacaatattaccctatcctttttttcccaataaagtctatgtccttatcccagtaaagttcacaacatcgaatatccaatcaatttaacctgcaaccaacttttgccacaatttttttaaggagacgaattgacaacgaggcagcccacagacttcggcgcccacaagatcgggagatagcggcccacggagactagacagcccatccccacatcagccagcgacggcgacgccgacgacgacgacttttcctctatttaccactctcccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttcttgtacgatgagatggagaaatcttgcctgctttcttgaaggattttcacctgacggcaacctgaactttacacgatttcttctcctgctgttgatttcatcgatcgccggcggcagtttcgtcggatgtctcctcgagctccaggccgcggcggcgcgtggcggcggcggcggccggtcgtcggaaggcgagcaagaagagcaagtacaggggcgtcggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcaggtactaccacctcggaggatatctcaagatgtattaatacgtgatatatcactttgtaaatatgcatgtttaaaattaactcctacatctcaaaataaaataaaacaatttaattgtgaatatacgttaactagttatagtttaatttatttttttttcgtttttatttttttcgttgcgggagtagaagttgaatttgaatttgcatgtgtgctggcggagaaacttggctcgtaggctcgtagcatggagcattgccctgttcgcatcatatcatacggttgagctcgatttttgcgaaagaaagaaaggattccaatattctcactgatgaatgatgatcaaggttgataaaatgagcgaactcgatcaaaccaaaccaacaaatttcgaagaatcaagtagatttactaatgtattggcgttgttggcttgttgccgtcgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgatagatttaataattacgtactacctctgtttcaggttataaggctttctagcattacccacattcatatactccctccgtcttataatataacaacctaataccggatgtgacactttatagtacaacgaatatggacatgcttcctgtccatattcattatactatgaagtgtcccatctagttataggtttctatattatggatggagggagtatatgttaatgaatctaggcacgtatatatatgtattgattcattaacatatatttaaatgcgggtaatgctagaaattattataatatgaaacggaggaagtaggtgataggatcgtaaggatgttcatcatctgtataattgtcccgcatgtaaaaaagacgaaatataattcgtgtcatcacatcaatcgtatgtgattgctcgagcgtatttactagtatcaatatcatggttcctaccaaaaataaatcgtcgtcatgaactcatggtacttttaatagattggtatcatggaatgaataaaatggatccacttttttctaaaggctcctatttcaattttttttttcaaaagtggcaaggccttgttcttttctccaacaaaagttcgataaaatttttgatacacgctgcacgcttttcaactgctaaatggtgtgtttcgtacgaaaactttctatatgaaagttgctctcaaatatcaaattaatctatttttcatcaagtttgtattgattaaaacttaactaataacacctcaataccatctcgttttacataaaacacttaatactatctttatcttcatctttaaaagaaaagaacaccacctttgttaggattagcaattctagttgttgcttatgccacacctttggttattagcaggggtgtccatgaaataaccaaaccttggaagggcacatgcgcatttctaccagcatctttttgcatccgcggcacacgaagtaggagtataaggatagctgagggactaaagcgaaaaaattcgcacgaacccgaaaacccttttctccatcgcctccccctccgccgcgccgccacttctctcctctcctcctctcgccgctcccagggtttcgcgcgagatctactctagcattcgggcgttagggttccccgagatggcgagcgagcaggcggcggagagctacacggtggaggagctcgtcgccgtgaacccctacaaccccgacatcctcaacgacctcgagggcttcgtcaacgatcaggtaaaccctagccatgggatacttgcggccccgtttgattttgttcgtgtgattgttggaattttgcgaaggattggtccgtggctgtgctgaaaaagcctcgcgccttctcatgtttacatggtccgcaaatcgttaaattctcctatgaaaaaaaaaatcctgattcatatgcgctatggcgatagctagaaatagcagtatttgtgtatttttttcgggcagactgtagtggagcacatcgttgtggaggagttgtgaattaagcggcagcacttgtaaagagaatggttgctgtttggtacatcaataaatcttattgtcagtcatctcaatgctaactgatggattttcaattgataatatctgttgtcgttggtcatgaaagtggcaagatggagatttcggtcagatgacacacattcatatcaatatttgacatgctgtttggcttacgatttataaagaaacaaactcaacagaccttttttttgtgctctagctattgtgagtatgtgcatgcatcttttgtagctcatctgttttattccagcatataaagaaacaaactcaacagacctttttttttgtgctctagctattgtgagtatgtgcatgcatcttttgtagctcatctgttttattccagcataagtttttggttctaatgctttcaaatttaccgaccttttcttttcatataggtttccaaccaaacatataacttggatgcaaatcttagtcttcttcgtctgtaccaggtgacagtccatctctgtacaaaccgcttttacccatattttggctcgagttatatgtttatttaatgatgcgtttccctttgcagttcgaaccagaaaggttgagtgtgcagattgtatctcgcatattgattaaggtcagaaaagaactaatgttaacattaataaataaacaatggttttttgttgatcacttccaactgttttgctctctttatgttgttctattgacaggctctcatggcaatgccaggcccggacttcagcctatgcttattcttaattccagagcatgtggtacggaaacaattccctgcctcatgtatatgtcgcatcaaaaactatctatctaataaaatgctattgcggatgcatcttaaatagtatcgatacccagtgatctatttgttttggtggtgattgccaaattgaccctgaaataacattatcatatatgtatgcctagagatgtgcaatgtatatatataataacatgtagttgatggaataaaatcatattcaccatggatttggaatttaaatatttgtgcaagggaacaatctttgcccatttagtcttagatatgtagatataacagacccgaatactttatacattgtgtttattatagctgtacatctagttcttttatttgttgggctctgttctcttatcatgtgagttttgaccactgtcctctatgctcttcttatttcagcaaatggaggaacagttcaagacgttgatagttctctctcactacctggaggtatgtatctggcttgactattgtatatatgttgaacagttagtgggataaccactgttaaccgcaatcaacgtctttgtagactgctaggttccgtcaattttgggatgaggcgtcgaagaaccgcaacatattggatgttgttccaggtatgtcttgtggaattggagccatgttttgttcacacgttgtgaagtggtaattgttgcaagctagatgattgtactggtatttccccctccattttcctgattgatttggccaattgggtgtgactgataaactgtaccttttctgattactttatttcagcattttctcgcacaactcatattttagaaagtaactttgtgacttatcatcgtttagacgtttaccatgtgtttatgtggcatgttcatgcccgcgttgtcatgtaaatgagtatgtattagtatcctagatgcccagagattggttaccatatcaagcagtcttgagcgaacttctgtttgattctttctactgactactgaggaattctttttaatctaacatgaactacctatggattatttttatgaatgtttgctatattggacactttcttatggcaattgatatggattctttccgtttgacctaatggtgaagtgttttttttttttgaaacactagtgaaggcttacttaactaatccctttacaggttttgagcaggcaatccaatcctatgcgatacatgtgctctccttgacataccagaaagttcctaggcctgttcttgcggaggtaaatgatgtcattttaaattaattattacacgagtcctcgagggagcatgagttttcattcaatcctttttgtttaaactttagatgaccaaggattcgtggtaatattaagtttcatattactaatgctacaaatatttgttacgccagaagtgtcaccatcatcatccaaattttgctatcatttaggtgttattggttgcctcgcacatggattgtcccttgttggctgaaactcattacttttcttttcaggccatcaacattgagggtcttgcattggacaagttcctggagcaccatattgcaaactccggttgggtgatcgagaagggtgcacgatctcagctgattgtccttccacgcaacgagttcaatcaccctgagctcaagaagaacacagctgaaactgttccgttcgagcatgtaactcgcatattccctgtccttagctgagtcaacaaccagaccaactgagattttgcattacagaacttctgagcgcgtgaagatactctgggcgcatctgttttctctgctgtgatgtactgcgttttgatatgcctgttttagctaaacaagtcaattctagtgacgatccgagcgtcatatctgcctagttatgtttatgtaagcattctgccatgatattacattgttggcaagatattttatcaggtcagagcaaaattttgcatagcggccgtgttcggctttgggcacaactcgatcttccatttaccacgagactacaaccattcctcgttgtcagatttttgcgattgctagtgttctgttgcgtaggggactcattgtgaaaaaaaaaacccgtatgtggtcggtgtaaaaacggattggttttagcctattttttcgtacggagttggcttgtagtagttgcatttttttaccagttttcgtttagttttccgcaaaagtggggagtggttttgacttccaaaaacaggataataaactcttattaccacaagcatctcttagaaaaaacaaatatgtatatcatttcatcgagcgaaacagcttggatatcgatttttgttgtcgctggcaaaagaaaccgcccaaattcatattgaggaaaaaggagtaaattcacatgaacagggggtctttctgcaaaaagaaaaaaaacttgggccggcccatgcacaccctgcccaaggagagtcgctgcctcacctaaacgccaattagggttttcaggggggcggagatataatgacataaaagcccctctccttcctcctcccttctccttcgcgccgccactctctccgagctctcgcctctcctcctcccccgtcttcccttcgcgcgcgccacccccacacacgcgaccatggcggcagtggcaggaggcgcagcgcgggcgctgtcgcaggcggagcaggacgtgcagatgatgctcgccgccgacgtccacctcggcaccaagaactgcgacttccagatggagcgctacgtctacaagcgccgctccgatggtacgcatgcacccacccccacctacaggcatctcacccggctctgcttgttcgtcgatgctcacagctagccattacaatgttcttgccatgagatttcctacgtaggataggtttaccatgttcttgccactagatttcctaggttggattggtgtggattgtgcacttgtatcatagtgctcgcctttgttcatgctttgttagtatcctagctttagctaagtatccaacttgttgtgagctagaattattacggcatggtgctcaacttgatctgatttcgtgtcatatcgtgtgtggcatagttgcattgcaacctgttgcaaggtatgctgctgttcttttgggagggtatcttgaatatgaatacgtgaacatcgttgctgcaattcataggtatctacatcatcaacctcggcaagacatgggagaagctgcagctcgcggcgagggtgattgttgccattgagaacccccaggacatcattgtccagtcggcccgcccctacggccagcgcgccgtcctcaagttcgcgcagtacactggcgcgcacgccattgctggaaggcatacgcctggtacatttaccaatcagctccagacctccttcagcgagccccgtctgctcatcctcactgacccaaggaccgatcaccaggtgaaaatgatcaccatgtcacggtagtgcgttggtgaattgggtacagtattgtttactgatcgtgttatcctgaattatgtctgcagccaatcaaggagtctgctctgggaaacatcccgaccattgccttctgtgacaccgattccccaatgcggtatgtcgatatcggcatcccggccaacaacaaggggaggaacagcattgggtgcctgttctggctcttggctaggatggttctgcagatgaggggtactatcctccctggccacaagtgggatgttatggtatgcggtgttattacttcaagaacacgttgacattggaagtgcattcatgaagataatttcatatcctttgtatgcttatacactgagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagcactgagtatgtcttttgcaggttgatctgtttttctacagagaccctgaggaggccaaggagcaggaggaggaagctccagcacaagactttgctgccatcactgattacaccgcacctgaacaatggtctgctgaccagtggacctctgatgtggctgctcccccagctgctactgttggtgattggggcgcagctccaggtttgtggtttatccccttctaatatatttatatttttaaccaggtatataactgttgtggacctctgaattttgttcttgtgatgctaaaaatttcatatcattggaatattcttgaaaaaaactgttgtgctgattgctgctcatactgttagcaattgtctcttcgttttcctgcataggctgtaaaatttacatgccttaagcgcttgtactaacttggaactgatcattctccctttctgtggcagctccagttgctgctgccgaaggatgggatcaagcaggagcacccgtagccactgaagccgccgtcgttccaccggttgcgcctactggatgggacccggcagctcaaccagctgctcaaggctgggattaggctaggcaatcactttgagatgtcttccgcagcttaagttaaatatttcccgaggcatgaatgaacacccaaaatccaatgtgatcatctatagctacaccatgaactcaactgtttttaggaatttctagctgaacctgtgttgtttgtccgtccctatttcgaacaacaatgctgtgagggtgagctcggcaagatgtgtggtatatgttaagctttctacttttgtcctaagtttattctgtagcgtttatatcaatcttttcctcggtgcaatggcatggttctatacgctcagtttgttattcaaatctggtacttgtacagtttgagaaatgttgtgcggaaacaaaaacaatttcccaagacgtgaatgcattttatcccttctaatctccacctaaacagacgtgctgcctcactgaaacttagttctaagggctctactctactgatgtacgtgtaaaacagatttaccatgcatttcaaaacctgaaaaatcctaggaaagagcaattttttttggggggggggggtgtatttctattggttcaaaatcatataaactcaaggcgtgcaaaggtttccttgggctaatggacattggtcctcaagtacaaaggcagaaaggagcttgactgcaagactcatctgtcgagcaaagacgaaagtcggccttggtgatccgacgatgctgagtggaaaggctgtcgctcaatggataaaaaagtttaaattatgtttctctttcaaattaaaggggccctagcgaccaaacgattttcctaaaaatcaaaagatacaaccaaagtattgcagcagttgcacaaacctgtatcttgattcgttaatatagtaatttcccatcatgttgcaacagcactcccattcatcatggagttcagggttcatgcaagacaatactggtaacatgaatcagcaggaccccagaagaaaattagttcatgcatcaggtgcaatttcatacatctctggaaaggaaaaaaaaaaacacacaaccaggctgactgaaacattggcttgacaactcatttcctcctgtaccgtgtggcctgttagattgtctcgcaatcattaccgtgttgccaacgattagtgtattttgtacagtgaagactgaaaaggcaagttccatacagagagcaagtaaagtaaaaattggtaaatatgtataatactataacatatttacaacagggattagcatttccatttttttttcatttttgtttgagaagttcttttttctgttttatccttttcctataacatattgccaaagattctaactaagctaacccttgcaaagaatgtgatatatgtttctcctatttattgtcttcagtatggtcaattcttcttcaccatagaaattcaatcgtgtacctcaaccgaaccgagtcagaatggtttcatattccccaatggattgtcatctttgagcactttctctgggcaaaccaagttgatgtttcttccatttgttgtgatgatctcttcgatcacgagaccgttgcagtttgcagcagatgtagcttgacttcgagtgtttcctttaatgtagctgcgatagcttctgctgttgaatccttttgctgagatgtcaccaagacaattttatagctctagtagcaaagcatgcctccgccatccacccaatgcgtgaagcggtcagagtagtcacggatgtctgacatttggctgcttgagcgtgacagatctgtgtcatctcttccctgctaaggaggaaaagtttcaatatcaataaatgtacagagtaaatgcctgatggcagaaagaacgcgtcgatagattacatttgaaaaatgtaaaatctgggttggaacaaaacaaatgtacagcaagcttgagtggcatatatctctactattataaaaattgaagatgtttttgccggtattttggtacgtcatccgcgtatgagtcggttttcaagtccgttcgcttttggaaatacaaatccgtatttgagacagttttgagtcagtttgtaagttcgttcgcttttagaaatacagaagaaatcgtataagaaatctctttaaaaactcacatactaacttgagacgatcggacacctaattacagctcatgattttctaacaaaatatatatccaagcgaatttaacacagtgaatttcatcttaactcgatataataataataataataataatattaatattaaaatagcctttacccgttgcaatgcacgggcattttttctagtaattttaaaaagaaaagaggggaaaagactgacctcatcattgtgtccctgttcactgtatgatgtagttgattcaatactgacaacatccatgggtgaattgatgagtgatgacctgtaaatgagtttgaaacatcttattaccgttaaccattacagcagttccctccaaaaaaatgaaataaaatactatagtgtgagtaatataacatctcagcctagaattcactcctttagttgccagatcaaggggatagaatttgtgcagttggatatacaaataaatcacagatgtgttacctctcataaatttcctcctcacaagaatttcctgaagatgataacagatcaagatcaagaaagtttgaagagtgcaattcaggataacccaatcttctcaaataattctgccgctcttctgaaattgagtgtctcccagacaatgtgctatagtttgtactgaacatgagaaaaatgcagttagttcatagtatggacaatctgaagttctccaacaaccaccaattcgttttcaaacaaggatagagcacctggagcacgggttaggttctatagagatctctggtgcagaatcagaaggttctctaatatcctccagtggttgcattgggagcaattctgagcttgtgttgttttttccaacattacagtcagatacaggtccaccagtgttgtcacataaaatattaccgtccgataacgacctctttatgaatgatctgctgatatgaaatatggatgttactaaactagacatggaaattccaaaattcaataaaataatataacaaaaacaaagtacaattggcagaaccactaattgaccagattctagatagcttgggtaacccaacacatcattatatcagcaattaataccaagataggttctaccttaagctaatcaacatattatattctagatcattgattatcattactaggtggaacatccaaatataagttctctgtgtgaatgaaaggctctcacacccttattaatttgcagttccaagacaaagttttagtattgttcaatccaaacgagcaaacaggcagctagagcaaaataaaatggtgacaccttttgaatttataacatggattgagaagtgaacagtgtcagatttacttggaatctttcatattccatatgattgtctggtaaactgtctaaatataagctgaagttgtactgcatattacagctttctgaacaacatttcttaatggaaattgacttcagtacctcccagtttcttcagttaaagttccttgcctgccaatgttgtaatgctgatctgagtccaatttccaaagcgcaggttttccttcttgtggttggaaatgacccaagaacctgcaattctaaagtcagacagacccgtttgtggtaatatactagagcgataccaacagctcccatggttctgtcatataattttctccgagaattctgcctattgtacatgtatagagtaatacagacatgagaagcttacacatttatagaatcctgcttctcaggatcagtgtaggcattactgtagtagcgctgaagggtccggaggaactcctgagattgtgttgctgccttccattggcctctttgctcacagaagatctgtaacatatatcagcagtatggagtactcagacagtcagactaataactcaaaagagaagtttggacttttggggtgtaaagaaaaaaaaatctttagaagaaaaataatattatgactattgacttcaccgccaattaagaagaaaaatcgctttgaaagaaacaaaaataggacaattgaataagaatatgaagaagggtttaatgaaagatgcatttgtttgagaattgtattacacagtagaggaagcacaaattatgctccaacgagtcagtaaatagaattaagcaagtaccttgttgtgagcagcagagccaccatattgaatagctagcgtatcacccatccgttcatagaaatccataagatcatcggccaaaggagcatgcaattcaattgtaggggtttcattgagctggagcacatgaagttgacgccctaaagcagctaagccatacgcaaactgtgcaacatttgtgcggtccaagcagtctatgcagttagtcctgaggacacccttttgcagtaaaagaggtactagcttagttgcacataaattttgatcctggatgttttcgatgtcacctgagttggcaacagctccttgtccactgatgcatttaaaaagaaaaaaaatgcattagtactgttatgtgagctcataagataagaccaaataggagagcagctactcccaattgttccaaaagctgccttatttgtgtgttctactgttctccaaggcacagctttgactaatccaaagaatgaatatgttacagggtaacatcatgaaggaacattttttgacaaacaacatcaggtagtttctggtggccaggcaaaattttaatataactcttataactcttaagtaggccaaatgttaccttgatgcatcctcatactttgatgtagttatctcacagtggaggaagtcagttagatccaacacatctgatgctaccttgttcaacagcgaaagcacattggtacctttcctgtaaatagcacttagtacttaacatcgaaggcaatttacaagtaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64547 - DNA, 7362 bp, Oryza sativa
aaacctgtccagtaggatttccaggattgatcaccaccaacgccctaacagttatgccttttgacctggcatcttcaagttgattcttaagcttagaaacctccaaaccccatcctgaggattcatcaagataatatggcacctgaaatgaaatgtcttcaggctattgcgctgcatcgagtagctagcttgaagttataacgtcagacaaataaactacatacaagagctccgccatgaagtgctagggatgctgagtacaatgagtattgaggaattggacacataatgccatctctgttgttccttatcagcaactgcatcatcatgtgtacctagaagagggaaagcataagtcagactggaatatcttacattcctgtttcttcagaaataaccaaggtaggacatacaccaggacttgctccattagttaggaatatatcatctgcatttgcagggaaaccatcacgggaggcaatcccagcagcaatctcatcacgcagtcccttgataccctaggataaagaagagtaaattccacaaaaactgcagtgtttgatttaaatctgcatcttttgttgaatatttcacacaactgcaacaatagcagaggattttatcagaaacctgcagccttatctcctattggtttctgatgtgtaggcccaaacttgcaacgacatgagtattgcatgtgtgtgtgacagatggatccagaccaatcaaataaggttgcaattttctgataagatcatcagctattcttgcattcttattgcgtagttaaatttgcagaaatcgatagttttgacaacatagttatagtgaaacttactataaggaaaattatgaactcaagatgctcctagttgagtgaattggcagatggttacctggctatgactatatgccccggtggctcttccaggaatcatggaaagaattttctttgcccgagcaatagcatcagtgctgcaaagagatgaagaaacatttatatcatacataaatgaaataccctaatgtgcttacatacctttttattagaaatgtagaaagtgtagaacataaatatatatgtatagtcatagcttggtaatgaatcatggcatgcagttgatgtttacctgaacaatgatttaatttcctctctctccagcagatttggatgattgcaaagtgcaagaacctgtaacataactcgtaaatactgaaagagcataaaaaggaaagatgaagttttgggtgtctaatatttacagacctccctgaagaatgtgattggtttttgacccaaggactgagggttcccgatgttgcaatacacgatctgcatataatagttgaaaatttatgaatcatctaccgattattcacgtgatctgcaaattatagttgtcaatgacctcatcaaatggaagagaaccaggttgtgtctgtagctgctgttgtaggtgctggaagaaaaatgtgagatatctattaatttctcttctagcatttgctgaaaaagaataaattgaaattgacttccagaacatggatggactaaaccacgaaacctgagcatggatggcaacctctccacgaactgcatattcacatcgtaaaacctgaaataaagaatatgaatcagcaagccacaaaagaacacaacttactgactatgcactcagcgatcgatgatggccctagtataaccttggggtttatgttctcaacagaaacaccagtggccatggccaaccaaagtatctactattctcgcttccttggagcttctatggacaggtaagagctaacttttctcaagcatctaagagagttccacgtaatgataatttgacattggaggcctgaaccacgtgatatttataagacctaaaatgaagaatcaaaagacaagatatcctgcaggagagaaatgaagaaaaggagcgtggacaatagggagcaacggcccccatagtagatttgttaattagaacagaaccatgactttgcctcctcatcttatttgttgaatcacataacaaaatgcgcatggccttttccacatagagtttcttaatctctgattgtccctgtttcgtacaagaaacccttaaaatttagctgcaatacttcttcctcagacattacattgggaggaactccgaggattgacagcccaggtataaagtatttaaagcaggaggtattttctgtggtcacccagctttgctatcactcaataccatgtgtctgattgtttttttcactttaaaaaatataccatgtattgcctccgctccaaaatataagcatttgtatgttgttttgtgagaagagtttgtgcatttctgcctttttttaacagttctactgagctcagaaatatgttacccagatcagatgagggcagtaataatacatcaaaactgcagaagaggggaaaaaaaactcacctcaatctaccattctacctttgctatggagatgctggatctagttagcattccgccgtgaaacaccaatctgccgccatggctcgagtcgagttctcgtctcccaaatgcagcagcagcagcagcctcccttctcttcggcttccctccatctccgtagcctctccccttcggcctcgaggaccacctccttccgcagctggaggatccttcacccgtcgtcccactgcggcctccccgccgccgccggccggccgcgctagccggttccggcaacggcatggtcgaggaagaagacggcggcggatgatgtccacgacaaagcacttcgaggcccaatcaacactaatgggcctaatctgcaagcccactagagagctgcacacctgcgagtgcgacatcgcctcctggaccaggccggatctagttgaaataggcccgttcggtaggagaggataaagaggaaaagtccctcgattagtcgttttctgcgcttacgttcaactgctaaaatgatgtgttttttaatatttatttttaatttatttttaaaaagtttaaaataattattacttaattaattatgtgctaatggtttatctcgagcctgttcactttgctacaatttttaaccttatcaatttttggcattgtcaaatttttggtaaggttgtcaaaattttggcaaggttactaaattttgacaagatttcatatgtagttactaaaatttggcaacaactaaatgtagccacttttttggtaacttttccaaaattggtaaggttgaaaattatagcaaagtgaacaagcctcttgttttacgtatttctctcctttcccatcctctcaaaacacttataatagcttctaaaaaaaacacttataatagtagtagttcattgctagcataagctgaagactgaagtcttgaaaaaaaggttgaaatactgaaccctatgaaactgaaagtatgaaacattaggtagtagttaccactagcattttatttttttgatcccatgaagtataatatactaataatgttgcaagatagctagggcttggcatggtcccaaggtctcgtcatgggaagccatgctcctccctcccggtacagcagcgcgtgcctggctgcagattcatcatccatcacaaggaccactgaaaccgtgaaaactgctgactcccacacatgtgcttgtattgtctgtccctccctccctccctccccagttgaattaatcatgtaaaactctggattccaacacatgaatacattcctctccaattctttactagttcttctcaccaattataaatgctagtagggtgataaattacagacagtgagatactgagatcgatcgatgctgcttctttcttacttaattacagacagtacgcatgcaggcaggaggagcagccacatgattggtttgcattcatgattcacaaagccactgcaaatcacaggaataagaagcttcaaagttcagagtactggaggagcttggagccaagaagctttggaatgagaattttacaatcgatcagatcacctaattaaaccagcaagcacacaagaagtagttatcttttttttttctgaacactcgtgcgctgacataatcatacacacaggcgttgttacacgccacggatgatgagtagcaaaagcttcagaagcaaggcaaaatcatggaccatatgctgctgacactctcgtacacacactgtctcttgttgatctgttcataccagctactgccattgccaaccttaaatgcgagaaggatctcttctcatcagcagataccatcgtaatcaaccccattgaatgcttcgtctcctatttgctccggaatggccttgatgagttgatccatttctcatcctctcttcttgcagcgtctcgcctgccattacttcgagggtaatgcagccaaataccttgtgttgcttcattcattcatggctgtctgtctctctctttgttctttaattaagtggcgttatactttggatttcttgcatggatcatgagaaagtgtcttggttttatcttgctcatttctgcatgaagctggatttgtagagctgcacgttatataagctggtcatgaggatgagcaagagctctggatgtcgtagagctagttgcgatcatcatcccgaacattgcaaggtgatctcggttcattcggttggatcatattgcaagaatctctctctttttgcattgcgttcttcttcgctgagacaatgggagtagctggagcacgcacagtactgtttagtactgttcatgcaataaagtaggaaactgtagtgatgaagcttttaatctctcgtcgtttcagttcatagaagcaacgataacacaggaagaagaatgcactcaagtttcaaataagacaacttcaagtagtcctgagaatatgttactgtcttctcaaggtctgcctgacaatgtaagttctgaacttctttctggaatttgtatcatttaggaagcaagcaaccctctttaacttcattgtcaatactgcatcttagttcacggatgaagcaacaaaggatcaatacctctgcaattcaggcctccaagctgcaaatcgagaatcgaagaagaagaactcgacgttcttgacaaagtttcagaacagaataattgcctccttggcatctgaatcctccccatgcagaaatgcattccgcagaccgctcctctctagggagatagtagtcagagaatacttcaaattggctcggattatcagacgaacagctgcagcctgcttctcgccatcgtcagatgctgatgaggactatgactatctgcctcacatgcagcttgacaaggtgacccatgcaataagcagagaggcatttggccctctttacttggtcacatgatccattccagtttcctgatccagatgatgcatggagcatgaactcctaatctcatgttaagttatgtttaagccattgcatcatctgtcagactgactcgtcgcaagaacatcgacatcatgctgcacttgcagtaacctactgaacatctaactgtaatgcctgtaatgctgtgaacagctcaacgcttatgtttttcaatgctagtaaattgtaccgtaaaagttctctatttttttccatcctcttttatgaattagtgaaccttaatgtatgcatgacatcacattgctcgaatgaagttagttgccatgtctccattaaacagcaaccgatcaccactaaagggaaaagacacaaacgaaggatcagaattcagaagttcagaatgatcctaaaataatagtagcaacagaaaagacgtcagcaaccactaactggtgttgagtgagagagcaaacgaaactgaaagcgatgaaaccataagatccagagcataacaaagcactacacggacacggtgtcacctacctcacggtccaccaaacctaatccttgctccgtacgtgccatggaaacctaatctgttcgtaccgatccaacattaacgacaaccagaacagcatctgtcaatcaaggagtatagttatttgaagccatgttctgctattttgcaggctaagtcactgtttggatctagggacttaactttagtccctatatttagacactaatttagagtattaaatatagactacttacaaaactaattatataaatgaaagctaattcgcgagacaaatttgttaagcctaattaatccataattaaagaatgtttactgtagcatcacataggctaatcatggattaattaggctcaatagattcgtctcgcgaattagtccaagattatgtatgggttttattaatagcctacgtttaatatttataattaatatccaaacatccgatgtgatagggacttaaaagttttagtcccatctaaacagggtctggcttgcagcatattggactcagcagaatcactctatctgtagaaatcatactattatcaccaccatttatcatttgacaccattaattactttcctattctccattcacaacaccatagtgtactagtattatactacacaatgacgagtacaatgtagcggtactacacactacacggtagtagtataatctttatgtccggtggttgcagagttactttctaaagtctgaacttaaatcataaaaagtcctatgaagtatgaaccgagccagatgttcagaattcagaaggttcactgcaccattgactttgcagcaaaatcctaacacacagctcgccgcttgcttgcttttgacagcacttttttttgacagatttctcgctatcacgggattgcttgcacttgcacggcgttctttgaaagatcacctcgaacagaatgcaaaggatgccaatcagaatgcctcgagtgctcgccaagtagtattccatgacacttgtgcacaaatctgattaggacctttcagaagaaaaatggtactcgtaaatctgattaggagatgctaacgtttttcggttgatgcgtgcgagcgtggagcgaagctgttggtgaagcaggatcagattagcatgtctcgctgtgctgttcggtcacatgttgctgtccatgccattcgccattcaagccagctagtactagctcccagtttttattttgggtactttggaacacagaattttttatttgactggttaggttaacatggtctttatcatcattagcaacactgaagggtaatatctgttttgcccatcccctttcccttagatcatattcatagattctacaatgtttttttttggtaagtactcccttgtttaaaaaaaaacgaacatggagggtgtgtttagtttacaccaaaattgaagtttgattgaaattggaacgatgtgatgatggaaaagttgaaag

SEQ ID NO: 64548 - DNA, 5506 bp, Oryza sativa
  unsure (1)..(5506): unsure at all n locations
ccatcacatcattccacttccgatcaaacttccaattttagcgtgaactaaacacatccttatcattcaaattcgttgtactaggatatatcatattcaattctaagggcttgtttagttggtgaaatgaaaatttttggtgtcatatcgtacgtttgatcggatgttggatggggttttcggacacgaatgaaaaaactaatttcataacttgactggaaaccgcgagatgaatcttttgaccctaattaatccatcattagcacatcgggggttactgtagcactttatggctaattatggactaattaggcttaaaagattagtttttctttttacttatatttaatgctacgtacatgtgtccaaagatacaatgtgatgtttttgggaaaagtttttggaggaactaagcagcccctaagtttgtttttttggataaaagggaaactttgttcagcagggttaatcggctggtggagattttgcttctgataaaaggcataaaattctgagagattttcgatgggccatcaggtcacaaattcccaccaagcaaataacaaaatgctagtaattaaattgccatgacatgaagatcatgccactcacgatgcgcgtaaggagtcccgatccactaccagctgatcacatttttgtgaatttcgctgttgaaatacaatcatgtcatacatacatataaatatacagcagtgaacaggggcagatccaagtaacaaaaaatttgaggagacttagttacatgtaactttctttaatcttcagccatttagggactttttagtttaccattcatgataaaaaaatcaaaaaaggtgtttcgggggtatctatgggtcttgtgggtgtaggggttggatccgcccttgagtagtgtacaatgtttgacctccaagatttatttttgttcttctccttttgtttttgttttttttaaaaagaactccattattgggagtaggatccatccagcttgtcgccatgacacgcggtgccagaaaaatgcaattatgcagacatgcagattactccgaacccatgtttgccacgacggcgactccaccctgcataattgatgcctttcttcttcattttctacttagaaaataatacaaggccttgttcagatcacggactaatttatgtttatatcacatcggatgtttgatactaattagaagtattaaatatagactattaacaaaactttgagcataattaattcatgattagtgctaattatggatcaattaggcttaaaatttttatcacgcgaattagctctcatttatataattagttttgttatgcttaacactccaaattaatgttcaaacatccgatatgacagatactaaagtttagcccctgatccaaacaccccctaagtagcattgcccattagcactaagtacaattagtgaatttgacaatcaagtgctactgtagactgctagtacagctctgcatgcatgcgacgtaccgtaagtactagtagtactctgagatgattaatggagtccaaaattgtacagcagcagtaaccctgacgcaagaatttcttttgcatcagctgatggtggaggtttatagtacgagtaccagatgcaaaagatgtgtcacgcattccaacccaaattctgcggttctgagttcaggccaaggccaacccaccgcccatcggcccggcgctgacagcagaatctgtgcgcggttttgctgcaatttttttttattccaacctcccaagaatgataggagtacagctaagtagagcaacggatttgttttcttgttcgtgaaaatgttgtagatgcatcctaataaaaacgtcgaatgtgtcagcttttccttaaaaaatcagctctttccttttaccttttctctttgaagaaaaagaattcgtctccgaatctgatgttctcctattgaatgtgagcccttcgcggctgctgaattcacaagaaagcccctcgatgaaagcgacaaccttgcaattgatttgacctcatcgttcttgtccccgtcctggtgccagctgctgctccgctacttcccactgcgcgattcaagaacacggaggaaggttgaaactctgaaagcagcagcagatacaggaggagataagataagtaaattaattggaagaaagaaatcagtggggaggaggctatagaagggatctttcatgcgaggaaagcgcctttctttgcgtttttagtggggagagcgtgtgagcattggtgtggggggagaagaagaagatgggaagagcggatgcgccatggctgccgcttctgctcctgtgctcctcctgctgcttctgcatttggccccagaagcaaatcttggtcgctgcagacaccgaccctaatgatggtaagctagaatctggaatcttctcccctttttgcgcgattgttctttctttttttcttttctgtttttgtttcagagctgctggattaatcggtggagttcttcgctcgatgtctgtgtttgtgttttctgttgcggttcgtccggctggtttgctgattctggcgctgtttgtacggagttttctgtagattcggttttggaacggggaaatggatgtgaaagcttccgattaaccgaatctttcttcattttttacttgcgaaatctggtctttgcgcaagaatgctcttgatttacgtctgttcgacatagtgaacaagatggtgtgtgaatttcggcagcttataattctcatttttgggttgataaaaatggggtctttctgcccctggggtagttaagttgtgctaatccgagtaaggaaatacactggattcggttggaaatcttgcatgtccattctttttctgctgtttctactaaccaaatttggcctatgctatgtacctagctatctcagttatggttgcacttttgcttgctgaatctcaattgaggaggaatttcgtgcaaaacattgtctggattgcgaggggcaatttttgagaacaaattttagtttagcagttccaagaagaaaatgcagtcgttttccttacacctacctctagatttgaccctccttttctcttcttttttgccttattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaggcccggcgaaaaacgtgtagtaattatttgctctttttcatgcagttactgtcctcaatacgctcttcactagcctgaattctccggggcagctcaaaggttggcaggcaagtggtggagacccttgtggccaatcatggcagggtatcacgtgctcaggatcatcagttactgcaatgtgagcctcatcatgaagcaaagtagtttactacttactcgaccaccttctttcttacttcttacaatattttctttgtgtttgatgttgtagcaaattaccaagcttggggctctccggtaatttggcgtacaatatgaataccatgggttcattgattgagatgtgagtatctgagattattcatatctgatcctgtcaagtgacaattcagttgataacagtcttaattgattttttaatgcagcgatatgagccaaaacaaccttggtggtggccaacagatacagtacaatcttcccactaataagcttgagaggctgtaagttcctcaaatgaagttgtggtttagaaagtacatcagcttttctggtgtctgtgtgctaagtggttattgtttgcagcaatctcgcaggaaaccagttcactggaaatttaccctactcgattttctcgatgtctaatcttaagtatttgtgagtatctttgcaaacatcaagttgattttgcttttaaatttgtataatttggtagagctaaatgttttctctttgtatgtgcagaaatctaaatcataaccaattgcaaggaaatataactgatgtattttccagcctctatagcttgacaacactgtgagtacttttgtgtgcgtggattgtagacgggtcttaacttgtgtattgtaaaatccttctttgttgttcatattcctaatgtctatattcactttccatttccctatgtgatgtgatgcagggatctttcctttaattctcttgctggtgacctaccacaagggttcacatcattgtcaagcctgaagaaattgtaagaaaatgattgtttttctctcatagatatgtctttttggagtgacatgcctgtaatcccatactcgttcttctcagatatctgcagaacaatcaatttactggttatatcaatgtccttgctaatctcccccttgatgatctgtaagaaatcaacctataagtaattaatattttatttgcacgtgcagtaccacatctcatatctttgctttcctataggaatgttgcaaacaatcatttcactggctggattcctagtcaacttaagaagataaacaatctacagtgagttctctttgcttataaacatgtaaaaatgtatgagagatgtaccctgaactaataagatccctgtgtacagaactgacggaaattcttggagtaatggaccagcaccaccacctccaccgtattcagctccacctccaccaaaccgtccaaacagcccaggtcaaaacaatggtggttcaagttctggtggaagctctgggataggtggtggaggtgtagcaggcattatcatatcattgctggtagttggagcagtcgttgcattctttgtgataagaagaagaaaacgcagagcggcattggaagaacattttgaacagcaccagccattcacttcgttcccttcaaacgaagttaaaggtctgtttgcctgatgccttgctgatcatcatactttagttttgttatatattttgtacaattatctgaaaatttgcttctgaaaatgtgcagacatgaagcctattgaagagtctactacaatagatgtagagtctttgccatcccctgcttcatttagtctgaagccaccccccaagattgaacgccacaagtctttcgatgatgatgatttatcaaacaagcctgtcttgaagaaaaccaatgtggcacctataaaggcaactgtttattcagttgcagatctacagatggcaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64549 - DNA, 16099 bp, Oryza sativa
gccgtttcgtcgatccgcggttcctcgaagacgttgctgtggtctcaccagtgcgagagcaaggcaagtcatgctttacatttgatcatattgtacccaatttacaaatatccctcatttctattaaatgttgcactcttttacaatgtcatgtgggatgggtcctactactcagccatagattgtttaccatatgccattgataacttgggtatcaatatgattagatgttggtttaggaaatgcttagccatgcctagttcaactagtacacaaatggggatcacattatcacatagactttgtctatcagcaaagttttggattgctgccaccgcaatggtgttagttaattaaaatacactgaatggtgggctacgggttcatggtttcgctgtcgcacccatggaagttaaggaccagttcacgggaaaccctgggagacttaccgtgcttatcacaagcgggagtgggtaactgcttgatctaaagtatagctcgaccctttcctaggcaccggtggcgagggtgggcgtgatagagttgggtcggccggggtgtccggttgtccagctgccggattcaccgcggcgcaagaagggaccgcccactgccttttgaggggtgggggtgaaaccttagcgtggtatggatggttaggggagggttatgcggagggtcttgtcacgatttccccctttgcagtatcatggtgatacttcggggcatggcgacatgtgtggaatcgtgtcttgtgggtacagttatacacctctggccagagtaaaactattcgaatagccgtgcctgcggttatgggcgatcaaccaaattcaccgtgattagtctcaccctagtttagcttaatgaactggtgtagttcaggtggttggttgggcctattgcaacgtggtgtagcgttggacagtgattagttaatattgattaattactacagctcttttactgctttcaactattgcttttaaatgctagcttgatgcaaaagaacccctagcctcctttggttatatcctgcatcatacctcctcttccggtatgacttgctgagtacagtgggtagtactcagtcttgctctcttttcccccacaccagagttgaagttcttctcagttggagccgtctcagagagattggtttcgtcgctgccgttaaggattgcttgtggaatggagtcgccccgcttctgaagtcaagcttccgagtttagttcgttttatcttttccgctacatttgtaaacttttatatttttgtaagacgtggatctgtatgtcaacaatggtcgtttgtgtaccctggctggtcctggacagggatttaatgcacattcagcttagaaattctgattcgtgaatatctgggcatgacaagttggtatcagagccgagcctgaccgtaggacaagccaactggaaacctaagagccctctgaaccccttttcatatgcatatgcctttttcacctggatttgtttcgggaaaattttgggttttgcctctttggtttgtgggaaaaatcttggtagttcatttggatcggatctttaaaattagctcagtctagggttttagtaaaattttatttggagtttattcgacagtcagtcgggaatctatcaggtgatatgcattaggtcgtgtctatgttcgatggggcaattttatgcgcattattttctatgcatctaatttatgcattaatttattgtttaatcagttgcattagtgtctttatctgggttcatgaaaaatgttctatgcataaaaatcagtcatgctaggttatttatttgagtcatttgttgctttgtttaatttggaatttagcatgaattggttcttatcccttgtctactttagatgttagtcctatccctcgattgcaagcgccgctccgagcttcagagtcgccgcccttagttttatcgtcttcttagttttgtttgcttgctagtttccgtgcttaagtttgttgcttgtgggttagttggcggtcgatatcatgtgtgagtggtatggctgacttaattaagagttgcgtgcctctttttcagtgttttaatcaagattaagataattgcacttaaatttataagaaagattagtttctgagccccctatttttcttccttttctcatatttctacctatcctccttcagatggtgaagacaaggaatggttcacgtgactccagcaacgtcagtggcagcgaagagcagattagtggagcacgtgccaacagtgcatctgacaacagtccatctccaccgcccgagaacccaacgatcactcaggtgttggacaatcagactcagatgatgtcaatgattatgcaacagatgcaacaacagtaccatcaggtgttgcagtaggtgcagcagcaagcacaacagcagcagtagaacctgcagtttggtcttccacctccttaatccaaactgttagaatttctccatgtcaagccgcccactttctcaagtaccaccaacccaatcgaggccaacgactggcttcgtgctattgagaagaagctgaaccttttgcaatgcaacgaccaagagaaggttgcttttgctatacaccagctgcaaggtcccgcttctgtttggtgggacaactacgtggtgacccgtccagctgggacaaaggttacctgggcagagttttgtcagagtttcaataaagcacaggttcccgagggaattatggcacaaaagaagagagagttccgttctctgcaacaaggaaccaaaacagttatagagtatttgcacgagttcaaccgcctcgcgcactacgctcctgaggacgtgcgcactgatgccgagaggcaggagaagtttttgtcgggtcatgatgatgaattgaccaactagttgatctcccgagattataaggactttcagaagttggtggacaaagctatccgtcaggaggagcagggtaacaaaatgaaccgaaaaaggaaggcatctcagttcagaacttcccaggggaacagttagaagcctcgcttcatgatgggacatcagggtggaccttccaccatgattatccggcagcatcgtccctaccacccgggtagcttcggcaggatctaccatagtggcagtcacggcaacagcgagaagcacagcctcaacctgactccaagtccactaatgtttctagctcagtcagttcagccagctctgcctgctcagtcaaaacagcccaaggagttcgaaggaaagcccgaactctgcttcaattgtaacaaaccgggacacacggttggaaagtgcccaaagccaagacatgctggacccaagtttgtgcaggcccatgtcaatcatgcgtctgcagaggaggcacagtcagcaccagaggtcatattgggcacatttcctgtcaactcgacaccggcagtaatattgtttgattctggtgcaactcattccttcatttccaagcgttttgctggtgcgcatgggttatctttagtgaagctcaagataccaatgcgagttcatactcctggaggtggcatgaccacaactcactactgcccatcagtgactgttgaaatccaagggttgatttttccagccaacctcattcttctcgaatccaaggacctagatgtcatacttagaatggattggttgacaaggcatagaggagtgattgattgcactagccacaccatcaagttgaccaatgcaaaaggagaagtggtaaccttccagtctccagtatcgtagaagcaagggatcagtctgaaccaggctgctggtgaagaacaagaagtagcagtggagaaaaccactaagaagttggaggatattcctatcgacagagagtatccagaggtttttccagatgacctgacaacaatgccacctaaaagggatatcgagttccggatcgacttggcacctggaactgcaccgatccacaagaggccttacagaatgggagccaacgagctggcggaagtcaagaagcaagttgatgaacagttacagaagggatacattcgcccgagcacgttgccttggggtgctccggtcatctttgtggaaaagaaagacaaaaccaagaggatgtgcgttgactaccgcgcactcaatgtggttactgttaagaacaagtaccctttgccaaggattgatgatctgttcgatcagctgaaaggagctactgtgttctctaagatagacctgcgatcaggctatcaccagttgaggatccgcgaagaggatattccaaagacagcattcatcactcggtacggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagaacataagcagcatctccggctagtacttgaaaagttaaaagagcaccagctatatgccaagttcagcaagtgtgacttctggcttaaggaagttcagtttctcggtcacatcgtgaatgctcaaggagtagctgtggatccagcaaatgtggagtcagttacgaaatggaccccaccaaggacagtcactcaggttcggagtttcttaagacttgcgggctattaccgccggttcattgagaacttctctaaaattgctaagccaatgacacagctattgaagaaggaagaaaagtttatctggtctgctgaatgcaataggagttttgaagaactcaaaggacggttggtgtctgcaccagtcttaatcctgcctaatcagacgaaagatttccaggtctattgtgatgcatctcgccaagggctaggatgtgtgttgatgtaggatggcaaagtggtttcttatgcttcacggcagttgcgtcctcatgaaggcagctacccgacgcatgatctggaattggccgcagttgttcatgctttaaagatttggcggcactatctcatcggtaaccgttgtgaggtatatacagatcacaaaagtctaaagtacatcttcactcaacctgatttgaatctccgatagcgaagatggttggagctgatcaaggattacgatatgggaatacactaccatcctggcaaggctaatgtggttgcagatgccctgagcaggaagagttactgcaacgtcacatgggtagagcaactatgctgtgaggttcaacgtgatttggaacatctgaaccttggtatagttgagcacggatttgtggttgccctagaggcacagcccacactagtggagcaggttcgcatagctcaagcaagtgatcctgaaatagcagagctcaaaaagaacatgagagttggaaaagcccgaggttttgttgaggatgaataaggaacaattggatgggagaaagattgtgtgtacccgaaaacaaggaattaaaagacttgatactgacagaagctcatcaaactcagtattctattcatcctggcagtaccaagacgtaccaagacctcaaataaaaattatggtgggtcagcatgagaatggaaatagctgaattcgtcgcactctgtgacgtttgccagcgagtaaaggcagaacaccaaaggccagcaggtttgctacagccacttcagattccagaatggaagtgggaagaaatcggaatggatttcattatgggtttgcccaggacgttatcggggcatgattctatttgggtagtcattgatagactcactaaagtggctcacttcattccggtgcatactatctactcagggaagaagttagcagagctttatttggcaagaatcatgtgtctacatggtgtacctaagaagatcgtgtctgatcgaggaagccaattcacctcaaagttctggcagaaattgcaagaagaattgggaacccgtctgaaattcagcacagcgtaccatccacaaactgatggccagactgagcgagtcaatcaaatactagaggatatgttaagagcttgtgcgcttgactttggtggagcatgggacaaaagcttgccgtatgctgagttctcctacaacaacagttaccaggctagtctgcagatggaaccatttgaagcactgtatggacggaagtgtcgtactctgctcttctgggatcagacagaggaacgccagttgtttggtacagaagttttaaatgaagcagaagagaaagttagagctgtcagggaaagtttgagaatcgcgcaatctcgacagaaaagctatgtagacaaccgccgaagagagctcgtttttgaaacaggggattatgtgtatctccgtgtcactccgctcagggagtacatcgcttccaaaccaaaggaaaattggaaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaagaagacttgacgtatgtggagaagccgactcgtatcctcgaaaccagcgagagaaggacctgaaacaaagtaatcagattctgcaaggttcagtggagtcatcactcagaagaagaggccacctgggaaagagaagatgagttaaaggccgcccatccgcacctcttcgccagctctttcgaatctcggggtcgagattccgtttaaggggggtaggtttgtcacaccctgaagtttccccccctttcttgctttaaaaattggttaaataaattgcccgaagaaattatcttaattaacctagagctaaatccctaattaataaatgtatttaataatcgaattcgccgtggtggaatttttcttgagttccccatgctccaatacattaacatgatttttgatggattttttagagccttggaaataattttaaccaattaaaattgagcaaatgcaatatttttaatcctaggaaaatgctttgtctctttttcttttcttttccctcctttttctttgttggaccgtcggcccgtccctctcccgcggcccctcctccttgtgggccggcccaagccgcccctccctcctctctcaggacgccgacaggtgggccccacctatcggtcgtctcctacctccggccgttggagccggagctccaaccgccgctgccgctgaaaccgccacgccgccgccgtttcccgccttctccgctccatgtcgtgcctccactccgcgcccacaccttgcgcccacgtcgccgctcctcccccgctcctcccgcccccacgcgcgcctgagagtgggcggggttcaatttgaatccccctctctctcttcctccccactcccccacgtcgccggccaaatcggccaccttcccggccacgtccgccccctcctgcacctataaatcactcccctgagctccctctctcgtctcccccatttgccgccctctctcgagcccctatcgccgccgcgcctagccgctgccgctgcctatctccggccgcgtgccgccgccgctagagccaccgccgcgccgcgcagtcgccgccgtcgcgctcaccgagcccgcccgcacctcggccgccgcttcgttgccgcgaatcaccgccggagctccgattccctcgcgccgccggtgagctcgccatagtttccatctccggccatttctcctcgccgtgccgcggctcctgtcttctccctaaccccttcaccgccttttcccaggtcgcgccactcccgtccgccgttttccgaagcgctgccgccgctcatcccctcccgctccggtcgccgcccctccgatgaggactccctccccctctattctccccttcccacgtgcgccgccgcctttggccgtgccgccgctccggccatccgccgccgcctttcgcgccgtccgccgccgcctccctccgccggtcgtcgccgtcggcagccgcgcgcgccgccgcctctcgccatggccggtcggtcggctttgtgccgagccgagccgtgcctagccgccgcccgtgccgtccgatcggcctcgggccaatccggaccgtcggtcccgtggaccggaggtgaaccacccgcgtggtcccggtcacggtagaccggccaccttgtgccgctgccagtggggcccacttgcccgagccccctctccctccccttgtgcgctgacaagcggggcccacctgtcggcgcagccgcccccccggatgacgtcagccctgggatttattatgcaataaattgattaagaactttttctttattagtaaaaacactgtttatcttctaaacttcataagtaattcatccaaacttcgtttaagtccattcaagtctcagtaaattcataaaaatgcaaactatccactaaaaatggttttgtttcctgtttcagtagtcttatagcatgttttgcttgtgtgctttgtttgtcgcgtagatttcggccgtttcatcgatcagcggtttctcgaagacgttgctgaggtctcatcagtgcgagaggaaggcaagtcatgctttacatttgatcatattgtacccaatttacaaacaccctgcatttctattaaatgttgcactcttttacaatgtcatgtgggatgggtcttattactcagccatatatcgtttaccatatgccattgataactggggtatcaaaatgattagatgttggtttaggaaatgcttagccatgcttagttcaactagtacacaaaaggggatcacattattacatagactctgactatgagcatagttctggattcgtgccaccgcaatggtgttagttaattaaaatacaccgaatggtgggttgtgggtgcatggttttgctggtcgcactcatggcaattaaggaccggttcacgggaaacccttggagacttaccgtgcttaccacaagcaggagtgggtaactgcttgatctgaagtatagctcgaccctttcctaggcaccggtggcgagggtgggcgtgatggagttgggtcggccggggtgtccggttgtccagatgccggattcaccgcggcgcaagaggggatcgcccactgccttttgaggggtgggggtgaaaccttagcgtggtgtggatggttaggggagggttatgtggagggtcttgtcacgatttccccctttgcagtatcatggtgatacttcggggcatggcgacatgtgtgaaaccgtgtcttgtgggtacagttgtacacctctggccagagtaaaagtattcgaatagccgtgcccgcggttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactgcttttaaatgctagttttatgcaaaagaacccctagcctcctttggttatatcctgcatcatacctcctcttccggtatgacttgttgagtatagtgggtagtactcagtcttgctctcttttcccccacacgagagttgaagttcttctcagttcgagccgtcttagagaggttggtttcgtcgctgccgtcaaggattgcctgtggaatggagtcgccccgctgctgaagtcaagcttccgagtttagttcgttttatcttttccgctgcatttgtaaacttttatatttttgtaagacgtggatctgtatgtcaacaattatcgtttgtgtaccttggctggtcctggacagggatttaatgcacattcagcttagaaattctggttcgtgaatttctaggcgtgacagggagccagttgagatctggcaaacggtacggaacctctgaataggcgtaccgtaccttcccatcaaggaagaaaactagctgttggagtgcacactaatgctggtacatgcccacatcaagaagttttaagcaagaaaaagaagaagaaagcatatggaatatgcatctcctcgtatatccatggatactcgcataaagtctcatacaaccaatagaaattggcaatgagacctatcatgggcaatgtctcttttagacaacaaaactcattggcagtcaaccaggagttgaatggaattaatgaactagaagttgaaatgaagaactcaacctgaatgattgataagcattgaagatagaatcaatgaacgcatttcaggagtttggatcgggcacttgcataatagtacatgaagatgtactaggtcccgaaccaacataaaagaatagaataagccagaaaagaattgaaaaaaacaaacacattcgttttgaatttgagtttgatttgaaatatttggccggatccaaatcatgctgacgcttgcaactaaaggcatgcgacagatagaagtctagtacatcagtccaactgcacttagaaatgttcatgatgcatggctttggaatagtcaattatcgccaaaatgggacggaattcctaaacacgagtgtcatagcagcacatgaatacttggctaattgaactaaaccgaactaagcattattgaactgttcagagcctcggcatggttttgagagatggttacgcgcgacatcaatcgcgatttgaaaactatctcaacccccacaatttatgaaagtaaaacagcatatgtcgcacatatgcaatgagttatgtgagaagcaaactcactaagcatatgaacccccaagctcttctatgtacatgaattgcatagaagcgatgaactaagtcatgtggaagtcttgcagattcatctgctaactcattactgacatctttacttgaataggtgtgtccgagaaatcagaataatgagacttagagaaatgcaaaaatcagggggagaatttcgccgactcattttagaatcttgatatggaaaatcaagtacccaaaatcaatctagaaaggttgaacgaagaattgggtggattgtactctttttcccttggataagttttcccagcagtttcttatcaaggtttttaacgaggcaattcgtgcgatattgcaagcgtatgctatgtactctttctccaaatttttcccactgggtttttgtggagttttgacgaggcataggcatcatgcggtgagtgcccaagggggagtgttaagaaaccgatgggcttgggcccatgaaggcccagcccatatacactaattgggcccacaccgaaaccttccatatatggaggaaggctatataagaaggagaggggtgctcatattgtacacttgtgcttgaggatgatagaatgatgaatgagaagagagtctcacccctatatcttgtgtctccacttttgtagaattacgggacccttttggactacttcgtgtagcaagagggttgcgtaataatttcctccctcaaatccgcttgattcaaatggctaattccaaaattgattggggggaattaatcccctttccctcctctctctttcccccttaattcccccttgaatggcgccctccactgcccggaacggccgcgccttcctcggtcgctttccatggccgccggccaccattcccgcctccattccgctctctcccgtggccggctcccaacccgcgcctataaaatggaaccccctccttgtgttctctcatttttgcctcctcctgagtcttcccgaggtccctagccacctccccaccgtcgtcctctctctcccgtgccgccggccgcctgtgccgcctcgcctgtgcaccggccgacatcgccaccacctccctcggctctgcaatgccgcccccttcaccggcctcaccgtcccctcgcccgaattttgccggaacgccgtcgtccccgccgcccctccctcggtctcatcggcacccactccggtagccccttccgccgtgctagtgcgccggccgacgtcgccgtctccaccttcggcatcgcagcggcaaggtcatcctcggcctcgcctcccctccatccgaaccccgctggcgttcgccgtcgtcgtctttatcgttcgtccctgtcgacgtctcctccggttagccgttcctctccatcgtctcatcgtcctgcggcgccgcctctgtcgtcggcatcggagcggcgcatttcatgccgtcctcgccttcatgcagctgctgccggctgccctcgtcgcctcctcgctggccccgatcgttgtcgtcctctcgtcgttcctgctcgtggtgacgttcgtccctccgtcaagccgttcttgtccgtcgtctgtgttccgtcaagtgagccgctgcagccccgtcgtcgtcttcgtcctcggctccgcgtcgtcaagccctgtgccggccgcgtctcgccttcgttcaaggatcgccgccgaagtcgttccctcgccgtcatctccgtcattcccgttcgtctccgccgcccgttcgccgtcgtcgttcccacacctcgttgcgtggtggtaaggatctctccttcgctgctcccgtcctcgttctttcggtgtcgcccatgcccgttgtgcggttgtcgaccccggtacccgtgtaccggtgttggtagtcgttcgtgtgtgcgtgtggtaaccgtgtttgtgtgcctgctcggtagccgcgtggtttccacgtgtgcagcccgcatggtgtctagtggagtccgtttgtcggccactcatctcggttgacacacggggtccgcttccctcgacccgtggaccgtttctgtgtacctggtctgccgtggtcccttaggttgacatgtggggtccgcatgtcaacagcgcagccttcctatcttttccaggttagcacttccacatgttttatagttgcaaaacctaattataataatccgcaaatctccatataacagcattaaatttcggatgaccatgtcttggtcatacgaactccgaatcgatccgttcaagtctcgtaatgtttgttataacctaaagaaccatgtgctttctttttatgtattgttattgcttctttataggcttgtagctttgcttgtgtgcttcgcgtagcttctgtcgttccagaggttcccgaaacgtggttcgcggtcgtcgccaaaggttcggaaggccgttctctttgagcaatgcaagtcacatgatacttgagcatattgaatcccagtttataaaactattttggtttaaattattgcattatcgctttatttaaattcccgcgttatcactgttttatttagccatatctatttacctttgttatgaccttattattattgctattgttattattaccttgttcaccctaggataaacaaaaccccaactagtgggtactctattcatggttccactagtatgaatttagctagatgcttcgctgattaattaggcaacattaggtggttttataactttagactttgggaatgctcatatcatttggacattatggaatgattggcttatgtggaaatggacacaccccttctcctcaattcaaaacccccaaaatggttttaggctaggctcgaggtgcatggttttgatagtagcacctcggccactataaggaccggtcttcgggcctctgttgcaaagcactaccgtacttccacatgtctagtgggtaaggcttagtttgtggctcagtctggtcatgggcaaaagtacacggatagggatggacgaagtcggggctcgatggacttctctaggacaaatgaaggctacatgagctgcggcccggtagtcgagatgtcatggcacagggccggtgtcctgctgcttggggctcaaccttggttacctgtctggggattccggccgtagccagggttgggtcggtactcctgtttatggctaggatgggttgggaactatgtcacgtcttccgtccgtatgccgtggtggtatgttgtgcgtggttacacgtgaggaagacgtgtcttgtgggtaaagatgtacacctctgatcagagtataatctattcgaatagtcgcgccctcggttacgggcaagcctagcaatgtacctaagttagtggtttacttcttaaaacttgattaacaactaaaatgtggaagggttggcctgggttggcttgggacgagctaggacccaggtcgggttgctagttcggtctgaatcatcgtaggccttgggttaaggcaggttcgtgcgggttcacggccttgattaataatattgtgtcgccctaggatcgcctttataaaatagctttgagcaactaagtgacttttaaatgctgtttactgcaaaacttaacccctatattattactccttgtaccctattgcattaatcatacatctcccggtgtgacttgctgagtactgtggttgtactcattcttactctatcttcccctcccttcagtaagagaagctttggagaagaagtcttagttggagtcctggcttatacccagttgagcgcctgtgaagatggagccgtaggcccgctagtccgctgctgtttatttttgtttgttaggcctaaattgcctttgtaataatgtaaatattatcgatataataaagatgtgccttttgtatcatgtttgtgtggtgtaccccggcttttcctgggacggggattaatacactagcgttctggaaaaggtatttttttcgggtgcgacaaccgctgcgttattgctgtagtcgtacctcgaccatctgagtttgcggtgcgagagattactccgacaacaaccttttctcgagtagtccagccatggccggtgctatgaaatatgtcgtcggtcttcgttggcaggttgggcgcgacgactctgtatttttcgagatcgttctcgataatacggtatactcgaccacaacctactcgagtgctcaattgttcctgaaaaatattttctagaaggcaagacatatagcagataatattgagtacgtactcaaaaaactacatggatcttctagcattatcaggatataatgagcatttctaaatatcaggcattatgtaaaccgtaaacaagcatgatttatacggaaggaaatagagcgagcccccagcgttagaccgtagtcgatttaacatcggggacactcgcgtaacagatattgtataaaaaatatgctctaggtaaacataataaattatagatctgataatgctgtatgatctaaattggtacgataaattgcatataaaatattgagtaccttttagatacatgccggatatatctacgaaattagtagattaattagattaattaatctactaattaccttaattagccttggtggccgatctctgttggtgttttcgggtgattaaccaacgtatcatggctctgtacataccaacatatatttattcgcatacgtacaggtgctcgagacgtgtacgtgtactgtatatatatatgtgtatggtcacggtacaatatttactcatgccacgtgacgtcaggctttgtagtcctcgcggttgcccgatcatgtcgcgtgatgcgagattgatccgagctgacgagcagttgatttctccggagtccatcattgtccgctattgaaaatcggattcgatgtagtcatcggttgacctggccgaggcttcccggtgggaaacatcaaaccatcgttatccccggcgacgatatcttgtagctcggtcgatctcgccggatcgacaagttaacggcgctgattccgatcttgtcagggggcatactccggtcaggttagatctccccatagccgaagtcgtcgagtagcttgttgtcggagaatccatcttttaaactcatcttgtcgaaatcttgaagcaccaaaatccccctacctagcgcgccactgtcgacgtttgatgtcgcgattccggtatttgcatggtatggggatcgttggtactaggatatacacgagactgaggtaaaagagacggaggcaaggatttttatacaggttcgggcccctgaattgtcaggtaataaccctacatcctgttggccgaagccgg

SEQ ID NO: 64550 - DNA, 1393 bp, Oryza sativa
aacaccgacacatttcctttcagaaatttgataaatgtaattatgtaattatagtacaatcgtggtataattatattgtaagttaaatataactacaatgtaacttatatgtaactttcaaaaatccctccgtaacatgctatttttgtgaaatggaggtcgtgcaaacgaatcttctcacgtgtggttgttgatgaaaaatctacactcgggctatggtgcgagatctgtgttgatctagtgcagaactaagatgacgaacacaacggcctgggagatctgcttaactttagtgcagatccaaaatattgatgagatgcaggcgtgccagtcagtttgatcatgtaactgacgagctatataaagtgaaaatcaaagagccgatttgctgacaagccgatatagcaacgctagccgatgtcgatagggtattgaggaattggttttatatccattgtagattttgacacttgagtaaataatgatataaagacaatcgaccgatgataatgtaataaaacaataatataatccaatagaaaccaatcggctaataatgatatgatagaatgattgttgatccgatggttaaagcatacatcggctggtattccgatgcccaaacgattagataatcaattaaacatttgttgcaattggctaaaaccaatttgtacgtaatcattttaatctgatgcaacgtctagataacttatcggctgaaaccccgatgaaacccttattggcaatcaagaagcatgtcagagattatggttctaagcatgactatggctgatgcagtgcaaagtatggtaatgtaatgccccgattttcgttcgggattccaaatcatttaataatgcattttctagaaattaaataaaagttaaagcaatttaatcaagtgatataatgggacaatttgaaattttcctttaaaaatcattggccgggaatattttttaatattctttgtgccctaatatactctccggaattttccgtgaattttcggagctcaagaaataattttaatagcacatagatcatttaatcaattagttataaagaaaaccaaataaatctccccatcctccctttcgggctcggcccagttcccccctccttcccaggccggcctcccctccctcggcccgctcggctctccctctccctcaagtatgctttacctcccttgcccgttttcccctccctctctccccgacaggtgggccccgaggccccacctgtcatcttcttcccgaacctcccgtcgccccaactaccgctatggctgccggtttcgccccacgacgccgcgcctcccgcgctccaccccgccccacgagcgcgtgaaatcggttccctacctcgtcctcccccacttcccccg

SEQ ID NO: 64551 - DNA, 15652 bp, Oryza sativa
ccactgtcgacccgagctttaccaccgcctaccgcctgcggccgcctctagtcgccatccccaactacctcaagccgcgccaccgcctctgttagatccaccaccgcgagggtaagcccggccgcccatccctttttcccctccaccaccagaacaacctccccaccacgccaccctaccggccacctttttccgcctccggtcgccgttcgccatcaccccggctgccgccgcgacgcgccggccgcatcgcctctctcgccgcgtcacgctcttccccggccgccgctcgtccgacaccttccaccgccgggagcccctccgtgttgttgacccaaggagcgccgccgcctccctccgccggccgctccctccgtcgccgcgcctctcggtgagaaccgcctcccctccccttctctctttcttcccttcgccggccgccttccgtgcttgcgcgcgtcgcgctgccgccgccggtggctgcccggcccgtgtgccgccgccgctttggtcccggtcgccgccgccgccggtctagtgtgcgcgatggccaggccgcgccgcccggctgtccccagccgtccgatcggccttggctgatcttggccgtcggggggcgtgcctgcgtggccggtcgccgccgtggactcggtccacggtgggccggtacccaccttgtgtcgctgacgtgtggggcccgcccctttgtggatgtggtccgcgcctttcccccttgctgacgtcagcagtccccttttcctttgtaaaaataaataataattacgcaataaattggtattaattccagaaattcatttaaaatggctcaaaacttctaaaattcatatctaattcattcaaactccgaattgagccattcaacttgcaaaattcatctaaaattaagctctacatgtttgtttactttttatgtactgtttccttagtttttattagagtttttcctcgttttgcgtgccagcgtgtagaatctgtcgtttcggaagatcgcggtcgcgaggataagagttcagaagatccaagtgaagaagcaaggcaagtcacacattccccttgagcatgtttatcccaatttataaatgttttaccatttgcaaataaatatgcatgttttgctaattacatgggatccgggtattacctatatgtttgcttgtgccatgtttacttgatatatgtcctttgtcaacattgggtaataaatcgactagctcatgttacttatgtgacctagctagaactatatgcttagccgtgcttaattaccactagctcagttgatgggataattacagtattagacctttttagtatcagaatgagctgcgtgctcgagacatctggccatgcttcatggtcgtaattatccaactgaaatgcgactacatggtgggctgtgggtgcatggttttgctagttgcacccatggcaattaaggaccggttcgcgggaaaccctggaagaatttatcgtgcttaccacaagccagcgtgggcaacggctgggcttgtagtgtagctttcctctagctgatgcatccaggcaagggtgggcgtgatggagtttggatgggccctgcgacggcctatgcggcttccgaattcacctaggcatgagaggggactgcccgctgccttgcgaggagtgggggtgaaacctaaggtgtggtgtgcttggttagagggagttatgcgaagggtcctgtcacggcctctttccagtatgtcgtggtggcatgtcggcgcacggaaacgtgtcgtggggctatgtcttatgggtacagttgtagacctctgatcagagtaaaactatttgaatagccatgcccgcggttatgggcggtcgaccagattcactgtgattagtcccaccttaataaatcgactcaatgcactgtagttcaggtgggttggttgggcctgttagacatggtgtagcgttgatcagtggagatttaatgttactttaattactcaacatttttactgttttgttcaataaaatgttttacaaccgcctttaagcaaataaccacaaaccgtccttgtgttccccttgcatgtctgcatcgttggtgtggcttgctgagtatggtggttgtactcagccttgctattattcccccttttcagaagtgtagtgcttctgagttgaagacgaagttagaagaccaaggctcagaccccagttgagttttgcctgtggagtggactgaagccccgctaggatcgcctttttccgctgctgtcgttctctttcagtgtgaggactaagtgcctcttctgtaagtattttatgctttatttacatttggaactgtatattacttgtcattttgtgtaccctggctggtcctggacagggatttaatacacaaaatagtctagaaatttgggctaaatttctgggcgtgacaggtaagaaacacaatatctagacaatcaagcccttaactgattttcaaggtggtagatatcttaactaatctagattgacagagcaatttagccaatacaggtaaaaccgtagaaaagatctaatcgatacaaataaattgaataattgacttagactaactaacatatatgataaataggtagcaaatatatcaaccgaaccagagtattatcgtgaaatggcggtcgtgggaacgaatcttctcacatgttcatgcgtcgtgactatttttttccttcctcaccggcatgaattttgaaacaaatctaaagattcaagattatacgaaagttacattcaagttagaatataattgtattacgataatcacatatgtcaatttttaagagagaatttattgacaaatatatagcataattgttcaatgttactgcaacaagcttggaaaactcttgcagttgcagatgggctgggctccgcggctgcgactagctcaacaatgaagctgggccctcatccggccttcatctcgatcacgcaaatggatcggaaatttgaccgtcgggtacacgtgcggactccgactcggatccgcactcgtgtctatttatcgagggactgtttacacccaaatttggcacctaagattaaaataggaaagattgcaaaatttggaagtctaccggtttcctccgagtgggccggtctgaccgccgtgtgttgggcggttagaccgccggttcagggccggtcagaccggcggtgtgtggccggtctgaccggtaggtccaagtccgactgtgtttcgtcgggtttcgaggtttccttgctcgggaaggcatgtttcaggtttcctttagtttctaccccgagttggacatggaggaaggcctgtagagggcaagaccaacccctatataagggacatggccggttcattgtaaaaatctaatctacaatcaatcaatcgaatcgtttttcatactgcttttagttttctcttagtttgtccatctttgtcggtttgcgccgtaaaccgtccgccgccgctgcgagagtgcgacatgtcgcgaccgagaaaattgccttttcccgaacgctagtgtattaatccccgtctcaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctagagctacacagtattattaatcaaggtcgtgaaccctcacgaacctgccttaacccaaggcctacgatgattcagaccgaactggcaacccgaccctgggtcccaactcgtcccaagccaacccaggccaacaattccacattttagttgttgagcaaattttaataattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttacaaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaaccacctaatgttgtcctatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcggagagaacggccttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttatatcaaacattaagagacttgaacgggtcgattcggagctcgcatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatatcaacctaaaggaccgcggtagaccgggtacacagagacggtccacgggtcgacggaagcggaccgcgtgtgtcaaccgaggcgagtggccgacaaacggagtccactagacaccacacgggctgcacacgtggaaaccacgcggctaccgagcgggcacactaacacggtcaccacacgcacaagcgaacgactaccgacaccggtacacgggtaccggggtcgataaccgcacaacgagcacgggcgacaacgaaaggacgaggacggagcagcaagaggggagaccttaccaccacgcgacgaggcgtgggaacgacaacgacgaacaggcgcggcggagacagacggcgagggaacgacttcggcggcgatccttggacgacggcgagacgcggccggcacgaggcttgacgacgcggaggcgaggacgaagacgatgacgggggctgcagcgaccttgacgaaacaccgaggacggacgagaacagctcgacggagggacgaacgccccgacgaccgggaacgacgagaggacgacgacgacgacgaccggggccggcgaggagacgacgagggcagccggcagcggctacacgaagacgaggacggcgtggaccacgccgctgcgatgccgacgacggaggcggcgccgcgagacgacgagccgggcgaccgatgggacgtcgacgacgagaacgatcggagacgacgatgatggaccgcggaggggtttggatggaggggaagcgaggccaagggcgaccttgccgctgcgatgccggaggtggtggtgccgcggctgaccggtaaacaagcgaggaggaacgggcggccggaggactccggcgaggcgggtggaggggttggtggcgacacggcggcttccggtcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttctggcgaaattcgggcgaggaggaggtgatgccggggatgagggcggcgtcgcggagccgagggaggtggtggcgacgtcgaccggcgcttaggcagggagatagaggcggctggaggcggccgacgcggaggaaagggaagggcgacggcgggaacgcagctccgggggtctccgcgggaaacggagggcaagccggggaaggggaggcagctgcgatgctggaggaggcgacggcgcgaccggacgacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaatggggaattaagggggaaagagagaggagggaaaggggattaattccccctaatcaatttgggaatcccatgcttgaatcgcgcggatttgagggaggaatggcgctagggttcacgggagagggagagaggacggccgggcgggaggaggacgatgacccgcctgacgcgtgggccccacgcggccggacgcgcggtcagcgcacgcgcggcgcgcgtgtgcatggccggctcggctcggcctggcttgggcgcggcttgggccgggcggccggcccaggaggagaggagggggaggcggcctgggagaaagagggaggaggagggagtggaccgggaggggaagaggggcccaagaggaggagggagagaaggagagggaggagagggagacttcggccgcgggccgaggggagagagggaggactttgggccagacttggaccaaaggggggagagagattatttttaggttttttttttctttttaataaactctaatatttgtttttgttgcttaataattattttcggtgctctgaaaattccactaaaatttgagggctctttttagaccaaggagaatttaacaaaaattctccgggccacatttgaatttttcttgtacgtattttaatgtttgccaatttcttttcgaattttaattaattctattattccttttagggaatgatttttatttcgggatgaatttatcaggacgtgacacgacatctctttgtaggtttgtcctaaaaacttccgttttgcccacgagacgggtagttatctagaaatcggctccgctagccggtttagttatcaaaacccatctaggtttagctctttgctagatcgaggtggttggcgactctaggatcaccgcaaggcttaaggtgctgcgatcgtgcttgtcaacttgtcaaaaaagatgccaacacgatttttggcgattccactgggaaagagatccgttcatcgtcaactcaacttcgacttcgccatgacgaagccgccatccaagacggaggtggagccatccaatgtgataccggtcacattggaggatttcgaaggagaggaccacaaagttatggaggagtacatcaacgaactcacacgagaggcgttgatgagggcaagcactaggactcgtcaaggggtgatcatcaagcccgggctacttcctaagctcgtccccgatttggtaagcaatgatgaggtaacacaatctatacaacagcaagtagcatctacaatagattcatctatgattgcttttaaagataagttagatgcaacttttgagggtaaatttgatgagtttttaagggttaaattcggtcctcttatggccgattacatgtcaaaggataaagcctctaccactgctaaccaacctcctatagatcaaacgggtagtaaaaccgatggagcggcgcacacggccggtctgaccgggcctgacggccggtcagaccccgacttagccgtcggtccgaccggccaaacggccccggcggtcagaccggtactcaggccggtccgaccgcgcctctggatgccggtcagactgggccctgggccggtcagaccgacgcgattataccgatacagggaatcgatccgatgactaatgctagttatttgtatcatcttaaaacatttgatcctcctgtatctactgctgcaaataatccccagttcccccacatgttcctaatgcttataatgatgttgctagggggtatcctcccgatactagacaaggctaatataatcatattacgccacaaacacaacctattaggccaccaaatccaccgccaaatcaacatgggcctaataatatggaggatataattagtgagattattaggaatagattcgggattgaaactaggaatcgtgctagggtttacaaaaattcgtatcctgattattatgataatgtgccgtttccccgtaattatagagttcccgaatttaccaagtttagtggtgaggatggtaagaccacatgggagcatgtaggtcaatttttggcgcaatgtggtgaggctaatagtgatacttttaaattgggcttgttttctttatctttgtccgataatgcttttacatggtttacttctttatcggcaaattctattcatacttgggctcaattagatgaaaaatttcatgattatttctatactggagaaactgagcttaggttatgtgatttaacatcggttaagcaaaagtataatgagcctgtcattgattatattaagagatttagggatgttagaaaccgatgttatagcttgaatataactgatagagatttggctggtcttgcttttaatggtttaattgctcctcttagagaaagactagatgaccaacaatttcttgatgttagtcaacttatgcaaagagctctggctcaagaaagccgggttaaggataataaaaaacttgttagatcatatgacaaaaagcctaatgtgattgattaccctgaggctagtgatagtgaggaggagggtgatcatgatatatatgttgctgaatggtcatggactaacaaagacaagccttttgtttgctccaacctaatgccgactcctcgcaaagatcggcaaagtgatgttaaatatagttttgatgtggccaagtgtgataagatttttgattatcttttacaagaaagacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaatacaattaatttcaataataaaaaggtgttgattcggccggagcaagccgaatctactaaaggaaaaggagtaatcattggtgaaccaagaccaaagatgatagtgccaaataagccggaggttggtgtttggaaggaaaataagagtgaagcttcaacttctaaagcccctaggaagaccaaagtgacttttgatatgcttttggagaaatatgagaagcaaggtggtgagagaattcgcaacaaaggaaaaagaccaagatcacctcctaggaagcgatttggtcattcaccaagacggtcgcattcacctccatatcatcatccacaagacatgtcatggggttcttatccaatgccgccgccgggttatccttatccttattacatgccatggggggcgacgctgccaatgttcaatcatatgcctccaatgcaattcaaccaagggtggggaggaccgaggaggccaattcatgagcgtttgtcttcaccaaacaatagccggttttatggtaagaatcgggctaatgaagaaaagagggaaggaaagcgcgtcaaggtggaggcaaggacttcagaagtaattaccatcaaagtggggtctcatgatgtgccaataccttttggagatggagttggagtatcctcaaacaaaaaatccgaagccgaaaccagctcctcgcagtcggccggtctgaccaggccttctggccggtctaaccgcaaccatgcgaccggtctgaccgggccatcaggccggtctgaccgccgacccgacagcagtccgaccgacgcctcaggccggtctaaccgtgcgccaagtgtcggtctgaccggcgcgtctggccggtctgaccggtggtctacgtccggtctgaccgggctccagcgccgttttgacaggggaattgcaaagggctatgtgagggcttcatcgtcttcaaacaagattaataggggacattatttacctcctggaacagagtcgaatcctaggtggatgcctaaggatttgacggctactcaaaagagaaggttgcaacgtcttcgggcttaagagataagagagataaagggttcaatgagttgcgaccgccatcggtatggaggcgtaaatccatagagaaggaaaagccggttgttgtagaggagaaggaggagcaatcggttgataaaggtgaatcatatccaaaagaagacatggatatcaacatggtatgtatgttacctatggagttttgtgctatggatgaagccgaggttgctcaattctcattaggtcctaaagacgcggtttttgagaagcccaatgagtcaaaccgtcacatgaagcctctttatctcaaaggcaatgttgatgggaagccggtctctaggatgctagtggatggaggtgccgccgtgaacttgatgccgaactcattattcaagaagttggggcgtgaggatgatgagttgaaaaagaccaacatgattctcaatggcttcaatggtgaaccaacggaggcaaagggtatcttttcggcggagctcaccgtgggaaacaagacgctaccaaccgctttcttcatcgtcgatgtgcaaggtaactacaatgttattttgggtcgttgttggattcatgccaatttttgtgtgccttctaccttgcatcaatgtttaattcaatgggacagcgatgatgttgaaattgttcaaacggatacattagccgaggttgcaatggccgatgctacttttgagtggcgtcatgggaatatccaatgcttatcagttagggatctttctagctatgattttattagtatctccgatggcaaatttgtacctatctctgtaaagcctgctagtgtagcacggctaagccatataaatttgtataatgagtaaggaggctaatttagaatggttacaaaagagggtgcaagaatatcggtctgcaaagaacgatattggtgaaaccgttgaagattttgatgaagtggagaagcttggataagggtttgcatcggccgatccattggaggaagtggacataggtgtggaaccaaaccaaggctgacttttgtaaacaaaaatatgagagccgattataaggttaagataatcgagctacttaaagaatatgttgattgctttgcatgggaatatcatgagatgccgggtcttagccgcgagcttgttgagcatcggcttccaattaaaccaggttttaggccttataagcaaccacctcatcgttttaatcctttgctatatgaccgggtcaaagaggagattgatcggttcttgaaggcggggtttattaggccatgttgttatgcggagtgggtttctaacatagtcccggtggagaagaaggggagtggtaagattagagtttgcatagattttagagatttaaataaagccactcccaaagatgagtatcctatgcctatagccgacatgatgattaatgatgcctcgggtcataaggtgattagctttctagatggtaataccggctacaatcaaatctttatggcggaagaggatatgtacaagacggcttttaggtgcccgggatttgttggtttatttgagtgggttgtcatgacttttgggttgaagaacgccggtgcaacgtatcaaaaggcaatgaatttgatctttcatgatttgctaggtattatcttagagatctatattgatgatattgttgtcaaattggatggtatggaaggacacatagccgatttgagattagcttttgagaggatgcgccggtatggtttgaagatgaacccacttaaatgtgcttttgatgtgtcggcggggaaattcttaggattcatggtgcatgagagaggagttgagattgatcctaagaagatagaaaagatttgtgatttcaaagcgccgacatgcaagaaggaagttcagaagttgctaggtaaggtaaattatttgagaaggtttatttctaacctagcgggtaaaatcgatgcttttgttcctatacttcgcttgaaaaaagaagccgattttacttgggaggcaaaacaacaagaggcgtttgaagagttgaagaggtatttgtctactccacccgttgtgggagcgcctaaagccgaaaagccttttcggttatatattgcctctgaagacaaagtcattggtgccgttttgacgcaagaggaagatggcaaggaatatatcattacatatttgagccgccgtcttttggatgccgaaacgaggtatgtttttatagagagactttgtttatgcttatactatgcttgtaccaaattgaggcattacttgttatctagtacatgcatagttgcttgtcaagccgatgttattaaacacatgttgcaaatgccaattctaagtgggaggattggcaagtgggcatatgctttgatagaatatgatttggcttatgaaccattgaaatctatgaaaggccaaattatatgtgattttatagtggaccatcatgtagatattgcttatgaggaaaaggtttgcttagttgaagttataccttggaaaatttattttgatggttcttcttgcaaagaaggtcaaggcataggggtagttttgttttcacctaatggcatgtgttatgaagcatcggttcgtttagagtattattgtacaaataatcaagctgaatacaatgctttattattcggcttacaagttatggagatggttggagctaagtacgtggaggcttttggtgattcggaattggtggtgcaacaagtcgccggagtctacaaatgcttggacggatcactaaataggtacctcgattcatgtttggatattattgccaattttgttaattttgctattagacatattgctaggcgtgataattccggagcaaatgacttggcacaacaagcatctagctataatgtgaagaagggattatttctgatattagaagaaccggtgcttgtttttaaatctttgtgtgaaattggcaaaactggagatcaggggcggtctgaccggcattgcgtggccggtctgaccggtgaccaagggcggtctgaccggccacatgccgccggtctgactggcgaccccgagcggtatgaccggccctgtgtggtcggtctgactggttctgggcagagcgctggggggcacgtttcaatcaatttagaggccgaatcaattgtgaattcggacatttgtgcccaggaagcagaagaaaattggagaattcctttgattcgatatttgaaagatcccacgcttaaggttgatcggaaaattcggcagcaagcgttcaaatacacattgcttgatgaggatttatatcgccgaaatatagatggtgtcttgttgaaatgcttagatgaagatcaatctaaagtggctatgggagaggtacatgaagggatttgtggaactcatcaatcggcccacaagatgaattggttgcttaggagagcggggttctattggccgaagatgattgatgattgcttcaaatattatagaggatgcgaggcttgtcaatggttcggcaatgtacaattggcgcccgccgccgtgttgaaccctataatcaaaccatgccgttccgaggatgggctttggatttcattggtcaaatttatccttcgtcatcaaggggacataggttcatgctagttgctacggattacttcaccaagcgggccgaagccgtgccgttgaagaatatgactcatacggaggtaattgactttattttgaagcatattatccatagattcggtattccataaacattaactacggatcaaggtgcttcttttatgtctaaggaagtgaaggttttgccgaatcttatggtattaaattgttgagttcttctccttactacgctcaggctaatggacaagccgagtcgagtaataaaatgttgttgaagtaagtgaaaaagaagattgaggaatacccaaagaggtggcatgaggtgctttctgaagcattgtgggcacataggatatctaaacatggtgctactaaagtcactccttttgagttggtttatggtcaagaagccgttttaccggtggaggtaaatcttggttctcttcgttatatcaagcaagatgatttgtcaagtgaagattacaagacattgatgggagacaaccttgatgaagtcatcgacaagcgcttgaaggcattggaagaaatagagaaagagaagaagagggtggccaaggcgtccaacaaaagggtgaaaggaaagttgtttcaagttggagatttggtttggaagacaattttgcctttgggtactcgatccaaggagttcggtaagtggtttcctagttgggagggcccttatcgaatatgcggcattgttcgaggaaatgcatattttttagagacacttcaaggggagcgttttcagcgagcaatcaacgggaaatacttgaagaaatacttcccgagcgtttggcaagacgcttaggaggtactatggctggtaattggattatcgtcctaagaccaaaacatgttctatgcttttagattcacgttgttcatcaaaaagacagggcggcatgtatttacacccaaatttggcacctaagattaaaataggaaagattgccaaaatttggaagtctactggtttcctccgagtgggccggtctaaccgccgtgtgttgggcggttagaccgccggttcagggccggtcagaccggcgttgtgtggccggtctgaccagcaggtccgagtccgactgtgtttcgtcgggtttcga

SEQ ID NO: 64552 - DNA, 14243 bp, Oryza sativa
agcctccctcgccggagcaggtgggatgggcggaaggcgcagtgatctccgcccagtcggcggcggataacatggcgtcctatgtgctggatctcaggaggggcctggccgtgttcgccgggaccgggcgccccgaggaggcggtgctcaggaagaacgtcgcgtgggccgacgcgcgccgcgcggcgcttgctggagaaggagctcaggtgcatggcggcgagagaccaccccgtcattccggagcttgcggcgctgatcaccgccatgcgcgagtccaccaaatcactggtcctgcaggactccggcgatgatgccgtccgtagccgtaaggccgggttgttggacagcgcgatcaagttcgaggacgccgtggtggggaagatgaccgcgttgaaggagaagctcacgcgtggcgccgccgccttcgtgggggaggaggagatcgtgcaggcgctgaacaagcacgccgcgacggccgaggcggagattgcagaatcacaagcgttctctgcggtcctgttagccgatgccaaccgagcagcaattctcgtcgttgtcgtgcacaagaggccggcgccggagacggagacggagacggaggaggaggaggagccgccacgacagaggcgaggcacaggagatgccggagacagtgccgcacaagactagctatagctagattagcaaactctgtgtttcctgtctcgtgccgatcgatcagctgttgatctacatcttgtaaatctaattagtccatgatcgatctgattttgttaatctacatgtaatatcagaccaatatacaggttgtgtcgtatgcatatactagttagtcatactccgtttttccctatactagtgcagggatgtatcgcactggtataggtagaatccttgagaagagtaacgcggacgaacaaagacgatcgatcgaacagagcaaaaattcaggcacccctgtaaaaagctactaccactagtcagatttgaaaaaaatatcgggggccgggcctgggccgtgccgcccatttggccatctatatacctacatatttgtcgacatatttgtaaggaaaaattatttgatatttcatttcatagatgaatggtagtaattcatctaagttgtctctcaacgatgagaattagaatctaaatatttctcgaatatttgacttagaatactactattactttgtggatatagaaaccggagaaggagaagaagctagctcaggtgcttggcggctagagaccaccctgtcaatccggaggttgcggagctgatcatgcgcaaggtcaccatcaatcctgtcggatttggtgagaaatccgtgtgttcttgagtgtttgagtgagataaaagttaggttgctaataatttggtatcagatccttgttggaactttttattctctccatcgctctcttgatctgcggtaaaactcatggaagaggtaggaattgttgcttcggtgatggattccacagaagcttcggctccctcgactaggttcatgagattcaaagcacgatttcaaccacaacatactaagccccgatacgtgaccaagcagggggccaagatcatggaccaggacagcaagatggaggcgtccgataagaagcaggaagagagcgagaagtggagggagcaatcagaagagagagtagggcagagttcctgactctccaggtgaaagtagaatcaaggatttgtgaggtgtagaagcatgatgatctcatgcaggatttggtggaagaattgcaagagaaagtgggaagttgctaaccatggttcagaattcatctcatgagactcttcctgcgcatgcacgagtcctacaacaaaattactacaataaaaaagtgctacttatacaattttagtagttagaaaataaatattattcttttgatttatatttaaaactaaattttgttgtaaacaatatcttgtataacaaactcataaatataatagtctcataattattattcaataatcaatcagaattttcgttttagatttattttgttggtctcgtgtcgatcaactgtttgatctagatatggtagatcaatcgagctaattattcgattcgattattaatgggaccacctatacatttgtcgacacatttccttttagaaatttgataaatgtaattatgtaattatagtacaatcgtgatataattacattgtaagttaaatataactacaatgtaactttgtaacttatatgtaactttcaaaaatccctccgtaacatgctatttttgtgaaatagaggtcgtgcaaacgaatcttctcacgtgtggttgttgatgaaaaatctacgctcgggctatggtgcgagatctgtgttgatctagtgcagaactaagacgacgaacgcaacggcctagcagatctgcttagctctagtgcagatccaaaatattgatgagatgcgggcgtgccagtcagtttgatcatgtaactaacaagctatataaagtgaaaatcaaaaagtcgattggcttacaagccgatatagctgtttgacgtattttgtcaattttcaccaagcaaataagattactattcagcttctaagctagcttgattgttggatttttatgagatgcatgcatgcatgggccatgcagtactgtgcacgtgttaactggtgcatacgtatatatatactcgtatctagccaaccatatggctcatatgcatgaatgaattggccaacaggagagatgagctgctctgtgactcatgggctcgcgcgctcgtggccgtatactcggcgtatacgtatacgtataccggacggttttccataggcttaaaaagcagcgagctgggacgtattaatagttgggctgcatatgggctggcggagctgcactacatgctcgtcgtgaacatgcggctagatatctaacgcgtacgcggcaggcgaaatttctctccaacggcagcgagatacggatgtggaactgacaacgtcggataactcaagtcttatctgatgatttcggataaggagttatccgcggcaactgtacccggaaatatcggagcgatcacgcgtggtcgcggcatgcgcgcctgctcgttaggttttcctccgcgcctatataaagccaccaagagacggcgccaggggatggacaatcattcaactcccatcgatccatccatcggcggcggccgcgtagaacacataggcgaccacgtactcaggcatcgctatagcacaagccttgttgacgtgacttcgccggagcagaagcggtgcacgccgcccgcgctcggcagcggcgtctggcaggaggacgtgcatctgaccatcagccatcacgggaagaaagccgaggtcgatggctgtccgaggtaagagcgctaattagattgtttcttcttatattttgcagcacatgcatgcacgggcagatggagaaccacaacggagaagaagcagatccatctacacacatgaagaacacacacaagagaaaacatgtacagggcctcggcggaagggcacgccaacgtgtgcgccgccggccggcggcagcatggcgcaccaaaagtgtggcccgccgggcgtcgttcgatgctgaaaatcaatcgatcaacacacatccatctatcgactcccatccggcgccgtcaacacatccatccaacaattctcatcggtgatccatccagcgccgacacgcaccggcggcagcgagcgacttcggccggagctccggcgtctggcaggagagggcacgcgcggtgacccgatcatcggcaagcacaggagggagtacttcgacgaggaagaaggaacttgatggctaccaaggtagaagctagcaagatcgtttcgtttttctttcatctacagcatgcacacatccatctacacatatggtcgccgccggtgaaagttgcggtggccgattcatctacacgcgatagaagcctcatcgatgccggcgcccatccgagtcgacaagatgtctggacccgacgccgccaatttaagccgctggtggtgcatctactagaagccgcgacgtcgccaaggtgccagacgtcctcgctttgctgcaagtttcaccgtgccggagcagactgactatgtcgaagtcatcgtgacgccgcgccctgctggagcacgtcgaagatcgccggagaaggtcgtcgtgaagttattccgtcggagcacgccgaagatcgccggagctaccgccgactgccatgacttctccccgcttttatgccggaggtcaagcatcacgtacgtagggcgtcgaaaccagcagatgacaacgaaggcaagtgtggctgcagcacaggagggaggatgacgagctgaaactagcagatgcatgctaattaagctaattattgtggtaacgtggccgaccaaccggagggtggcacatcatcaccatgctacagttgcacaagaagtcgtcaacgcgacggctaaagtaaacaaatcctgttgatttcaagctttctcaattagatgccgagctgtgattaaatccggctgccgtctacatcgtccacctcgttgccgatgctctaacgctcgccatccctgctcaagctaccggtgatgctgtctaccggataccgccatgtcgtcgagatgcgccgatgcccccatctcgccaactgcggcttctcttctgtaatgcgcgccgtaccctcgccggcgatcgcaggagcagccacgagtgtcgcccgagctgtttctgatccaggagacggtggcagtcgctgggatgttgctcaaggagccgtcgacatgccaccctgctgtgacgcactgaaggtccccggagcagtcgcggataccgtcgaggtgcccgtacgccgttcgtcaagtctggctgtgattctttcacttcatcacgccggagttgccatgtcaaccgatctgttggcgctgatcgcaagcgtctgtcaagctcgatgccactcgtcctcaggactgatgccatctgttcgagctgccggtgatgattctactcgttgcgatctcgccgagatattaaacgtcgtcgccttttgccgaccgctgcctcgcaacaccgtcaatatctacccaccctcgccgccgttgcaatcttggtgcccacacgctgtcgtcaagcccggccatgattctttctcgtcatcaggctgaggtcgtcgtgccgtctatccacgacgctttcacttcatcacgctggagtcgttcgtgatgtcacaagacaatcacgccggagcaccactgctcggtgcccgtaaaccatcgtcaagccggagccgttgtattgtccgtctgtgatgcctttacctcgtcaagtcggagttgccgtgttgtctatccatgacatctccttctcttcacaccacatgataagatgtcatctgtctacgatgctttcacttcatcacgccaagatgagagctgtccgtccgtgatgctctccccttttcgtcaagattgatgcctcttgtccgtatattggagcgtcgctcgtctacatcgacataatgcaagaatggtgccgtctgtgatgccaaggaactattcatgctgaatctacaccaacaataccctcggttgttccgccgatgagatattcacttcttccaaggtcgtcgtcgctaccgacgctctcatggagccccttttatgggctcgtcatcatatcaactgaatcaatagtagatccattatccgaaggaggtgccagagccccgttcatccggctgttgtctgcaccaacttcttcatcaacctcttcgttacatgtccttgttgtataaggagcttgacgagccaggaggtgcccaaccatgtgtaatccggctgccgtctacaccaactgtatacgtcattttattttcatctagccaggaagtacccagccatggatatgcatgcggctgtcgtctacaccaactgtcttcgtcaattcttcgttcgtttgatctcgacgagccaggaggtgtccagccacgtatattcggctgttgtgtacactgacttcaccaacttctcttccctttaacaccatcccgacaccactattgtgacgtctcaaccgtccaagctatggagatccatgcatgctgaagattaaccatctacaccaccacgttgctcaagactgatgaggcggagtgaaagggcgggcggagtctatatgaaggctacgtcaccaacaccggcgcacggaccgacgaggccgtggataagttgccggctatcacgccctgaagtttcccccttcttctttcttaaaaatttgttgaataaatcgttcgaagaaaatggtttaatttaacctagagttgaatcctaaattaataaatgcaattaataattggaattggcatgatgggatttttcttgagttccacatgtcacaatatattaacaggatttttaatggaattttcagagccttagaaataattttaaccaattaaaaatgagcaagtgcaatattttaaatcccaggaaaatccttttcctttgtctcttttcttttcctttctttttctcttgatgggccatcggcccagtccacctaacctcaccccgcgctcgggctccccttgttgggccggcccatttccccttccctctccctccgggacgctgacaggtgggccccacctgtcggggtcgtccccttcctccaaccgccgccgccgaaaccgccgcgcccacctcctccactcctcccgcgcccactccgcgtccacgtacgcccgcacccacgtcgtcgcccacgccccgctttcccgaccgcgcgcgctcgcacggggcgggattcaaatttgaatcccccccctctatctccccactcccccacatcgccggccaaatcaaccaccctcccggccacgtccgcccctcccgtgcctataaaattgctccccgcgtccccctctctcgtttttcgctctcgccgcgctcccccgtgcctcctaccgtcgctgcgccgcgctcgccaagcttcgccgccgccgaagctctccggccgcgtgccgtcgctactacagccgccgccacatcgcgtaaccgccgccgttagcttcaccgccgcgagagctacatcggccaccgctcacttgccgtgccccatcaccgtaccgctctccccacacgccgccgccgctagagccgtcgccgcgcctccgctcgccagtcgtcgctgccgccttcttccttcgcgccggccgccgtgctcgccggtgaggaatcccctctcctcctttctttcctctctcccatgagcgccgccgccctttgcgcatgcgtcgtcatctttggccgcgccgccgctccggccgtccgccgccgcctttcgcaccgtccgccgccgcttccctccgccggtcgccgtcgctccccatggccggccggccggctttgtgccaagccgagccgtgcctagccgccacccgcgccgtccgatcggcctcgggccgattcggaccgtcggtcccgtggaccggcggtggaccacccgcgtggtcccggtccatggtagaccggcctccctttgtgccgctgacatgagggccctgcttgccggcgccaccccccgccttcgctgacgtcagccctgggcaatattgcgcaataaataattaaggactttttccttgttagtaaaaacacatattatcttctaaaattcatacctaattcatcttagctccatttaagtccattcaagtctcagtaaattcataaaaatccctagaatccattcaaaatggttttgttctctgtttcagcagtcttatagcatgttttgcttgtgtgctttgtttgtcgcgtagatttcggccgtttcgtcgatccgcggttcctcgaagacgttgctgtggtctcaccagtgcgagagcaaggcaagtcatgctttacatttgatcatattgtacccaatttacaaatatccctcatttctattaaatgttgcactcttttacaatgtcatgtgggatgggtcctactactcagccatagattgtttaccatatgccattgataacttgggtatcaaaatgattagatgttgatttagaaaatgcttagccatgcctagttcaactagtacacaagtggggattacattattacatagactttgtctatcagcatagttttggattggtgccaccgcaatggtgttagttaattaaaatacactgaatggtgggttgtgggtgcatggtttcgctggtcgcacccatggcaggtaaggaccggttcacgggaaaccctaggagactaaccgtgcttaccataaataggagtgggtaactgcttgatctgaagtatagctcgaccctttcctaggcaccggtggcgagggagggcgtgatggagttgggtcggccggggtgtccggttgtccagctgccggattcaccacggcgcaataggggaccgcccattgccttttgaggggtgggggtgaaaccttagcgtggtgtggatggttaggggagggttatgcggagggtcttgtcacgatttccccctttgcagtatcatggtgatacttcggggcatggcgacatgtgtaggatcgtgtcttgtgggtacagttgtacacctctggccagagtaaaactattcgaatagtcgtgcccgcggttatgggcgatcaaccagattcatcgtgattagtctcacccctagtttagcttaatgaactggtgtagttcaggtggttggttgggcctgttgcaacgtggtgtagcgttggacagtgattggttaatattgattaattactacagctcttttactgctttcaactactgcttttaaatgctagcttgatgcaaaagaacccctagcctcctttggttatatcctgcatcatacctcctcttccggtatgacttgctgagtacagtgggtagtactcagtcttgctctcttttcccccacaccagagctgaagatcctcctagttggagctgtcttgttgaggttggtttcgtcgctgccgtcaagggatgcctgtggagtggagtcgccccgctgctgaagtcaagctccccagttagcttgttttatcttttccgctgcatttgtaatcttttatatttttgtaagacgtggatctgtatgtcaacaattgttgtttgtgtaccctggctggtcctggaccgggatttaatgcacattcagcttagaaattctggttcgtgaatttctgggtgtgacaagttggtattagagccgaccttgaccgtaggacaagccaactggaaacctaagagccctttgatccccttttcatctgcatatgctctttgcacttggatttgtttcggaaaaaatttggtgttttgcctctttggtttgtgggaaaaatcttggtcgttcattcggatcggatctttaaaattagcttagtctagggttttagtaaaattttatttggagtttattcgtcagtcagtcgggaaactattgggtgatatgcatttggtcgtgtctatgttcgatagggcaattttatgcgcatcattatagctatgcatctattttatgcattaatttattgtttagtcagttgcattagtgtctttatctaggttcatgaaaaatgttctatgcataaaaaaatcatcaggctcggttatttatttgagtcatttgttgctttgtctaatttggacttgagcattaattggttcttatcccttgtctactttagatgtcagtcttatccctcgattgcaagcgccgctccgagcttcagagtcgctgtccttagctttatcgtcttcttagttttgtttgcttgctagtttccgtgtttaggtttcttgcttgtgggttagtcggcggtcgatatcatgtgtcagtggtatggttgtcttaattaggagttgtttcctttcttttcggtgttttaatcaagattaagataattgcacttaagtttataagaaagattagtttctaagccatctgtttttctccctttctcttatttctacatatcccccttcagatggtgaagacaaggaatggttctcaatccaacaaggtcagtggcagtgaagagcagatcaatggaccacgtgccagcggtgcatctgatagcagttcatctccaccactcgagaaccctacgattgctcaggtgttggacaatcagactcagatgataacaatgatgatgcaacagatgcaacaacagtaccatcaggtgttgcagcaggtgcagcagcaagcacagcagcagcagcagaacctgtagtttggtcctccacctccttagtccaaactgttagaatttctccgtgtcaagccgcccactttctcaagtaccaccaacccaatcgaggccaatgactggcttcgtgctattgagaagaagctgaaccttttgcaatgcaacgaccaagagaaggttgcttttgctacacaccagctgcaactgcaaggtcccgcttctgtttggtgggacaactacatggtgacccgtccagctgggacagaggttacttggatagagttttgtcagagttttaataaggcacaggttcccgagggaattgtggcacaaaagaagagagagttccgttctttgcagcaaggaaccagaacagttatagagtatctacacgagttcaaccgtctcacgcgctatgcccctgaggacgtgcgcactgatgccgagaggcaggagaagtttttgtcgggtcttgatgatgaattgaccaaccagttgatctcccaacattatgaggactttcagaagttggtggacaaagccatccgtcaggaagagcagtgcaacaaaatgaaccgtaaaaggaaggcagttcagttcaggacttcccaggggattagtcagaagcctcgcctcacgatgggacatcagggtggaccttccaccatgattatccagcagcaccgtccctaccacccgggtagcttcgacaagaactaccatagtggcagtcacaacaacagtgagcagcacagcctcaatccgactccaagttcactaatgaatgtagctcagtcagctctaccagctcagccagaacagcccaagaagtttggagaaaagcctgacctctgcttcaattgtaacgagcccggacacatggttggtaagtgcccgaagccaagacgtgccggactcaagttcgttcaggcccatgtcaatcatgcatctgcagaggaggcacagtcagcaccagaggttatattgggcacatttcccgtcaactcgacaccggcagtaatattgtttgattctggtgcaactcattccttcatttccaagcgttttgctggtgcgcatgggttatctttagtgaagcttaagatacctatgcgagttcatactcctggaggtggcatgaccacaactcactattgcccatcagtaacagttgaaattcaagggttgatttttccagccaacctcattcttctcgaatccaaggatctagatgttattcttggaatggattggttgacaaggcacagagtgattgattgcactagccacaccatcaagttgaccaatgcgaaaggagaagtggtaaccttccagtctccagtattgcagaagccagggatcagtttaaaccaggctgctggtgaggaacaagaggtagcagtggagaaaaccactaagaagttggaagatattcccatagtcagagagtatccagaggtttttccggataatctgacaacaatgccaccaaaaagggatatcgagttccggatcgacttggcacctggaactgcaccgatccacaagaggccttacagaatgggagccaacgagttggcggaagtcaagaagcaagttgatgaacagttacagaagggatacattcgcccgagcacgttgccttggggtgctccggtaatctttgtggaaaagaaagacaaaaccaagaggatgtgcgttaactagtacgcactcaatgaggtcactattaagaacaagtaccctttgtcaaggattgatgatctgtttgatcagttgaaaggagctacagtgttccctaagatggacctgcgatcaggctatcaccagttgaggatccgtgaagaggatattccaaagactgcattcatcacttgttatgggttgttcgaatgtacagttatgtctttcggactcaccaacgaacctgccttcttcatgaatttgatgaacaaggtgtttatggaatttctagacaagtttgtcgtggttttcatcgatgacatactgatttactccaagtccgaggaagaacatgagcagcatcttcggttggtacttgaaaagttaaaagagcaccagctatatgccaagttcagcaagtgtgacttctggcttaaggaagttcagtttctcggtcacatcgtgaatgctcaaggagtagctgtggatccagcaaatgtggagtcagttaccaagtggaccccaccgaggacagtcactcaggttcggagtttctttggacttgcgggctattaccgccagttcattgagaagttctctaaaattgcaaagccaatgacacagctattgaagaagaaagaaaagtttatctggtctgctgaatgcaataggagttttgaagaactcaaacgacggttggtgtctgcaccagttttaattctgcctgatcagacgaaagatttccaggtttattgtgatgtatctcgctaggggttagggtgtgtgtttatgcaagatggcaaagtggttgcttatgcatcacgtcagttgcgtcctcatgaaggcaactacccgacccacgatctggaattggccgcagttgttcatgctttaaagatctggcggcactatttcatcggtaaccgttgtgaggtatatacagatcacaaaagtctaaagtacatcttcactcaacctgatttgaatctccgacagcgaagatggttggagctaatcaaggattatgatatgggaatacactatcatgccggcaaggctaatgtggtagcagacgccttaagcaggaagagttactgcaatgttgcatgggtagagaaactgtgttgtgaggttaaacgtgatttggaacatctgaaccttagtatagttgagcacggattcgtggctgccctagaggcacagcccacattggtggagcaggttcgcatagctcatgcaagtgatcctgaaatagcagagctcaaaaagaacatgagagttggaaaagcccgaggttttgatgaggacgaacaaggaacaatctggatgggagaaagattgtgtgtacctggatgggagaaagattgtgtgtacctgaaaacaaggagttaaaagacctgatactgacagaagctcatcaaactcagtattcaattcatcccgacagtactaaaatgtaccaagacctcaaggaaaaactctagtgggtaagcatgagaagggaaatagctgaattcgtcgcactctgtgacgtctgccagcgagtaaatgcagagcaccaaaggccagcaggtttgctacagccacttcagattccaaaatggaaatgggaagaaattggaatggatttcattaccggtttgcctaggacatcatcggggcacgattctatttgggtagtcgttgaccgactctccaaagtggctcacttcattccgatgcacactacctactcagggaagaaattagcagaactttatctggcaagaatcatgtatctacatggtgtacctaagaagatcgtgtctgatcgaggaagccaattcacttcaaagctctggcagaaattgcaagaagaattgggaacccgtttgaacttcagcacagcctaccatccgcagactgatggtcagaccgagcaagtcaaccaaatattggaagatatgttaagagcttgtgcgcttgattttgatggagcatgagacaaaagcttgccgtatgccgagttctcctacaacaacagttaccatgctagtctgcaaatggcaccatttgaagcactgtatgaacggaggtgccgcactccgctcttctgggatcagacaggggaacgccagttgtttggtacataagttttaaatgaggcagaagagaaagtcagagctgtcagcgaaagattgagaatcgcgcaatctcgacagaaaagctatgcagacaatcgtcgaagggagctcgctttcgaagcaggggactatgtgtatcttcgtgtcactccgctcagaggag

SEQ ID NO: 64553 - DNA, 10706 bp, Oryza sativa
aaggggggtaggtttgtcaccccatgaagtttcccccttcttctttcttaaaaatttgttgaataaatcgtccgaagaaaatggtttaatttacccaagagttgaatcctaaattaataaatgcaattaataattggaattggcatggtgggatttttcttgagatccacatgtcacaatatattaacaggatttttagtggaatttttagagtcttggaaataattttaatcaattaaaaatgagcaagtgcaatattttaaatcccaggaaaatccttttccttttttctcttttcttttcctttctttttctcttgatgggccgttggaccagtccacctcgcctcaccctgcgctcgggctcccctcgttgggccggcccgtttccccttccctctcccttcgggacgccgacaggtgggccccacctgtcggggtcgtccccttcctccaaccgccgccgccgaaaccgccgcgcccacctcctccgctcctcccacgcccactccgcgtccacatgcgcccgtgcccacgtcgtcgcccacgccccgctttcccgcccgcgcgcgcgctcgcaagggacgggattcgaatttgaatcccccctctctctctccccactcccccacgtcgcgggccaaatcgaccaccctcccgaccacgtccgcccgtcccgtgcctataaaattgctcctcgcgtccccctctctcgtttttcgctctcgccgcgctccccagtgcctcctaccgtcgccgcgccgcgcttgccaagctccgccgccgccgaagctctctggccgcgtgccgtcactgctacagtcgccgccacatcgcgtaaccgccgctgttagcttcgccgccgtgagagctacatcggccaccgctcacttgccgtacgccatcgttgtaccaccctccccacgcgccgccgccgctagagccatcccgcgcctccgctcgccggtgaggaatcccctctcctcctttgtttcctctctcccatgagcgccgccgccttcgcacgtgcgtcgtcgtcttcggccgcaccgccgctccggccgtccgccgccgcctccctccgccggtcgccgccgtcagcagccgcgcgcaccgccgccgctccccatggccggccggccggctttgtgccaagctgagctgtgcctagccgccaccaacgccgtccgatcggcctcgggccgatccggaccgtcggtcttgtggatcggcggtggaccacccgtgtggtcccggtccacggtagaccggcctccctttgtaccgctgacatgcgggccccacttgtcggcggccgcccccctccccttcgctgacgtcagccctgggcaatattgcgcaataaataattaaggactttttcgttattagtaaaaacacagattatcttgtaatattcatatataagtcatccgagctccgtttaagtccattcaagtctcagtaaattcataaaaatccctagaatccattaaaaatggttttgttctctgtttcagtagtcttatagcatgttttgcgtgtgtgctttgtttgtcgtgtagattttggccgttttgtcgatccgcggttcctcgaatacgttggtttggtctcaccagtgcgagagcaaggcaagtcatgctttacatttgatcatattgtacccgatttacgtatatcccgcatttctattaaatgttgcactcttttcaatgtcatgtgggatgggtattactactcagccatagattgtttaccatatgccattgataccttgggtatcaaaatgattagatgttgatttagaaaatggttagccatgcctagttcaactagtacacaagtggggattacattattacatagactttgattatcagcatagttttggattggtgccaccgcaatggtgttagttaattaaaatacaccgaatggtgggttgtgggtgcatggttttgctggtcgcactcatggcaattaaggaccgcttcacgggaaaccctgggagacttaccgtgcttaccacaagcgggagtgggtaactgcttgatctgaagtatagctcgaccctttcttaggcacgggtggcgagggtgggcgtgatggagttgggttggccggtttgtccggttgtccagctaccggattcactgcggcgcaagaggggaccgcccactgttttttgaggagtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcaccctagtttagcttaataaactggtgtagttcaggtggttggttgggcctgttgcaacgtggtgtagcgttggacagtgattggttaatattgattaattactacaattgttttactactttcaactactgcttttaaatgcctgccttatgcaaatgaacctttagcctcctttgcttatatcctgcatcatacctcctcttccagtatgacttgctgagtacagtgggtagtactcagtcttgctctctttttccccacaccagagttgaagttcttcccagttggagctgtctcagaaagtttggttttgtcgctgccgtgaaggattgcctgtggagtagagtcgccccgctgctgaagtcaagcttccaagtttagctcgcttttatcttttccgctgcatttgtaatcttttatatttttgtaagacgtggatctgtatgtcaacaattgtcgtttgtgtaccctggctggtcctggacaggggtttaatactcattcagcttagaaattgtcacgcccggaatttctatccaaaattccaaacgcttacatgtgtgtgaaccctcgtccaggaatcaaccgaggcacacaataacaaattgataatagagtacaattattactctaattaataagcgaataaaatgtcattacagaggtagatagttcctctcaaccaataaagatctaagcagcggaaaaataagataaacggcgcagacgactccactccataggcagcttgaccagggctacacctaatcctgcacaccatcagcatcactgtagaactcctcctctgatgaatgattgcaaggtgagtatatgacatactcagcaagccacgcagcaaatatgcaagtgcacaggataacaaaggatggcatagtatggtttcatttgcataaatagcatttaataaacatttcagaatttaataaaacagttaagtaataattgaacaatattaatccaacgctatacaacataccctgttgcataggcccaaccattctgaacaaccatcccggctgcacagttctatctccaaaccaggaatgtaccattccaaacaaggagctaatcaaattattaccagttatagcatcttttattatgatgagaagtgtgaaactaatcacgaaagacattgttagacccgcccataaccgcgggcacagctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctccaccacttctcagtctggtgccccgcaatgaaccatgttatacaaaaggtaaagccgttgcccatgctagcttgtgattggcacggttaatgtttcacaaccgaaactcgtgaaccggttcttaattgtcatgagcacgaccatcaaaaccatatgctcacaacccaccattatcaagttttagttggcaaattaattaattaaccaatcacgatcaaccatcgtgagcttccattaagccatcattaaataatagtgagtcacaaattatcccaatagtgtgctaatgtttctaagcatggctaagcaatcatatttaatatctagttgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaagggaattattgcgtcagcggctagggttcgcggtggactgggtgcacggcggcggttcacgagattgggcggccgagatcgatccatccaaaacggacggccaagatccatcggtccaccgcggctcacggatggacgatgacgatgacgccagcgacgacgtcaccaccggcggcggctcgggcgcgcatgctcgccggcgaaccacggcgcgatgacgcgaacggaggacaccaacacgtagcgggcgacgcggcgaactcaccggtgaccaaagcgacggcggacgatgaccggacgacgtcggcgacgaggaaaaggcggcggcactcttcggcttgacgacggcgacggtgttccggcggtcgacagcgacggctgaggggcggacaaggacggcgacgtgacggcgaccacgatgacgacctccccgagcgacggcgacgactggagcgacggcggcgcacggctggagcggcggcgacgacggcggcgcgaggtctcacggggctagggcgctacaaacgacgagagacgaaggcaagggtggcgacgggtagcggcgggcttggaggtccttttataggggttggaaggcggcggcgaaggtccacggtggccggcgacgagaaggaaagattagggttcggggagagagatgaatccaattcgagatcgaatccacagatttccaaacgaaattagccgacgattccataagagaaaagatagaggggatcccggggatcatttcccctctattaatttcaccggaaacggaaaggggcggctggatttggaaggagacgacggcggcgcggcgctagggttcgggcggcggccggccggaggtagacgacaggcctgacaggcgggccccattgtcagcggcagcgagcgcgtgcgcgggcggctcggcttgacttgggccgacttgggccgaagaggagagagagagggaaggttttgggccgacgccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccctattttacattggaatttattaattaaaactagatcttctcttctaggcttttaaaataaattctaataattccaataataattccaatttagacaacaatttatatatttgggatttttagggtgtgacagaaattctggtttgtgaatttctgggcgtgacacacactgacagggtgggggtacacagtcgccgtcccatcggtcattcaaccggtcacagaccggtcagatgcgcagcacgccgtattaaatgcggcatggcgcggttgcatagaccgctttaaatgcagttaggtgggcgttaggcacgcccacctaaccctgtacattgggctaatacgtggagggggtcggagcagctcgaccccacgcgagggcggcctcctccctctagctgggatggggcagtcgccgcgccaccccgggctcgacccccctcggggggagccacgtgggtttgggggcggcccgaccccaagctgggagggggcagccgccgcaacaccctgggctcgacccccctcgaggagagccacgtgggtttgagggcggcctccaacctctagctgggagggggtagctgccgcgccaccccgggctcaaccccactcggggggagccacgtgagtttgggggcagcctcctccctctagacgtgatatccctgggcccatatcgccgacagtagcccccagtgttagccctgaccaaaaccttcccctagtggccagggttgacgccactctcctagtctaacaatgtgggcccggtctcttctccattctttgctagcattagggcccatgcgcctttttcgccccaacttgagggcgactcgccggcccgtaccttaggttgtgaacttattttctgtatatattcaacaaacattgttagattctctcgggcccatgacttcatgcggcgcacctcgcctgcccctgccttttgttaacctctgttcatgttctacttcatctattcaaacgatgttttcgcatgagtgtgaggactgaactttccatagccagcaatccccacccgcgatcaagccaagctgggtgccatagccagccggcggggccaaagccagctgctacgggagagccagcacagggggccccgggcgtcgacggcgtccagagctcgacgcagggctaggatagagctaggaatcgtagcccccacacttttagcaaagaatcatttgaatgggtgaagtgaatacatactttttgttaccaaggggggcaaacgacgtgcgacacgtgggtatcatgggaccatgaggaggagatgggtgagagataaatataagccataataactttgctgataagcatgaacaaagaagatacaaacttaaaggaagtattacaaatgttatgctcaataagagctcccggccaacgctgagctttcccagagaggtctactttggtccggatattgtaatacctcctttgttacctttgtttatccttgcttgcacatcgtgacctttcaaacctttggctcaaagaaggcttcccaccgtgagctctgtaccctttaggggcccacggccacttagcaaacgaggtcaggttcccacgagcctgcgcccccacgctacacattatgttcgctctttcctttcggtggccttgttctaatctcttttccttctacatggacgattactttcgcacgagtgtgagagccgaaaaactctagagccagcactccccgtccacagttgagctgggccgggcaccgtagccagccgacgggaccaaagccagccgctacggaagagccagcacaggggggtcccgggcttcgacggcacccgaggctcaacttaagtctaggataaggctagaaaacttagcccccacacttagcgaagaaccgttcatgtagatgggagagaggttgggctcttaccaccgagggaggaaacaaatgtgcaacacgcgagcgtcgcagagccatgagaatagaatggggggaaattaaatataaggtttcaagctgatgaattgaaaatttgaaaatgcttaaaacctgaaatgatgattaatgcttgaaagacggatgcctttatgcatggattgtggtggcgacagggtctcctgtttggcaaccagcctacaaaatctgagcgcagaacgccagcaactaagaaaggacctctccgaggggacttgtcaattacacagtcatgccggagcacggtgtaagcctaacttcccatcttagcgagcgtgcgacttgtggttggcgctaggtgaccctgtacaccatgcgcttttggcaggtttttaaacgcttgatacctgcctgcaagagtcctctcaggagtggaccgaggcgggcaacaggttcatgagccaatcccgtgcttggcccctgagggccatggggaagaagctcgccatgacctggtcatcaccccccgccgcctctatgatcgttgtgtagatctggagggactcggaggggttgacgcaaccgtcgtacttttcggtgaggccgggccgaaactttgggggccatcaaacattccgaagactcgccacaaaggcctggcagccagccttacccggtgaggatgtggggggcctagccccctgcctagggtggcgtgacactcttgaggaggttgttgtgagtgatatgccctagaggcaatcatagagatgattgtgtcacatactatgtttacatatttatccgacattgttccttgaaatagataactccttattggttaatgaatatgcgattctttcatgagactctttatgttgtttgttactatttctaaaggatccctgattaaatattatatgtggaacaaatatgtttatatgatcagcacatgtattaattgatgatcatgtctcatggatcatggtacagagataccaaattaataatgtggacacatgttgttggatagacccaacatgagacactgcaagagccatatgtgttgtgtcatcagtgatctcattgagtgttggtgttgaatccttagacctgagattatcatggttctcaacatgtgtagtagcttacttaaggactgctaaacgcttctccgtaattgggtagttataaaagtagttttcgggtatgctatgaaacatgtagtgggatatgaataatcaagatgggatttgcccctcctatggagagatatctctgggcccctcgatgttgtagattatggaagtgcatggccacgccaaaaggtgattgaggagtcaatcacaagttatataatctatcaacaggttcgagtaaatgattgagctattagaggatagcacatacttagccttgagcttaatcgatatcgtgaggcaaaaggttcatacaagtatacactagagcttcagccgatatgatctttatgtatgcccggtgggtcaatacgttctgctaggggccgctgttgacgcgtggaccgaaaaggagttttcgggttacagccgagtatatatgaacctacagggtcgcacgcttaatgggccagaataaggggattggatagaaatccaatatgagcttaattcggatagggatccgaataggagtcctacgtgccttggaggcccgagtgatggatcctatatattcgtgtggggtgtgaccggcggaggcattgcatcacgttagaaaccctagccgtcacttccctccccgagcaaaaccctagccgtgcgcgggtggtagcatatctgcgcgtggcgttccgtccctgtacgtgtggataccagtagaggcgccgctggtttgcggtgctgatcggcgtgggagtacggcgaggagaacgcacgaggaggagaaggtcgagccggtgcgatcgactacttcctctatatcgacgcgcgctacttcacgagagttccttcgacttctcagcgtcttcttccgctgcgcagcgcgtcgagtggtaacgatctatgatctaacacttgcatggttcctggtttacacgatagaaaattttgatttatgctatcgtagcctacgcatatcccaacagttgcgccttcccccatactggcggcgtggcactcaccacgccggcgctcgaaagaacctcaaaaatcacgaacgcgccccctacctggcgcgccagatgtcggagggttaactcctccaccagggaactgtgaggcccccttttttggttcggccgggggcagcgggtgaaatttgaggcttcgagagcaaaactaagtcatcttgaggggatcagcccccccctcaagacgatgagacaaaaggggtttatacaggttcgggcctctatgaagcgtaataccctactcctgtgtgtatggttcttctgtacttagaaagtccctgaatccccgatatgcaagctagggttagacaagctttggcttagggattctaagtccgatcccccctcctcgctaggcatggtcctccttttgtactctaaggggatactacatgtgctgcgaatgctatctagggagaaggaaaaatattctctatattaattacatgtcttgtgccttagcccagaagctatctgcacgtcggttgctgcgcggggcccctcaaatcatgcaaggcgcctttgtcattcgccatttaatggatgagaactttcgggttctcgttcacactagaaaacgggaacccgggtcagttcagagtggttgtactagctctgaccgaggtaagaggctgtgaagcccctcatcattatgatgggacgggatggagcacgccgctcgccgcctgacacacagatagggtggggggtacacagtcgccgtcccatccgtcattcaaccggtcacagaccggtcagatgcgtagcacgccgcattaaatgcggcatggcgcggttgcatagaccgctttaaatgcagttagg

SEQ ID NO: 64554 - DNA, 8144 bp, Oryza sativa
cctcctcgctctagctgggagggggtaaccaccgcgccaccccgggctcgaccccactcggggggagccacgtgggtttggggccggcccgaccccaagctgggagggggcagccgccgcaacaccccgggctcgtcccccctcggggggagccatgtgggtttgagggcggcctcctccctctagctgagagggggtagctgccgtgccaccctgggctcgacccccctcggggggagccacgtgggtttgagggcggcccgaccccaagctgagagggggcagccgccgcaacaccccgggctcgacccccctcggggcgagccacgtgggtttgagggcggcctcctccctctaactgggaggggtagcgacgtgataccctcgggcccatatcaccaacagatagtgagaaaaaagttccaacaaggctctgataccagattattagcaacctaacttgtatctcactcaaacactcaagaacacacgaatttctcaccaaatctgacaggattgacgatgacctcgcgcatgatcagcttcacaacctccggattgatggggtggtctctagccgccaagcacctaagcttcttctcctcctcggtttatatatccacaaattaatagtagtattctaagtcaaatattacagaaatatttagattctaagtctcataattaagaaacaactttgatgaattactaccattcatctacgaaacgaaatatcgactaatttttccttacaaaatgtcaacatattgtaggtactccctatagtattgaccctcctaatcccctccctctcaggctgtgtttagttccacgccagaattggaagtttgaagaaattggaacgatgtgatggaaaagttgaaagtttgtatgtgtaggaaagtttgatgtgacgaaaaagttagaagtatgaagaaaaagttgggaactaaataaggcctcacttatatgtgggtccaacctgattttaaatcttaaactatgctgtgttcaattgtcaatttctccaactttttcacgcgaacgtttatcaaactactgtaaataaataataatttttttataaaataattatatataaatgttgttttaaaaaaatatgttaatccattttaaggttttcttaagctaatagttaattaattagtatgtgctaatgagctactcgttttccatgtagtgggattgagttcgcaaagcatatgtttcactgtttagatccgaaacaaatctctcgtgcatatggaacgaagagacttattagcacatgatatattaatatgctttttagaacaacttttctatatttttttttgtcaaaacacatcgtttaattaggagtttaagaagcgtgtacgcgaaaaacgagtgaggagagttggaaagttgactatcgaacatagctagcctccggctccacacccaagattttgctgaaattttgaaaatcgtttacaaatatttgaattgaatgtacgtttcaccggaaacttaattcctagacgctagaaatcagtgttggctagctgtaatagatgaacttgctggtaattccatctcggccattacatgtagcacaaaatcatcacatcgattatggactaactagcccgccgtaattccattgcgcgtacaagatctagattaacagctgacaaaaaaaaagagcacatggtaatctacctactaactaataatgacaaattaagtggcgatcgacatgagctcgctagtcttgtgcggcactgtctcctgtgcggcgcctctgtcgtggcggctcctgatcctgctccttctccgtctccggtgtcggcctcttatgcacgacgacgacgggacttgctgctcggttggcatcggctaacaagaccgcagagaacgcttgtgattccgcaatctccgcctcggccgtcgcggcgtgcttctgcagcgcctgcacgatctcctcctcccccgcgaaggcggcggcgccacgcgtgagcttctccttcaacacggtcatcttctccaccacggcgtcctcgaacttgatcgcgctggccaacaacccggccttgcggctacggacggcatcaccgccggagtcctgcaggaccagtgatttggtggacacgcgcatggcggtgatcagcgccgcaagctccggaatgacggggtggtctctcgccgccatgcacctgagctccttctccagcaagcgccgcgcggcggaggcgatctccaccgcctccgcgcggcgcgcgtcggcccacgcgacgtgcttcctgagcaccgcctcctcgggcctccctgtcccggcgaacacggccaggcccctcctgagatccagcacataggacgccatgttatccgccgccgactgggcggagatcactgcaccttccgcccagtccacctgctccggcgagggagggtcggggtcctcaaggtactcggtggcttcagacagcgctgtggccgtgatctcctcacactctcggtcgtcggcctcttcctccgggccggcctccatgagctcggcgatgagctcctggaggtcatcgtcgacggcgggcggcatgtcgtccgccatgatcgatcgatggatgcacgcactacctaccgtccgtgttaccgccaaaaattgcaaagcccaaaaccttggagatatgggacggaatcgatggatggatgtccctcgataaatagacacgactgccgatccgagtcggagtacgtgtacccgacggaccgatttcctttccgatccaatcgcgtgatcgagatggaggccgaacgagggcccaacttcactgttgggctgctcgcagccgcggagcccagcccatctgcaactgcaagagttttcgcagtaacattgaacaattatgccatatactccatttgtcgataaattctctctcaaaaattgacagatatagcgaaagagcctgtaacctagtggttacaagagtctcagtagcacctaaggtcctaggttcgactatttatgggagcgaatttttcaggatttaacagcgttgtgctttcagtggtaggtggcgtacccgttgacagcgaggtgcctgtagtgacggcgcacgaacatgtgagaagattcgttcccacgactgccatttcacgaaaatactctggttcggttgatatatttgtgtacctatttatacatatatgttagttaatctaagtcgattatttaatttatttgtatcggtcagatcttttgtgtacctatttatcatatatgttagttaatctaagttgattatttaatttatttgtatcggtcagatgttttgtagggttttaccggtattggctaaattgctttgtcgatctagattagttaatgtatctaccacattgaaaatcagtcaagaagattgtctagatattatgttcctttaatactttgtgctgcatcagtcctagtcatgcttagaaccataatctctaacatgttttttgattgctaatagggtttcatcggggtttcaaccgatgagttatctggacgttgcatcggattataaggattacatacaagttggttttaacagattgcaacaaatgtttcattgattatctaatcgtttggacatcggaacaccagccgatgtatgctttaaccatcgaatcagcactcattctatcatatcattattagttgattggtttctattattgttttattatattaccatcagtcgattgtatttatatcattatttactcaagtgtcaaaatctacactaggcatatagccggttgctcaaaaccctatcgacatcggctagcgttgctatatcggcttgtcaaccgattggctctttaatttttactttatacatcttgtcggttacataatcaaactgagtggcacatccgcatctcatcaatattttggatctgcattggagctaagcagatctcccagaccgttgtgttcgtcgactttgttcgcaccaacacatatctcgcaccattgctcgagcgtagatttttcgtcaacaaccatatgtaaccatatgtgagaagattccttcgcatgaccagacgacctccatttaacaaaatcagcatgttacggaggaatttttaaaagttatatatatacattaaaattacaatatagttacaccacaattatactataattatatttgtcaaaattctgaaataaaatgtgtcgataaattatgcaggtgcaggtgggttaaagaggtggggccgaggacttgtttctccttcttctctccttgtctcgtcttcttccgagcggcgaggcgagggcggcgttggcgacgggcggtggtcgtctgggcttggaggagaggccaccgtggcggcagcgagcggtggccggaggagcagcgctcgggcggggacgaatcgacccggcgtggcgggcgtcgttcgggagcgtggaggcggcggggcttcggcaacgtcccgaggttgccggcagcgaggtggatcggggcgtacggtggggaggaagagggaagcggtggtggtcggtggaggccggcatgttgggcggcgcggctaggcgagggggagaggaggctagtggctagctcgctcagtgcgactctgaccgcggcacgcggcacgcgggcttttacagccgccatgaccgcgaggagggcgaggacggcgtgggacgggagcaggtggctgtagcggcgtgcgaccgcatgcactggcggcggcgggaggcaacggggcgaggagtaggggcatgggctcgatgcgacgcggcgaggccgtcttggtccgcgggtatggcgtggacttctggcgacgaggcgttgcggtgacggcggctacagtggcgcgccggctttgaggagaggcgcggtggctcgctgctcggaccgcagcggtgcggcattttgtcgagcaggtggcgtgcgagggcggctgtctcggggcaaggccgtgggctggctgagagatgtggcttaggttgaataatatgccttaggattgagaattggagggaattcattaggtgttaagtttggattttgattttgaatggtttctaattttagaggggagtgtgaggatgtatgaattgagatcctaactgaaatttatcttgggagaacctcttgttgattaaaaaacagacaatatttgtcttttgcaggcagtttcataagatggttttactccagaaaagaagttctctaagctgccatcaggaggattaagggagctcattggtgcatacttaacacttctccagaatttctttttgaagttgtgcataagtattgttagtgagatggttcacttttgtaggtcaagatggcataggcaggagcaacatcatggaagcagaaggtattttgaaagatctgattgatgataaggtgaacaatgttgatgccgagttgcatgtcttacaagaagagcatgaaaaagacctgctcgagcatgacagtaagttaagttttatctctattccttccccacccacacacatgttgcactattttacttatccttaagtaaaaaaacactgtgttacatagtattattatacgcaaataaggatgatcatcttgcatttcacaaacataagctgattatcaaccctcaaataataatcctctctgttcttttcttgaaaggaacggcccaaaagaagaggaggcccaggaaatgggaagcccaaagcccagatcagattggcaaacagcaataaagcggggcgaataccccagtttccctctctcccccgccgagccttcgtcgtcagctggtgttaccccagcttgaattctctgcaagacagcaagttcttccctactccctctccaccctgcgcaattccctcgcattctcatcctactccaagagcagaggaggaaggagatggagaggcaggacggcgacgctgagggatcgggacggggagagcataggagcagaggctgccgttccccggcagagaccaagactgaccgaagccccggcattcccaggtcaggaggaccagcgaatccattctcttctcgttcgtcttcgcgttcttgcatttcttttcgaccgtttcaatcgcagttccaccgccattcttccttgctgtctttcttggtcggtgttcttgaagttctcgtttggtttgctgcaagaagcatatctgatcgattgattgcagagttctggaggtggggttcgccaccgtgcgagaacaccacgggaccaagagcaccacgggaccccaaaagagcaacaacctccagaacaagaagataaaatcaagagaagatggcagagaaccggaggccgcagagttgagacggggcgagaggagaaggtcaggacctgcgaatctttctttcccttcttgttctttgtttcttgctgcgttcttgctttgttttcgatcgtctcaatccctgcagctttcttgcgttggttttcttgccaagttgtgtttggcttcacacgtgtctgatcgatgtgcagagaccacgaggtggtatttgccgctgctgcgcgagatccacctacactgcagcgccccgacttcgactgcgtgcgtcagaacaaacatcccaatggtaatcagtctctctcctgtcctgctctgtgtccggtttaattcttttcctttactctgggaacgaacatgcatgtataaaagcctatgtactagttgttgatccatgtccatgaatctggattgaaatgttaacagatattggcaatatctgtaaattcttgttggaaccatgcggaaacttaatctagttaagttcactgatgctttgacaccttggtttctgaaactggatccttgtttcttgcactcctgcctttatttcaaaagagaaaaaaagtaacttcagaatttccaacaagaaactgatcttttttttttcttcctgcaaaatgcaaatgcaagttcactgattcatagagagttgtttaagttactccaatctgattttctttcactacaagaactagtcctggtgttcagttttgacaaacttctatgatataaaaactccctgatatgagaagctgacatgtgtatgtgtggccatgcacccagccaatactgagaatgagatgacgggcggtgatctcgagaaagcaagtggaagcttactagaccagagcaagcaaccgctgaacataaagagggatcgtcgcaggctagaagaagtcaggttagtgacttctctgctcccttcttatgcgcaaatatgtattgttggttgctctgtttgatctgataataactgttagaattgagattatgttgttggtgaatctgacaaattgttgaaccctagtgataaaatgtggaaggatgaagcgaaggagattggaagcaggtcgccagcactaacaaaggggagcacgaaagagtctcagatgcttcagtctctcggtaaatatatttgaatttgggcttgctcttttgaactgtggagtggagttgattgggcctgtttttacttttggtgtgtgtggatgcactatcaggtgcacaaactgctaagagctccagtggttgtcagggaaaaaaatgctagtgtccaactcaatggcttcagggcagccacggcatcttttttcttacaccctatacacccagtgtagtttgatatctatatcaggtcatgtccagagtaacgagtggatatttcaattaatcaggatggaaattccaactaggttaattgcttgctcttggtttcacaacttgtaaattctcgtctcatgcatggaaaccgtacagaaacctctaatctagttaagcatgtcaattcatactgtaacaacatgcatgatttctgacaagaaacagaattcattgtttatgttttgctgttacttgacaaaacaacaagctgatcctccctaatttcttgtaaaatggtatcttgttgttttgtatcatgttaagtaataattatgtaactacaaaaggattattggaaagtgattattttgccaatttggaaagggaacgttcacactctcagtgtgcaattttgtagatgaaattgactcaacatcagtacctgaaaattgactttgaaactgtggtaacccttggaacacttcaattttacctccaaaatgtgtcc

SEQ ID NO: 64555 - DNA, 1855 bp, Oryza sativa
agttgtcagtctgctttggttggaaaacctgtatctccaattctcctcaccatcaccaaggaacttgttgtgttcctaggcgttttgttatctttcatgttatatctcaaaagtaacttatgtccctctgttattgtagcatattccaaaaataaatggcgatattccttctgccattgaagcctttgcagatcaccaaagactgcttgacaggtaaatagccctgtagtatatttttaactgtatttccaaatctacgaccgatagaatgtgaacctcatggcagcttttgtatgttcagtgttagtaatgtgagtcaccataggtgtttcacttaatgttgcttctaaaatttgactcatggcacgatgtgatttcttatttaggttggtgctgtatgatctggctgaagtcaaggttaaaggagacaggaattgccaggtatacttaaaatatctagccatttcccttttccttaattttactacatgttgtacttatctcttttagcatgtgtcttttactcagttccgagcattgtcagatcaaatgtaccacaccaccgaacaccacaggtttgttcgtcagcaagtagtgaaacaggttagtgttggtgcagtcatcatgttttcttgttagaactctacttgtccatgctcatgtttcccttttgaactgttccacagcttgagtcttatcctgaaatttatgcgggttatgtccctatggattatagggaatatctgaagaagatgacagagtaagtaattgctctttttgtaacaagaaaatctttgttatagtgtaacattatgcatttaaaatttgttgccacaaaatcgaccagggatggagagtggggtgaccatgttacgcttcaggctgctgccgacttggtaaacaagatgtttcctcacttcctgagttgttaaataaaaattgctgtcttgtacattggccatattatgaagtatacagatcaatagttctttgtattggacagtatggttgtagattcattaattgacaaataatcaaaagaaataatgctattttctgtggtttttattttggtaaccagcatgtctcaacagctatattgcaatcttgtgcatcttaggattatgtgaatgatctagggatgttgtatgtcgatccttgttataaatgtgaaactcaagtatccgcattggtttttgcagtatggtgtaaagataaccctgctgacatcatgcagagataccttttacattgaagttcttcctgctgaccagaaaccaaaaggaggtagcctttttttttggcaattgaatttttactgcaattaatatactaactgcactgttcttagttgatttgcctagtaggtcatacttacttgagtagatgtgtatctgatgtatttctgtttatttttgttttctcccaaaacccagagatatgcattagtttttgggctgaggtgcactacgattcggtatatgcagaaaaaggtacagtttgtcgttttgatacagtgttcttctaggagtactagtatctctttggcaggttgatgctgtagctcatgtgtgcaagttgtggtgcagccagttgatccagttccgttacaacctagtcgtcggcgaggaactgcgacgcccggcgagcaggaagaacttttattctagagaattgagagaaaagcagaaggggagagagagagagagagagagagagagagattgttttcttacattttcaacttgtatatatacgctacagcagctggagatttatatagtcagcactcgtttgccctctgggccccacacagtagactcacacaactaatacgctttctttacttgaagat

SEQ ID NO: 64556 - DNA, 2631 bp, Oryza sativa
  unsure (1)..(2631): unsure at all n locations
atcactctctgtgctccctcatctgggtctttgtcaaaaattccttcgttgggtgtgtgttcatatcggttcaatgttctaatttgtccctctgcatacatcattccagttcggatgcattgtatctatcgctccctgcacagcctcacaaccttcatacatctacagttctttttgttcttgtgtttagcctttaaaggtttaaagcatctcgatttcgaggcaagatttgtctcctcgaacggaatgtccactatcccccttgttaaaaagatggaattttcttcattacaggatgtcgggtcgagggaagaagaagaatggagtgtccttcaatattccttttacactgccgattttcacccgattgacttaggtcttgttcgtttctccaactagacggtgatgaaattttgaatactcatgacacgctttttaaactactaaacggtatgtttcgtgcgaaaactttctatatgaaagttgttttaaaatgtcagattagtatatttttcaagtttataataattaaaactcaattaattacacgttattaccatttcgttttatgtgaaacacttaatctttatcttcatcttcagtagattcaaacaacacctcattattttgtacatgaagagtgaacaaagaaagatacttcgtgtaagaatggtactagaaacaaggtttctgaactttgtgtggatgccagcattaatgcttatgctttaggttcaaatttaatgtttcccatgatttattcattgattagattgctgccaattgtttgcgccccatttttgacgtgattttctggggaaatcctaacagtatgatactatgctaacactttgatttggtatgatgttctgccatgttcatagttcaggaaaaacaaatttgttcagtcgaaaacagtattatgcatatgatggcccacagataaataagaggcacagagtggaatgtcgtgtggcggtgtgggccacgcaagtccatctacgaatcggatccacggaagtacacggactccgaatcggatcctctccatctctctatttattggggcccgccttcaagggagatttgcttcccatcctgtccaacagatcactaattttgcataccgccatagttttgccgtgcatagatcgatcgatcatggcggacgacatgccgcccgccgtcgacgatgacctccaggagctcatcgacgagctgatggaggacgatgccgaggaccgagagcacgaggaaatctcggnacagcgctgtctgaagccaccgagtaccttgtggaccccgaccctccctcgccggagcaggtgggatgggcggaaggtgcagtgatctccgcccagtcggcggcggataacatggcgtcctatgtgctcgatctcaggagggctctggccgtgttcgccgggacagggaggcccgaggaggcggtgctcaggaagcacgtcgcgtgggccgacgcgcgccgcgcggaggcggtggagatcgcctccgccgcgcggcgcttgctggagaaggagctcaggtgcatggcggcgagagaccaccccgtcattccggagcttgcggcgctgatcaccgccatgcgcgtgtccaccaaatcactggtcctgcaggactccggcggtgatgccgtccgtagccgcaaggccgggttgttggccagcgcgatcaagttcgaggacgccgtggtggagaagatgaccgtgttgaaggagaagctcacgcgtggcgccgccgccttcgcgggggagggggagatcgtgcaggcgctgcagaagcacgccgcgacggccgaggcggagattgcggaatcacaagcgttctctgcggtcttgttagccgatgccaaccgagcagcaagtcccgtcgtcgtcgtgcataagaggccgacgccggagacggagaaggagcaggatcaggagccgccacgacagaggcgccgcacaggagacagtgccgcacaagactagcgagctcatgtcgatcgccacttaatttgtcattattagttagtaggtagattaccatgtgcttttttttttgtcagctgttaatctagatcttgtacgcgcaatggaattacggcgggctagtaaactgatcagggctactaaagaaatttgctgaatcttgccgaacgtgtacagtaaactgacgaacaaatgcagagaacgaaaaactatcgagagtttgtgctccgaactatcgacagccttttctgatttctcttcttctccttttattagattagatctattgggagtttgttacatgcataacaatcaacgactttacctgatccaatctcagctcggtcggctaaccgaaaacaaacgatgcggctactctagcccgatggtgatctgaacccggtcagccacttattattacatgcatgactaagtaaaaacagatagaaaaaagaacaagctagactagaatgtgcaagagtatacgacaaatccatcagagataacccctcacatactccctcgcctcgcttatgcgattctcccccaatggattagcagggctgtctgctggtcttaagttttctccaaccaaaaagagacacaatgtgccagtgccactactaagcattcagcgccc

SEQ ID NO: 64557 - DNA, 5918 bp, Oryza sativa
tagagccatggaggatcatcggggacgtccaagtcaaggtggaggcccaaaccaagtcgacgtcgggtgcaattcggagtccaggaccagtctgcactaaaacgggcgcccaggtcgcatacgtgctcggattggggcgttctttatatggatggaaagctaagaagataaaatttccaatggttttggtcccacgtccaaattcttttcgagtcaatgggaattgaccgaacaagttgacatccagaatctgtcccggtgctgcgtcaccgtatttgggcctttggcccgtgtatcgtgttggaacccattagggttgcgtcgagaggggtttgcacgaccctaaactctatatatcagtacccaccgccatctttaggtttttgggttttgcttagattaatctgtcgagaatagtttcgccgctagatcggtttataagaccccaactcgtgagcttaatcattcatctgcaattttggttgttttctatcttgttcttgtttgtgttcttcgattggcaaatagggattagccttcttggcgaggtcatccgcgtttcggcacgggtgataaccataggagacgtggtgctgcgattgcggggctcaagagcgtacgcgttcaagaagccggatcgatttgtgtcgcgactccgctcaaatcgttgtttatcggaacctttcggaagattgggaaccctagtgcacatcaagtggtatcagagctctaggttcaccgtcaggttcgctcagtttctttgccctagattagtttttgtttttcgcaattatcctagagtctacagaaaagccaaaaaaaattttagttgttagttaccttaacctagaccgtgtttagcctttgcatgattctttttcaaagtccgtagtgttgagtttgagtcctagtttaagttcctgttgctggtctagtgcgtgttttagtctagtcgtgtgtttgtcctttgtaaccctagccgctacctttcaccgtgtgttagggttcatcctttgagagccgtttctgccatcataaacacccatccagatcaccacgcatcaccagaacaccctacaactccgctgccaccatatcccaattccaccgcataatagactaggttatatcccctctggaaaacctagccggaagccgaaacttcaaacagccataacttttgcatacggactcggaatcaggcaaaatttaacttttcggataagagaaaaaaattttacatctgtttctcccccctttagcgggtttggcgaatccaaaattccaaaatttggcttgcaaaattgtctgttcgagctcacaagttcctgcaccttgtttatagtggtttcagaaaaatccataggccacatatctactccgattgagctgtaacttggaggtgtgcctattttcgtgttctgaaaaaagaaaaaaaatatcaaaaaaaataaaagaaaaaaaaagaaaagttgatttccactagtgctttgagctcacgacgcgctccattgagcttatctgctagttcggttttgtagtttttgctgaaactcgccgaagcttgcctgcaagtccttctttgctgcttactggtgtcatttttcttgagccataattgttaccactactgtctaggacacgagtagaccagcaactaagggcaagtgacttgggatttttattcagcattactatatgtcattggattgtgtaccactcatatacatatatttggccttcctagctccacatattacttctggacagtacgtacaggttcttgatccctacaatcgctgactacgccttctaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacaaaggtgagaagagtccccaggattttgctgattgtgtcagccaagagcaactacgaacactccaacaaaatactcaaaaggacatcacggaggccgttgcaaagtctgtccaagataccttcactaaaatcggcttcctgaaccacatggagaggttggacaagcggatatccacgctaactgatcgggtcgccgcgttggagacaccttccaatgaggaagtggtgagtggtgacaacgatgctcatcctgaagacacggtgtatgattccaatggctatattgacgcaccggctacaaggcaagcacggctatgacgtcgcctacgcacaaaccacacaggtatgggtggcactcgccaccaacaaggtaataataataatcgtgtgcccgatgatccttatgctaaggttaagtttaaaataccatctttttcgggatattatgatgctgagaaataccttgattgggagatgacagtagaacaaaagtttaatgcccaccttgtacccgagcaatatagagttagacaagccagtagtgagttcaaggattttgctattatgtggtgggctaggttatctgatgagggggtactacctactacttgggaagaacttaaggtagctatgcacgataggtttgttcctccatcttatcatagagatttacgcaagaaactgatgcgtttggaacaaggggataaatctgtacaggattactatgtgagctacaaaagggtgtgagacgctgtggcatagtggagggggtcgaggattctatttgtcgtttttattctggtttgagggagaaaattcagaacattgttgattataaggaatttaactctgtcaaccagttgtttcggtttgctatgcttgcagagaaggaattacaggggcgtgagcatcaaggcaagagcaaggcgagcacatacactccgcacacgatgccatctgcgggactgcccaaggccgtctcttttcgggcgtcctcccagccagtgggcaagcaaccagctgcatccggagcttctgcggcaccaaaaccatctccaccaccacgaccagcagagtcaggtaaaggttcctcgtaggtacccgccaagagtgcctcatctgtcgcctcgacgggacgcattcagtgctaccattgccaagggtttgggcatgtgtagaaagattgccctagtcaacgggcctatgttgctacagaagatggctacatcaccacctccgacgtggaagaggaagagggggaagaagaagaagttgaggatgaggatggcgaagtttttggtcgtgatgacacaacggactacaggaccatcattgtgcagcgggtgctcagcgcgcaggtacagcagcatgacaggttgcaatgccataatttgtttgagattttcttcgtcatcaacaaccgtcgtgcacgtgtgatcattgatggaggaagctgcaacaacttggtgagttctgatttggtcaagaagcttggcttgactacacgtacgcatccacacccttaccatattcagtggttaaacgattccggaagagcaaaggtaacacaggtttgtagggtttcgttttccattggctcatatgcagattctgttgattgcgatgtggtttctatgcaagcttgttcacttttactgggccgtctttgggaacatgataatgatgctacacaccatggtaggagtaataaatacacttttgtgcataatgggaagaaaattactttgctacctttgacccctgctgaaattgtagaagctgataaagagcgagctgctagtttgaaacttgatgaatctgaaaatcaacaagtggctaaatctgtttttccacctaaaaaggataagctttcacctagttctaaggctgagggaattaagttgaagggtggtgttatgcttgcaacgaaatgtgacattgctgaaatttcagatgatgatatgtgctatttcttgatatgcaaacaagccttggtttctttagatgatattgctagttcgatacctttcggaagatcgggaaccctagtacacatcatatagttatgaatatcttttaatgtgtaaaaatatatacacatatacaaagtttatatacgatgtatacaaagcttatataggacatatatgaactttgtatatgatgtatatgaactttgtatctcatatacatacgtatttaaaaaataaaaaaaaagaaattgcatcacatatacaaagtttgcatacgcatatacaaactttgcatatgtacgaatacaaactttgtattcatatatctaaaaaaacccaaaaaaacagaagagaaaccaaaaaaaaaggaaaaccaatcttaacagaaacaaaaaaaaaggaaaaaaaacagccaaccgaacagaaacagaaaacacggaaaagcaaaataaaaaaaaagaagggaaaagtctgtctcccgcgcggcgcgtccgccgccccctctccgcgccatagtataaaaactcggaccggagcttgacccggcggacctttcggttcaccggtccgccggtctgaccgatgaaccggcggttcaaccgcgattttttacgtataggtatagtgcatgtttgctagtagtcacaagtgatatacaacctcaacccccagacctgaggtcgattcccaagtatgcacccatttttgccaaaaagttcgaggtaccaatatgatatggaccatactgggcctctcattggcccattacaaaccttcactggtccaaccgtaggcggtttaatctccggttcaacacaaaaccgcccggttcagccggttcacagcggttcgaatgcatgtcggttccggttttttggttcaaccgccggaccggtccggttttttccactatgctccgcgcgcgacacgtgtccagtcgtgcggggaggaacgtgcgctgatcacccaatagccttctcgcagcaatggatcggaggctcggagcggcggaggcaacggcgtcggttgggttgggtgttcgcagatcccgactagcagtaaaattcagcgttccatggtgtatagcgcgtttcacaggggttccccttgggaacttccactgccgctcgatcaggcctttacggcccagatctcgcactcacacatggtaatccgcttccgcaggttcggagttcacggttcacgatgatcattgggaaatgggaagtttatgagcgctcacaatcctgcttagtttatactactatgactctcgcaggcttctatttgggctatcttctgatcttgattttctcctaacttgaaagagaaacaatgtgtagtaaactaaccagtgattgctagtatatggatcatgcggcttatggaaatccgagtgttttttactccatttctctgtttcctccgaaagatattcagttagtcctacacacgcggatcggattgtgtaaagaaaagaaaaaaaaaagaaagaaataaagaactagagctaatccgagtcagatacgctgtgcaagtatacaacatgtatatgcaactgaatacttaaatgatggtgatgtggaggggagaagagaagagagagaagcagtcatcacacctcatacaagactacaagaggcaacatccacacaaactctaagaaataaaaaaaaagaaaagaagaggggttgattggtggcaagtgtattagaccctgtttagatgggactaaaacttttaagtccctatcacatcggatgtttggacactaattataaatattaaatgtagactattaataaaacccatccataatcttggactaattcgcgagacgaatccattgagcctaattaatccataattagcctatgtgatgctacagtaaacattctctaattatgaattaattaggcttaaaaattttgtctcgtaaattagccaatgtgatactacagtatattaaatg

SEQ ID NO: 64558 - DNA, 3338 bp, Oryza sativa
  unsure (1)..(3338): unsure at all n locations
cagtggagtacagtaaatttcttcctccctcgcccgcccacactattcggtcaatcgctcgactcgattgccgatttccatccattgcatgcattggccgcgcgcgtatcgtcttatccactcgatcgtcgcgcgcggcgcgggagacccggcattttgcaggccggccggcagttcatttacaactatggaagcttttatttgtggccatcgttctgtcggttcatttacaactcacttcttctccacctccaaacgagaacaactcgttagcagcagatcaacacaagtgcatacaactgctgctgcactgtacgcaccacagttgtagaaaagaaagaatgaccttgcctgggagaaaacggacgagacacttgacaatatgtactcctatgtgccagtagttggctgctacctccgtttcatattaagtttatttttatcacctcccatttagcttaaataagttcttttaagtaatcattgcgtcagattttataaaaatagagaataattatattgggagtagataaagtgagtagtaattgcattagagcaagtttaacattatagcccactatcagctccaaatcatttatagccaatgtaatagctaatttatacaatagttgtttactatattattaatatatggtcccacatgtcatacacacattacgtcttggagttcgtgctgcagctggctacagatctatagcccgctgctcttctccctcttcctttatctctttaaaatatgtttatagctggcttatagcctgctattgtacctactcttaggattggataaagtagagatattctagtcttttagtgtttgtattggtatgtgtaggagtattttggaatggaggtagtagctaattgttgaggttttattacatctgcagtggtgaatgcagcgcagtagtagacgagctctactcctatctaaaaaaaattgattgtatagccaactttttttataatgtcgaagataccattatagaacatacaagattgataaagtatatccagttaagatccaaaagattatgaaaaaatgtgtttaggtcttctttatttagacttataagccgaaaagtttaagcttaaacaaacaagcggttttttgtttggcttttttaagccataaaccactcttacactattaagctattaagccaaaagctaggttagagaaactattttggcttatttaagatagatatatgactttacctttaaatttagggctttaaatccactagcttataaatcatataagtcaaaaatctgacttaaaaggcaaagcctaatcaaagaggcccttagcctcctaactttgcgtgccagttttaagatttgttttttatgcttttagggtgtatttgagagggaaggttggaacttctctcacgcgcacgcaaaataggtgactcgttagtgcatgctataaaaaaatttaaaaatagattgatatgctttttaaaatcaacttttttatagattttttttttcaaaaaacacattgtttaacagttcagaagaagctcgcacgcacgaaaaatgagggagtggaagtatttcctgaggtatttttgtgtagttcatgagagaggaatcacttaaaaaagataaaggggaaatattcaatgaaaacccatgaaaatcatacctaaaagttctctaaattcatgaaaagttactggatagaagtataggcatgaaatacatttataccaaatctcaaatccaaactcaactttatctgagagaaacaaaaaggacaaatttgaggtaatagtatcatgttactattcacatgaagctttcattttttacttcaaaataaagttgagtttgaacttgaatatattttaagtccacatctatctctggtaatttgttttcataaatttaaaaactttttggcccgattttcacgagttttcactgaatatctccctaaagataatagcacaaaaatatttggtgtatcatatgaaagattacttacataaataaaaacaataacacaatttatgtaccatataatatgtaagttttattttcaaaagttagttaataatgcagaaatatagaaacttacacaatctactatgatgtgctaggaggatagacaaaatttttcataattctcttaatcttctgacaagataaatcaattgtcagccttatatttccttaggcattttgggaattctttacaaagtatatggcccaatggcatattgtatagacaattgataaaaatagtggtatatttgttaacaacgaaaatttgcatcagattcggagaaggaagaaaatcgaagcggatttggtgttgaatcgagttggattcagaatcagactacggatcggctggataccgcatcggctggaaacagaggttgaagactgaacaagttgagaagattgatggccgatacagctgatatggcatgacttaggctcagcatgggcttagattgggataaccgtcattgccaattagagatggagctcaattaaggcaattatatctattaattaggatattgagtcggtttttattagatttggtaagagaccgccgtatatggtcttatttttatcttaactttagaaaggtttgagtcgtgtccacaacggactaatatgtacttggggtataaatatgaaccccatagcattgtaatacgggagccaatccaatacaacttcggtgcatcgccacccttttacttttctcgtttccggcgagttcttcacaagaggtaacccgtctcaatggccagcgctatcggggctaacatgtcgctttagacatgttaggctcgatattgcgagtcattgctatcatatgtctttgctaatctattcttagcttttcaatttagttttatcggttgctgctcgctttagggtttatgctggtttcggttaaattgtcttgctagattagattagctaaggcatctatcatcttgaagtgtctaattgcttgattgtctagattgcatgtttcttttcatactttgagatgcatcatccctagtcgtgcttagaaccatgcaaactagcttgcaatcgaacataataaggataatatcagggtttcaaccgatcttacctaatatgcatgtttcaatacatgtttcatgtatattcgacacttatatagatagatcgttttatgtaagcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64559 - DNA, 742 bp, Oryza sativa
agccagggatcagtttaaaccaggctgctggtgaggaacaagaggtagcagtggagaaaaccactaagaagttggaagatattcccatagtcagagagtatccagaggtttttccggacaatctgacaacaatgccaccaaaaagggatatcgagttccggattgacttggcacctggaactgcaccgatccacaagaggccttacagaatgggagccaatgagctggcggaagtcaagaagcaagttgatgaatagctacagaagggatacatccgcccgagcacgtcgccttggggtgctccggtcatctttgtggaaaagaaagacaaaaccaagaggatgtgtgttgactaccgcgcactcaatgtggttactgttaagaacaagtaccctttgccaaggattgatgatctgttcgatcagctgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagaacataagcagcatctccggctagtacttgaaaagttaaaagagcaccagctatatgccaa

SEQ ID NO: 64560 - DNA, 2605 bp, Oryza sativa
  unsure (1)..(2605): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctgtctgaaggcccgatcaagtcaaatatcgatcggcttgaagctcgtaagattgatcttggcacaacttcaagaatgcaacgctgagttggatatggagcacaaaaagctagccgatctcccgcaagctattgaagaacagaaggcaaagctaaaatcggccatcaagaatgtcgctgatatgaccaagtccttgaaagttatctctggaactgacgctcaagatgcccaagccatagaagatgtagaacagattaggcagaaggctatatcggctatccagcaatacttgtctcaataactttgtgtaatagaacttaaaaatttttttgtaatcggctaagacattctagtactttattatcttgacaatcttttcaccgattagcacaaaaaatttgcctccaaaaatttgcattgcatttggtatatatgtgcccccctaattttataatatcaaaagcattgataaaattataaaacaactaagggcgatataaccatatcggccattgtacatcggcaaatcacaaccgattacattatgaaaaacaactaagggtaatataaccatatcggccatctcaaggcgatgtaaacacatcggctgtcatgcatcggcaatacgagccgatcatgcgttaacccaaacacttgggtaatatttcttcaaatatttgccattgagcgctcgcccatagacttcgccatcaagcccttgcaacatatatgctcccttagacacaaccttataaatttggaacggtccttcccaattcggcgaccacttgccgaatttactatcacgagtaccaatcggcaaaatcaatttccatacaagttctccttctgaaaaatctttaggcaccactttcttattataatgccgagcaatacgttccttatacttagtaacctttgcaagggctcgcaatcgtgattgaaccagatcctccctctcattggccataaggttgtaatactcatcagctgttaaatcgttttgtaattccgttcgtcgagagccgattctaacctcccacggcaaaacagcctcatgcccataaacaagtttgtaaggagggacttgaatcgatccatgacaagccatcctataagaccacaacgcttcggccaactgagtatgccattgccaaggataatcaaaaattttccgcttaatcaatttgatcaaacttttattagacgcctcggcttgcccattaacttgtgcataataaggtgaagaattcaacaatttgatacccatgctatcggtaaactgaacaaactcatcggacacgaagattgaaccctgatcggtagtaatagtttgaggaagaccaaatcggtagattatatgctcttgaacgaattgaatggcatccctagaatcaactttcttcaaaggaatttcctctacccacttggtgaaataatcagttgccaccaatataaatttatgccctttactcgatggtgggtttatcatactgattatatcaattccccaacctctgaacggccatggcttaataataggattcatagctgacgccggcgctcgctgaattgctccaaacttctgacaatcctgacaccccttataatatctgaaacaatcctctagcattgtcggccaaaagtaccctgcatgccgaagcaaccacttcatcttatgagccgattgatgagtaccacagactccttcatgaacttcaccgattgcaaccttagcctgatcggcactcaagcacttaagtaataccacatcaatcgtccgataataaagctcatcatccagcagtgtatactttaatgccttatatcttaatttcctaggagccgattgagatggattattcaaatattgatgcacatcgtgcctccaatcatcggctgtcattgctgcaatttcaactttaacatctttgatcatcggcttataccccgatgccccttgggctaaatcattagctttaatattttgttcttaagagacatgctttaatgtaaccagccgaaactctttcattagttcctggcacttctcattataaaccatcaatgtatcgttcttgcattcatactcttctgccaattgactgattactagcaaagaatcccccatgatttcaatggtatcggcttcaacttccttgagtaattgcacccccttgagcactgcctcatactcagcttgattattagtcgcatatggtgtaatagtataagcaaactcgaaacatgccccactaggggaaattataactaggccgataccacaaccatgagtacataccgattcatcgaagaataaagtccatggcactatttcaaccaagccgattgaatcatcacgatgttctacaataaaatcggctatagcttgtcccttaatcgccttcggcgattcataccgaagatcaaactcggttaaggagaatatccactttcaaattcttctttttaatattggagccgatagcatgtacttgactacgtcgg

SEQ ID NO: 64561 - DNA, 9174 bp, Oryza sativa
acgacccactcaaataagccgattgcaccagggcatctaaaagctgtcttatggatatcttcttcagccataaagatctgattatatcctgcgttcccatccatgaaactcaaaattttattccctgatgcagcatcaaccagctgatcggctactggcattgggtattcgtcctttggtgtagctttattcagatctcgaaaatcaatgcacaccctgaccttgccattctttttaataactggaactatactagaaacccattcagcatatcggcaaggacggataaaaccagcatcatacaatcgtttaatttcagctttgacaggttcaagcatgtcggctttacatctcctcagaggttgctggcgtggtctaacccctggtttgataggtagccgatgttcaacaatcgattggctgagtccaagcatctcataatactctcaagcaaagcaatctctaaactcttttaagagctctatcagcttggttctaaactctggagataagttcttgctaataaaggtcggccttggccgatcgcttggacctatgtatatttcttccaaaacatcggccgacatgaaaccttgaccttgcttgtcatcgagatcatctactgtatccttggtgtagacatttgaaccctccacgacgcccttaaaataatagcttgggttctccatcttcaattggctgtatatcagaaccggacacttttagaaaatctccatcccagacttttccagataaagaatcaaggccatccatctcccaaagggctaaatcggcactggcaacattaactgacctgtcgactgacacgatctctatcttgtcgccttgccattgaatcaaacattgatgcatagttgaaggaatgcaacaattggcgtgaatccaatctcttccaagcaacaagctgtaagaacccttcccatcgatgacaaaaaacgtagtaggaatagtcttactgccgactgtcagctccacatttagaacacctttggtttccgatggattaccaccaaagtctttgagcaccatatttgtcttgatgagatcctcggcatttctacccaacttcctgaacgtggcataaggcatcaaatttaccgcggccctaccatcgaccatcatcttagacatcggcttcccattgacgtagccgtttatatacaatggtttaagatgccgattctctgtcccctcgggtttctcgaacactgcctgttctggtgacagaaccaacttagccaattcctcttccacctcgtcggcatcggcttgatcgatcccgaattcggctagcaaggtaaagaccatgttaattggtgccactacgacactcttcccttttgccaacctctttgcctcatcggctgcaacatcatcggctacaggaacctgattcttaacacgccactcctgtcttggctttgctttcctcagccgatggttaatttcttgttcaacctcctggaggcgctccctgttcttcaatctttgaacccttctcttctgattcttcatgaaaataccagaaggacaccattgattcttcctgattacctcgtcctcttggccacgatcttgattcaccggacccaatctttgtttaacagaaactcttgcctgcctcagccgattacccctattatatgactggcttgagctctcgacgatatcactgcacccagggcagttttcgatagatggcaacctcatcccttcattccagtagaatctaaagaactcacatccccaatgaggatcaaaaccatcatcgtattcttcataatgcttctcctgctgcttgtcatacttcctctgatatttgttgataatcttagccgaattcacctgaaaaccctttgcacggaccctatcggttgtttggccagctgtatgcaccatattaacatgaaaaggattaccatcgaccttcatcggctttttggaatcatcgaacataatcttgcccccctcaatggccacctgaatctgctgtctaaaaaccttgcaatcgttagtagaatgagatccagaattatgccatttgcaatatctcttccaggactttttacccattggcatggtatgacctttttactcctcacccattcggctgcagctatttcagaatcgtcctcctcatcatccgacccatacatgtatggacaaacatgattaaccttcttagagcttttcctgacttccgctgacctatgctcatgcaaggttaccttctgtatcagatgtgacaagctatcaaagttttcagacgagaatttctccctgattggagcaatcataccctgaaaggccaatcggctaactgggcatcagttaaactcaagctgaagcatttgttcctcatctctctgaacctctgaatatactcgtgcacgggttcatcatgccgctgcttaatcgctatcaagtaagataatttcatctcatgaaccccactgtagaaatagctgtggaattgcttctccaaatcggcccaactattgatcgacccatatggcaaagaggaaaaccaagtaaaagccgatccagataaagataacttgaataacctaaccttcagagcgtctacagccgatgcttcaccatactgagccaagaatcggctaatatgctcataagttgacacaccatcttgtcccgaaaacttggagaagtccggaactttgaaccgattgggaagaggaactctctcaaaccactcagggtaaggctgccgatacaagcttccagtctcttttggtttaagcccaaactgttccctcattacgtcagcaattacatcggcccaccgtcgctgctgagctgccccttgtgactgttgctgcatgggctcgaactgaccgtagtgagatgtgaactgaggttgagccaatccccctggctgatattgggcttgcggggaaggaggctgatattgataactcaagttacccccttggtaattatgaaggtttggctggatattgcgcaccaagtgctcaggaacaacctaaggcattactgtgccgtccggctgtacgtggtgaaccaaatgttctgggatgacttggtttacaaattgttgtataggctgacctctaggcgctgcgaacccggccgatgcgcttacagacccctgttgctgaatcggctgaatgatttgctgccttaacgtagtctgttggatcggttgcagaggctgctgccttggtgatgtttgctgaactggttacacgacctgttgctggattggttgcataacctgctgaattgggggtgtctgctgaatcggctgctgcggtactggatcaaccgcatgttgaggcggcaaaaacatggcagcaacctgatcttgggttggccgattcgcaacctgcccactatgctgtggatgctccctcgttaacaaccgagggttcatcggctggcctggcgccatagctgatgtagcaggtaggggagttgatgttggcgccgtcggctgagttgtgggtgcaacggagggaactgcatgaatagatggctgaacatcggtgagcccacatcgataatttgggaagacacctccttgcaaataaactgggcctgcagcctgatgctcagctattgaaccatcggctattgtcttcatcatgtttgataaggtaatgactaatacgccggactgattgatcaaagcatgatgcacggcgtaatcaacccgatcttggaagttattgaaaaaatcctgtgccacatcattattctgattaagacttcctccctgcggcccctgagcaccatcatcttgaactccatgcaccccgtcaccttgtactccatggactccttgagaattgtcaccttgatttcctagagagccgtcagtagcacctttgatacactacaccataacctagtattcatggcacttaactgccggcagtaaaataaagttagtgacgaactatttgccgagaatatatcaagtgccggaaataatcttgaacgtcatcttatctgccgggaattaaaaaaataggacagcaaattaagtgccggcaatgaacaaatataaataggtcaattgatctgccatagataatttaagagaacacattatctgccgggaattctgttaccgggaaaccaattttacagtgaactgtttgaggaaattttggcgggctaaaaatattggcaggccgagcaaagctccaaggcgtggaaattttcgtgggcccaacatcccgtcgcacatgattcctcatcgcatcgcactcccactctcgtcgcaccgcacccgattcctcatccacgatgtctccacacgcaccgccacacgctgcacgccgccgtcgactccaccggccggccaccactgttgttgcctcctccccacctccgacttgacccacacgccactgtcgactccgcccgccggcttccgctgtcggcatatcgctgcccaacgcctccctattgccgccgcagccgcactctctccctgacgagctccattcctctatgcggccactgattcctcctcctatgcccgacgcctccgcaccaaaccctcgactccacacatttagacaggggcgtagccaagaggtagtcccggtgggctcggaactacccagaattcggcccagagacctcacctcccaaaaaaattaggcccaaaagcctgtttagcccaaaagcctgtttagcccaaacagcccagaaatattagggttggaaggattccagtccaccaccaccaggcgcgcctccaccctccacttctccacgccgccactgtccagggccgcgcgtcgagcctccccgtcgtccgcgccggcgctgcgccatcccagccgtccactctgtccccgctttcctcgccggcgccgctccgtcccagcggtccgcgccgtcgtccgcgctggagccatcgacgcccatgggcggtgggtccgtcttccgcgtcggcgccgctccaagccgccaagcgggggccggcgacgaagcgacgctgcgacggcaactcctcctgtcctccatactccagtcctcctcgcctcctcgggtcaccgcttcgccggactctggccgccggttgcgggttgccggcttggtggcttggcgcggcttgccgcagcgccgccgctcgcctcctgcttaattggctgctccacgtctccactgatccggcgctccaccatttagctcaggtaacgaacagatcaacaaaacactagaacagctgcctaaatcaatttgtaattagagatcagtgaatatgtgaataagaataactgaatatgcaatttataaattcttactaatgtgtgctattatttgtaggattggtaaaacatgaagaggaacggagatcaaggaatcggctcggatatccacttgttcaggtaaaaaatctcccggttataccagatccatgatttgtttcttctgaaatgagtgaatgtatgcatgtatgtatggattgtttcatgtgttaaattataagtgaatgaatggacaaaataaacaaggagaaaatagagaaacgagaaattatctacctgcttggctgtgactgttagttcatatgccttgtcagtctgtcactcttcttcctagtagtaccatgatacacatgatacacttattattatcgtcctgctcacaaaaattgcagagttcatcatcaaggatagacaattagaggccttggatagcattgcaatgtcaatgttgcatatgcagcagcactgtgcaaaccaactttttttttatgtggaggaatcttgccactgagcctgtttggtcagttatattgttgacatgtgtgagaaacagctatattgttgagcctgtttgatcaaatatttattttaagtgacattataatctatttccaagtttgaactatttggctttatggtgcagtttagtcgtccactaccgattttgctgcaatcaacctagatatcatccaaggtgtacgttgctttgctgagcatctaccgaacagaggtcccgaacaacaaatgtacaacagttagtttcctcccgcttgccatgagtactatgctaaaatgctgaaatgttatatcctcatgttatatttgtcttgcgcaatgtttttttatcttttccccatgggtacactggtgagtacttgtacttcacgcatagaaaacaccactcaaacacaaactaatttaagtggcctctaaaatttgattgtcaataccagctatggataggtgatggatgtaccttcctaggcacaatttaaccggacaatgaaattgaacatgtagaccaatgtcctgatttaggtggtggcacagacattactattgatccagcatatgtttctcctgctagatcaggtatagatggaatagtagttgttaatgcaaatgaaaagatagccatttcaccctcttctcagacgcaatcttttatttttctgttttttttttacagaattgctaggtttttgttagaactgctattagaaaaattgagtcacttggtgaggaagtggaaaagttgactgaattacttgctaattctcgagatggacgacaatgtcaatccctaagtcatgtcaaattctgcaacaacttaaatgaggcaaataatgcgatgtatacagttctattctaaatgatcagtgcttgtttccgtttcattacttttggccaacaatttgtattggttgaacaggagagtgcaaatggctagctttttgttagagctactgatgctatcctggacatgaagagttgcatgttgaaggtggtcgcttgttggttgaattatttaatgtacagaagtacagatcggtggaccatcgtcatacaagagtcttggaaacttttgctaattaaatagacttcttttgtatgaatgcaaagacaatgtactcgtatatatgtacactgatgcaagtgtttgcccactctgctgtgctggatataactacttttgatcttgtggaatcttaaagtcagtatgtttttttcatgcaacttaaagtcattatgttaaacctgagttgttgaatgcagtggcgaagccaccgtaggggccaggagggccaacacccccctaacccctatgtgacctcccctcccctctcttctcccatggataattagcccttataatctagccattaattacatcattagttgcagatgagactagctatatagaataactgcctagctatatatatataggacttatgaaatgacttagttaactgatttatcattttaaaaatgattgcaagactccaattaaaataatggaacaaactgtttaaattggcaaattatgatctatgggttctcattctctcttctagctaatcgctataacatgtatgatgtcgagttaacgatcatacatcaacgctacaatatcactgttcattaaaccttaagtgagttaccacatctcgtagatggcaccccccatctctaaatcctggcttcgccactggttgaatgcacgttgaaagtctatggagtcttgaattgctggatgtgtgttgaatgtctatggagtttgtactgattctgtgggctgatttggtaccgatctgaatttgtgtacattggacccgttgtactgatttggtccgaaacaaccaagtgccggtaaaactactaactgtcagactatatgccagggatgctctaagcatcaagggcagttaattgccacggatacaactatatgccgggaatactctagtgattctagggcagttaattgccaggaaaaaaaatatctgccgggaattctcttttgctacaggactttatagggcggtttttaagtgccgggaatagttttcccggcagatgaattgccattcaatgcacttatctagggcagttgcaatgaagggaatactaggtcatggtgtagtgatactaggttgcgccgagccgtctggagcttgtttcctatctccatccttaaaagagctgatccaaggatcatcagcaatcacctttattttgtatttctgaacaagtgttcccttgcgggtctacatgaatgagttcaagaactgatcccgtgcttgttgcaacattgtttcaaactctttcttctgctcgggcgtgaatttttccggatcgatcggcacgatgttttcttcattgacgtcagtcaatcctaacttcagcatcttttacttaacagagcctgggctagatggtggtggtggttgtttttcggctatgaggaagaactgtcggctgacttcttactggtcccaccgggcgtgccaaaagcgtgttaacagaaaacacgaggcctgagagatctgcttaactccagtgcaggtccaaagctcgcctttgggtgtactagcgtgacagttgatttgatcctgtaatcaacaagaaatagaagcaaagaaactgcggttaaatctataaatgatagccgatcggctagatgccgatgacatatcatttatccctgagccgatgtcatatatgaatcgatcggcaattgtaaatagataataaagaactaaatctattcaatcggctgtagatatttccaatatacagttcttatatcgatatatatttaaatcaagtgattgagatagatcggtcaccatgccgagacagtataaatcacttaggtcgaaatatatattaataacaggtctatatatgttatagcatagctgatcagatagacctagcatgtatcggataatactccgatactactctatatcaggatattaaaataggtataatatatcaaacaaaggcctaatatatttaaatatagcaatatcttgacgtaaaggacagatttaatatgtcaattaagcatataaagcaaatatagttaaatcagataagatcggctgaaactccgatgctaccctaatcggcaaccagaagacaggttagagattgatcttctaagcacgacttaataaatcaaactcaactgatgcagcattaagtatgaagagaagaacaatatctagacaatcaagccgctggaagtttcatagagtggtaaatatcttatataatctgaatcaacgtcagaatctaacctaatcggctaccttcctcgatagatgttagccgattgtaggttagacagcgatattgccagagattatgt

SEQ ID NO: 64562 - DNA, 5507 bp, Oryza sativa
tgataactcgacgaatcatataaacaagattagagtatcatgaggatggaagcactaatctcaagaacgcaagccgtcataacaagttttacctcttgttgaagatcgaaaccgatgcagctcaacccgaaagcaagaactcgtcgaaacaaaactaaatcaaaagggtggtgatgtgccgaaattgtattgaacgtgtgttaaaagttacataggactcgggtctatttatacccgagaattacaagatacgtccataacggacacgactactatctctaacaaactctaagataccataagtctttgcggcagacttttgcccaaacgtatctctaaggaaattatataaaacatcctaattaatagatacaattgcctcctcagaactctatccatgtacggcaaccaccttgaagcacctcaatcgaacccgacatcacacattaagttgtattgtcgggatcggctacgtctgcttacctagcccgactcagactcagccgatcttatcgtagccgatctggactccagccgattcctgccttgttttcgaactcaatctccgcctccgactttgcttcgatctaatcttctttcccaatgccgatgttaccaaatttggttgttaacaagctcacaccgaaaccttccatatatagaggaaggctatataaaaaggagagggtgctcatattgtacacttgtgcttgacttgtgcttgaggatgatagaatgatgaatgagaagagagtctcacccctatatcttgtgtctccacttttatagaattatgggacccttttggattatttcgtgtagcaggagggttgcgtaatacgttatcagcacgacgttctaccggagaccaagcaagaagaagggtgagaactcgcacatccatttagcatctcgccgattcaatcacgaaaacgaattcctctcctcgttcgcattccgttcttgtttttctggagaaatctgctaccgccgacttggagtcgccggcgaaagccgattagcaatatcccggaaaagctagctggctgagcgcgtccctccgcgccatgccgcacacggataccccggcgacaggccgcgtcgtcctggacgcacgccggccaccgcgcccccatagctgcactcgcgccatcactggcagccgttcgcgctcgccatcaatggccatcgcctcactgcaacgagggcacgcagcaagcccatgccggacgcgtgcgccatggcaactaacagcaaaataggagaggagaacaaaggaaacaagacaaagaagaagaacaagaaaaagacgccaatggagacgtcggccactgcatgggccacgccactacaccgaactccacggcgtcacgaccggtcgtcgctcagccgcgcctgcacagaggccgccgctagcagcacccacgccgacgtccgccgccgctcggccgcacctcgcgccaacccggccgcgcccaccgccggccgaaccgccgcctggccgcgccatacacggccgcgtcaccgccgcacggccccgcgccgcgccgccttgcacggccgcgcgccaccgccgccgccgtacagccgaaccccgcgggcgaccgcaccgccgtgcgccgagccgccccgccgggcgaccccggcgcgccaccctgcagcgcccggtcaccgcgctacgctgccacctcgcctggctgcgtcgtcgacatccgccgccgctcggccgcacctcgcgccaacccggccgcgcccgccgctggccgaaccgccgcctggccgcgccgctgacgtccgccgccgctcggccgcacctcgcgccaacctagccgcgccagccgccggccgaaccgccgcctggctgccgtgcacccgtgctaccgcgcctggtgccgccgccgctcttcctcagcccggccgcgtgctcgcgccaccactctcccgggcgccgcgtcgcgccgccccgatgtcggccgccgtgctgttggacgtcgccccacctccaaacggccggccgtcgccgggccaccggctctgcgccgccgccgccgcgtcgtcatgtatggcaggcgacgcaatcgggggagtcaacgggaaaggataaggaaagtgggagaaaagaaggaaagagaagaagaaaaggaaagaaaaaaaagaaaaaaaaaaaaggaaagaatcctatgattttgcaaaaatgcccttgtttttttggaaattaagtgcatgttcctctgtattggaatctttgcattttaaaccctgaattttccagaaaacacataaataaccctctgcatttgggatatttgtttgaatagcattcggaatttgcaaatatcaccaaaatcatattctcgcataaaagagccacgggacattgaatttcgacccgactttgtatttcaggtacctttattgctgatgtttatgattatgaaatttaattatcgcatttacgattattgattatttgtgatgcttttattacttttaattaatatcattgcgataaaatgtatagaattgcatagtatatactagaattatttgcgggaattttgtgtaccattatattgcaacacttgtgcattttaccagcatttaatttgcgcatatttttttttgaataacgaaagatgactggtatcgcggattagaaaattcgctgaatctagaatatctctgacatatttgttttccaatgtcgaaattacagtagagcaagaagccctatggtaccgttaatccaatcgcgctataggcattgacttgatgagtttgatctagcatttcaaactctcgccagtgcctcgaagccactctcatgaatgagtaggctagaagaataagcgcgttagcatttagaagattatggtacataccctacctctcgtagagcaagaactatgagcaagaatgggtatttttcgactatgattcactgagcagatgacacaaagagtacggtaatacggtgcaccgaatactgcgaaaactcttgatgttctacccgaacatgacaaaagtcgcacgcaagcatcactggtgcacatacaagaagtatgcctaactagttgataaatggaattgcgtaatgttcatgacagtactcactagaagagcattgtcttccaaaaccaactagcacagttgataacgaattcaacacgagcagctagcccagtacacttacctcaacgaaagaagaggaaaggggggagtagaacataggtggtcaaggtgaaacaatctagaactatgaacattaaaagaaaaggacaatcctaatagcacactcatcatgaattgagggggagagcttctagcctatttgcattgatatggacgaagaatctcctatgctatatcggatcggccctaaaattgatgtcaggatagtaaataattgccatagctatcgagcaagaagctcgctatgaagttaattgaatccgaagtaccgggatacctcgttgaatcaatatacttcgtcatcacttgttgcaatctttgaatagagcattgcatcgaaaaatggtccttgcccaagtagagcacacattttccctgcaatagagaattattttcggtataaaattgcatatttaaggcatttactattttgttgctcttttctagcacatagttataatgctttgaattatgtgtagcgcccaaacataagagaaaaagaatgaattgtggtccgcataaccacaaataacactttaagagaaagaggtattttccagacccatagaactgaaaatattatgattgttgctggcagcaacaactaaatttgtcggcctagaatgcgccacagtcatattacctatggaacaattgtgcactttatagaagcatctattgtccgtcaaccccgttgaactctctaaaaagtgtgatcatttgggctacacccttttagcaatggattttcagccatttctggtcttagaattataagaataaatattacaactcgtatgatcatggcacatatatgcataattttcctaaatcatgaagatttgtgtgccaagtatgcaccgacaggaaattagtgcataaaccacatatagttctagcatccctgaactggattgtgaggaatatctgcggctcccatttggtactatatggataaatgcgcttccaaagcagcaaacatccagtgtctcttagacaccgtgtctctgccaagactgatccagcaagatcacgtgaacaacaattgaactcactaaatcatctttagaagtccgcgaggacaatgctagcattgcatttgatgattggtgaattggtagcacgaagtaccaaatatccgcatgaacgaaccaagtataagctatgaattgcaatatatgctatatcattgttgtaatacccgtagtagaaaaggacatgtagtccccaaagctgcggattctgaaagaaaattcagaccatcggcataaacatccatcctgcaactaatgctattgcatctgtttggtttatgtgcatatcccactaatgcgtttcaaaaggctctctccgaaggtcgggaactttttatggagatagttatgaagcctaaaatccttgacaaataagaattatttccagtcatttagggggggagaatgaacccctagataggaaatgtcaggaaatatgacagcagaaagggactaatgcatgttacaccacactagtgaatgtagtttgcatagagaattaaaactgccaaattactttgtaaatacttttgtgatttcgaaaagtttgactaagttgcatgaatgaaatgcaccggaggagggtgataccgaagaaagtaaaggtacccctcgtcttgtctagaggcctcgaacaaaaagaattggacaagaaacttcggctcctcacacccctaaagtaaccggagacgtctggtgaaaacagggcaagagggactatcatactcaaagtcaaaaggtaccccaccgaatagaaggggagtgtcacaccctgaagtttcccccccttttcttgctttaaaaattggttaaataaattgcccaaagaaattatcttaattaacctagagctaaatccctaattaataaatgcatttaataatcgaattcggcgtggtggaatttttcttgagttccccatgctccaatacattaacatgatttttagtggaattttcagagccttggaaataattttaaccaattaaaattgagcaagtgcaatatttttaatcccaggaaaatcctttttctccttttcttttcttttccctcctttttctttgttgggccgtcggcccgtccctctcccgcggcccctcctccttgtgggccggcccaagccgcccctccctcctctctcgggacgccgacaggtgggccccacttgtccgtcgtctcctacctccggccgttggagccggagctccaaccgccgctgccgccgaaatcgccacgccgccgctgtttcccgccttctccgctccacgtcgtgcctcc

SEQ ID NO: 64563 - DNA, 909 bp, Oryza sativa
gcccgcgccgtccgatcggcctcgggccgatccggaccgtcggtcccgtggaccggcggtggaccacccgcgtggtcccggtccacggtagactggccaccttgtgctgctgccagtggggcccacttgcccgagccccctctccctccccttgtgcgctgacaagcggggcccacctgtcggcgcagccgcccccccttggatgacgtctgccctgggatttattgcgcaataaattgattaaggactttttctttattagtaaaaacactatttatcttctaaaattcataagtaattcatccgagcttcgtttaagtccattcaagtctcaataaattcataaaaatgtaaagaatccattaaaaatagttttgtttcctgttgcagtagtcttatagcatgttttgcttgtgtgctttgtttgtcgcgtagatttcggccgtttcgtcgatccgcggtttctcgaagacgttgctgaggtctcatcagtgtgagagcaaggcaagtcatgctttacatttaatcatattgtacccaatttacaaacactctgcatttctattaaatgttgcactcttttacaatgtcatgtgggatgggtcctattactcagccatatatcgttttccatatgccattgataactggggtatcaaaatgattagatgttggtttaggaaatgcttagccatgcttagttcaactagtacacaaaaggggatcacattattacatagactctgactatgagcatagttctggattcgtgccaccgcaatggtgttagttaattaaaatacaccgaatggtgggttgtgggtgcatggttttgctggtcgcactcatggcaattaaggaccggttcacgggaaacccttggagacttaccgtgcttaccacaagcag

SEQ ID NO: 64564 - DNA, 1148 bp, Oryza sativa
aacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtcatggcacggggctccgctccgcttgatggtagcgtgctgccgccttcccgcatcgtgagcgagagacaggccgagctgccgcgccgcttcatgccggaatctgccaccggccgggagatagtctcgctgggcgagggatgcccggcgccacgctacccggggcggtccgtcttcttcctcccttttgctatggcagggctggttccgccattttcttcttt

SEQ ID NO: 64565 - DNA, 1132 bp, Oryza sativa
caccaatgtaagtatactatagcagattgactctttgagatgacacctagactcatattgctagccagttgcctgtctggccatctgtgggccaaacatgttataagctaactacttgttttatagctcttgaatgtccagattaaaaaaataaaaataaaacatcaatgtatcttatggctggattttctggctcacttattttgcaattaatgttgttcacgaagtcactgtaatttatcagcttcttcgtgtgcacaggtgtgcatgtgaaccaaaagtggaactctgctagtgggtacctataatggtcaagtaaactggaaatgctgcatctggcatgctgaatctgaaaatagagcatagcctcaaatgaaaatcttcggagttagagattgttgcaaataccgaaagatattatgatggtatatgcttctttttacagccaattggaaaatccatgaagcggttgctcgacgttcaaatgcccataacaggtcttccagtgcatttacaaagttcaatgaagcagaatcttctagtgtcccaagtttttctagaaagctgtcaacctcagtaaacagagacgaagtcctctcagtaaggagcctgcagaaggtgtaagatttaatcactgatgaagaaaaaaaatacggaacattatgaacataatcaagtacaatatcaacctaatgggaaggtcaaatccacaatcctgcaaagactttagaagaagaatggcatcatcagtctgctcgcacaaactagcagccctgatgaaacttgtccagacttgatgatctggttctacaccatctcttttcatttctaaaagctttgtgattccaagactgtagtcacgatttctcaagtaagcatcgagaacagtactgtatggtaaagtgctaatttccaaattagaagatttcaagctgttcaggactttctcagcttcgtctgggtgcccagaagtcccataagaagtcatgaggatatgcatagtagcgatggttggttcaatcccatcctctttcattgctgatagtaagtgctcggctttggaatgcatgcgggcattcctatatattttcatcatcatgtggtagatagatctatttaaccgatatccctt

SEQ ID NO: 64566 - DNA, 1798 bp, Oryza sativa
tgtgcctattatcatgtccaccacatcactgacgttcatttagctgacctcatttgctgtatcttttgcttatgagtgaattgaaattataatacaatatgtaacttgtttacatcttttagctgaagtatttacataaagatctacttgacaggctagacaggcttacctgattggcaacaaagctctagccaaggaattgagtatgaagggacagacatataacacacaaatgaaagcatctcatgagaaagcaagagaagctatttatcgacagaggtcgcctaactggttccctgttctttctgcgctggatggaaaatccttttcatgccaatttatactttgtccacccgattgacaagctgcgccttgtactgttcctaatatttacaagtacacttaacatatcatatgtttttgttgcaatgttcctcaggaacccatcttcgcaacgagggagcgaccgtctgatcgatctacatggtctccatgtgaacgaagcaatccatatacttaaggtcgagctcggtactcttaagagcaccgcgagggctacaggtgagaggatgcaagtcatgatatgtgtcgggacaggtcatcacaccaagggttctcgcaccgccaggctgcccatcgccgtcgagcagtttcttctggaggaaggcctccactacacgcaggcacaacctggtttgctccgtgttgtggtgttctaacatctcttaggtcagcagcacgaagaaaaaagaagcaaaacaaaaaaaggagaaagagatgtagggaaaagaaaaacctaaaaaaaatggccgctgttgcagcactgtaattttcttgtagttgtatattaaaagaggcagcaggagaatagcctgacaacagaatacagtgtaaaattatacatagcttcattcaattcacattccattcccatccggttgttcttgcatgttcttgacgttttcttttgaggtactcgaaggttgtttgggatgcatatgcgatttagtatttgccatttcttgctgatgattgatgatgaacatttctaatagaacgagttagaccatgttttgaatttctgaaaattctcctggttactgtggttgttgctggaacggaaactgatcaagggcctgttcactttgatgttaaaaaaaaccttaccaaattttggcattgctaaaattgctaaaattttggtatagttaccaaacttttgacaggattttttatatactttatccgtttcacaatgtaagttattctaatattttttacattcgtattaatgttaatgaatctaaatagatatatatgtctagattcattaacatcaattttaatgtgggaaatgctagaataacttacattgtaaaacggagggagtagttatcaaaatttagtagcaaactaaatgtaaccacttttttttgacatcaaagtaaacaggcccgaagtttagctatccaaatatgccccaaacgttcaaatccaaacgaaatatgttgaaaaattgaaattatgtcggcctgtcagaggctctttcatcgcttctgaaacactgaaactgcagctacgaaatttgagacagatttttcaggagcagggagacgcgcgaggaaaaatatcttgcgctcgattagtgattacccgctcaaactcccgcaacgttatcatctccactcttccacctccatgcccatgcgcgactgatccgccgcccaacgcgatgcctctcatggccgtcgcctcccaacccttcctctccaccttcacctccacctcctcgcgccat

SEQ ID NO: 64567 - DNA, 1779 bp, Oryza sativa
gcgggcgcaccgcgggagggtgaaaaagctcagcaagctcgcgctgcggcgggcgcgggactggcgcgcgcgcgtcgcgggcctcgcggaccgcgtcctggcgctggcccccggcgcgcccgtcggggacgtgctcgacggcgcgcgccccgcgccggacgagctcgcgttcgtcgtgcgcgcggtgggggtggcgtcctggcggcgcgcgctcgacgccttcgagtggctcgtcgcgagcggcggcgggcgtgccccgggcccccgcgtcgtcgccgtcgtcctcggcgtcctcgggcgcgcccgccaggacgcgctcgcggaggatgtcttcctccggttcgcccgcgagggtgccaccgtgcaggtgttcaatgccatgatgggcgtctacgctcgttctggccgcttcgacgacgcgcgccagctgcttgacgcaatgcgtgaccaggacatcgagcctgacctcgttagcttcaatacccttatcaatgccagggccaagtctgggtgtttggccgctggtgtcgctcttgagctcctacatgaagtccggcaagctgggctgagaccggatgctatcacttacaacaccctcatcagtgcttgctcacaaggttctaatttggatgatgcagtggcggtgtttgaggagataatagcttcagagtgtcggccagatttgtggacgtacaatgccatggtctccgtgcatggccggtgcgggaaggcacaggaggctgagctgatgtttaaggagctggttgagaagggttttcagccggatgcagtcacatacaactcgctcctttatgctttcgcgaaggaaggcgatgtggagagggtggagcgtgtgtgtgaggaattggttaaggctggtttcaggaaggatgggattacttataataccatgattcatatgtatggaaagatgggcaggcttgacttggcgcttgggttgtatgatgagatgagggctataggctgcactccagatgctgtgacctatactgttttggttgattctttagggaagatggataggatttctgaggcagggaaggtgctggaggagatggctgatgcaggattaaagccaactttggtaactttcagtgctttgatatgtgcatacgccaaaagtgggaggcaggatgatgcggagcgtacatttgatcgtatggttgagtcaggtgtcaaacctgatcgtttagcctatttggttatgttagatgtttttgcaaggtctgatgagactagaaagctgatggttctgtaccgggctatgatcaaggatggatataagccagatgatggtttatatcaggtcttgcttgctgcactcgcaaagggaaatgaacacgatgagattgaaggagttatccaagacatggaggccgtttttgaaatgaatccactagtaatatccagtatactcatcaaggctgaatgcatttctcagggtgctagtctgttaaagagggcatgcctccaaggatatgagcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 64568 - DNA, 1319 bp, Oryza sativa
agcagaatactttatttttttataatccctaaaaaatggattttgatcggaaaaaagtacttcgcataaatatgaactgttttgattttgcgaagtgtctttcataaacttttaggaatcagtagcaaaaggttttttttttcgtgttagaatatatttttattagcattggaacatggccaaattgcattctataggacgcttgttccttttgaaagggagcgaacacaaatacactaatcgaacataacagaaggttaggagtagaaagatattgttcagttctgatttctcggatgatcgagaaaaagtagagtggacagctgtgatgcttgagagatgataaaacccagttaatcgtgaactatatacgtatgttcatctcgaggactgcaattttgctgccatggacctgcagattgtttggaaacttggagaagctgtggtgccatcactgaattaacgtgagtagtagctgatacatctcttgtacagatgggagcaccatgccggtcaactggtgccacatcattatacgatgatttcgattttaccgacagcggagaaaaaagaggagaggatggagggtggccgtgcccatagtaagatggaagggatcggagtttgtttttatgtgttagagataacatcttatcattaaaaataatgggtccaccaatttaaatgacaatcgaaggttagatttatttttcttcttcttataatttttagtattttttctaatttattaaaatgtcacatgacaatctaggagcgtttgtaggaatcccacgtggtggcatgagagcgtttataggaaatttaatggacttttagtatataaagatagatatttttttcaaattacacagcgctcccatggaaagtcgaacccaggacctcaggtgctactgaagctcttataaccaattacaggctctttcgcatattgagtattagtatgagtatgagtattaagtatattaatactcaatatttaaagtgttgcatctattgtttaaggttatcttttttacatattgaggatgctcttatgtatgtttaggccgaattcggtatatatctaattaatcataaccatatctttactgttcattttgaagaggtttttttatatataaatgtaagtcatgtctgaacacaggaatcagcaattattcgatgtaaatcacacaaggggtgtgtttagttcacgttaaaattggaattggaatgatgtgatggaaaagtgttgggaagtctatgtgtgtagaaaaattttgatgtgatgaaaaagttaaaagttcgaagaaaaagtt

SEQ ID NO: 64569 - DNA, 4294 bp, Oryza sativa
tctataaaccgtgagatgaatttattaattaggtctgtaaacagtttacatatgtgagttaatgtagcacttattactaatcatagactaattaggctcaaaagattcgtctcacgattttcatgcaaattgtgtaattattttttatctatatttaatgcttctatgtatgtatctaaaaatttgatgtgatgtttttgaaaaaaaaaaactaaataaggcctaaatcaagatttcaatgtcacacagtgtgcagtcagtactcagctggagcacgtactggtgcctggtggaccgattaggaaaagaaaaggacgaaaaaaaggtttagcactgtgaccgtgaggagcatcagcaatggtatctcagacccgtatccctgctcacggcgtcggcgtcccgtttctgagccgtctcccagcgtgggtgcgcgtttgctcgcagagggacgtgcccctcgctcacttttcgctgagacacggcacgagggcgcgtgttggctaggcgtgtgtcccgtggacactgctccctcccccaaatttccccttccacccctcgccgcagcgcctggacacccctctcccatatttccccttccacttccgctccctcccatggacatcgaggcttcgcctagagaagcttctagaagctccggtggggaagccacctcgagcgacacgcggcggcgggcagagctggagaggtggggcatggcggcggcgtagaccccgcgacggagacgacagccatgacccggcgacgacctcgcgatggagacgacggcgatgaccctgcgacggcggcgacggcgcccccgaccagatctggccaccgctccccgtgcgccgctcgctgcgggaaggttggcgacggcggcggcgggaaggttcgcgacgatgtgatgggcggcgctggcgacggcgcgacgggcgccgacggcgcccccgaccagacctgtccaccgccccccgtgcgctgctcgctgcgggaaggttggcgacgacggcggtggggcggccacggcagaggatgaacgcgcgggcggagaagacgaacacgcagaggaggatggggactggggagaaatggggaaatagggaatggctagtggtgatgggtgggctgagtaaatgagagagagaagaggctaggggtagggagggaaataatacctgtggctatatggggtgaagcaacccgttgtgggctgaagtagtcttatcctgttgcctaagattgtgaagaacctagctacaagtatcctccattgcaagatgggtgccctatggagtggcttcggttagtgagggcacccatagagtgtctttgattgctgatgccctaaggccatgtacaacgcatgtcttcggctcgtagccctagcgacgtcgttcggttgctgtcacttttcaataagcagagagacacggcgtatctgtgagcagagaagacgtgtctccctgcgctcctcgactcctccccgatccacaacccatggctccgtgttgagcgatgccgtggccacgcctccttcttgtggtcccggctcccgcagggtatttttccctttcactctcggcggcgcggtgaggagaggctggaggcgatggactcaacaacgcgttggggcggagtcagtggagcggaggggcggagttggtggcaaggtagggaggggtaggaggcgtgacccaccagatctggcggcgacgaacagaaggtgagagaggtaggggtgggcagaataagaccgaaccgagaaaaccaatgccgagaaattaggtctcaactagtgaaagatcaaaatttattcgctcaattcgatcagtggcatccatcaccgcctctgcctccatcaccgcggccatccaaaactacaacgcaccagggctatcttctacaatggcaagctatctcggcgaaggcactgcgttgcaaagaatgcaaatgcatcagaccaagaatgcatatgaatcgacggaacaacatatatatgcatgatcaaaagtgattgcacgatttatatatctgtgtgaacggcaagacgattcattttttacaagggaaaaatggcatggcatggtgacatctacggagaaatcgttgaaaaataagcaccaaatacaaatttaatggcttaagaatcgacgcccgaagtttcgtcgaagctgccttcgttgaaaattggacgccgacacctgcactggcgaagtttcgcggaaagctctggtggtggtggaattttctgtggaggctggccggcgacgacacaaacgaagttcagggaggaggggaacgaactggacgtgaggagcgataactaggaaatcggagctctgcctgagtgcctgtgacctatagcaaacttcaaacatatcatacatggtgatttctcgttacaaggagttgtatggtcttgttgttgtaacggaagtgcgtttactccttttcatttttgtggcaaagcatgatcatctttaggccgaattgtatactggattttaattatgcatgtccacacctttactgttcgttcgttttaatgagtgaacctaagcccggtttgaacatttataataatcggcaaaaggtcgatacgaatgactttactgtgtgcaaaaagtcgatgaattcgttcggttgtggatgccttgcaaaagtgagagagtggaggtatgatccaaggggatggtcggatggatgcatgaaaggtttccttctttatttcgctgtgatctcgcgtcgagaaattccattaatccattgtgaagttcagaccttgaatttgcacgtacaggtcgacaggtaacaggttagataggaaaataaaagaaggaagaacaggtttaacactgtgaaggtgaatctgacgaattaattagcatcttctatgcaaccgctggatttgcccctcgcgttgagaaagccaaaagactttctcttgaatatctttttctggtcgtaaaaaaaaaactcgaaaaaggctcaagttgcggttggtggaaaagtctatcacgaggtcggaatcacaagtaatatctgcatcaaaagtagaaagaacaatagtacaaagctgcatctgtgtttttagtacaagtactaggaaatcaattaaatattccgctgttcgtgctctttccagttttctaatcgcgtcatcatgctcatcatcgaataagattctcctataatccttcggttccaaaatatatcaataacttcttcaccaatatttctttttaaaataattatgatccttcaccattcaatttttatatctacctttacttctcaactaatcacaatcttacaccatttaattctacatattttctttattatctaaattttttttacctctttctttaataaccgtgtctaactttaaaactcattatattctgggacgaatgaatcatatcattattttttttctataaaatgcacgaaagctgacacatctccgcccaaatctctcgttttccgttcgcttcaccagtcacagctctatcatggcttcgcgcgtgccaccgatcgtcatctcggccttctcgatcttgcttggggccctccagtcgctcgaatccttcctcgccgcgtcgagcgcgacctcgccgtcgctggatcgtggcgcccaactcgccgcaggtgctctcttctttaccattctgatctctgtcgagctcacttgtctccttctgttcgcatatgtcggcaagctcggcgccgctggtggagcggggcacggtggcttcttcgccgtcgccaccgcaacgctcgccgccgccgccgtgacagctctcctcgccgagccatccttcctttcttttccgctcgcgcaggcggaatcgagtaggtgagggggaagtgagatctatctgatcgctcctcctccggtcgtcgccgtcaggcgttgatcgaggcagttgggcgtgcttgtatctttcgtttgtgcaggtctataaagctattggattttgatggaaattggaaatactagcaattctactcgattattatatacggccactgttacatgcatcttaatttcatttccttttcttcccggtttcaatcggcaataagctgcagacctgcagtatcaaatccgagacgatatgatggagcttgttatttttctgttcacggaaaattattgctttttctggatcttttgtgaaaactttgttttctttatcggaattgctagaggactgtcgacagttttttttgagtgaaaactgtcaaattttttagccgtcgattctgctttaagatttgtactgagata

SEQ ID NO: 64570 - DNA, 5446 bp, Oryza sativa
tttaatacatatatataagttattattagtatagtatagatctagtgaaattatatactatagttagatttgaagttttctcctcaaacttggacagttttttagctagtccctttctttattgtttgaaaaagttagattttgtttctttatgtccttgtcgggttccgccagcatctggaatagagctaccaatacacatggaagtagatttttcttgtcactttcccctttttgtttttaaaagctataaactcgtactcctacttctttcgtggagtactacaataatccatactactccctccgtttcaaaatgtttgacaccgttgactttttagcatatgtttgaccgttcgtcttattcaaaaaacttttatgagatatgtaaaattatatgcctacataaaaatatatttaacaatgaatcaaatgatagaaaaagaattaataattacttaaattttttgaataagacgaacggtcaaacatgtgataaaaagtcaacggcgtcagacatttcgaaacggagggagtacaaatatttttagcccacacttttcaaccttgcggcgattttatgtggtgggcgcatgtgtggcctatatagtgggcctgatcggtacggcagcagctccaacacaaaatctgttatagatactgtagatttttactttttcttctaacgtttgaccactcgtcttatttaaaaaatttatgcaaatataaaaaataaaagttgtgctaaaagtactgtgaataataaagtaaatcacaaataaaataaataataattctaatttttttaataagacgaatgatgcaagtaaaatatcaaaatacttatattatgggatggagggactaccgatcaagtccagtcaagttagttgaagagaattggactttccagtagatagtgcgagaacaaattggactttccaacgttaacttattttatataaccatagcacacaaaaaattttactagccagccagtattacgagggtcaggtacacaatttttttttactgtggaactgtgctatgaattactccctccatcctaaaatattataatttaggatgggatgagacttattttaagattataaatcttaaaaataatcgttactgtacatatgcggcaatgattccaccactacttccaaattaagatagcatcgcaggaggatcttagattttgttgcgaaggtaacaatggatggaagcattgaacaattgaactaaactttagtccctctcacaaaagaataagtcactaccctaaggacttatgtttttaagagaggggctaaagtttagcaactagagactaaactttagtccctctcataaaagtgtccttaccctaagaacttatgtttttgagagctcgcaaacacccccttaaaaagtctcatttctcagggcagtctttgcatggggcattgattgacctgaacaagtgtggtctgattggagtgggctggtagaaaagcagttgaaaagttgggcacattggacctaccgcccagtaccgacctgtccgagcctcggagacacgaagtggatgtgctgctgcgtgacgacgaccgggcgaccatgacgccgcacgcctccgcaccgagccactcgttgatggcgctgtatgccaaattcctcggcgttagcggtcaagcgagctgggctggggtgagcgtggttggttggtacaaatcgcgtttgaagtttccgaagctgcagacagattactcaaagtagagacgcagcgaaaattgaagctgattcctggaataaaccaaacggcatatttacatatgagaagtaaggtgttaataaaacttttatatacgtgttcttagcaacctaaaagcaaaaactgaaaaataaatttcgataaaaaaaccccaaaattagcttcaaatttaatgttgaaaatgtaaattttggctaattagtataaacataagcgaaaagatgaagccattaatttctccattactacctggctagctagctgtgctgtctgagagaatgtaatagtgtcgtgaactagctagagagagtatgcagggtgtgtttagttcctgatattggggagaagtttggaaaaaattgatagtttggaaaaaaaagttaggagtttatgtgtgtaggaaagttttagatgtgatgtgatgtgatggaaagttaggagttgggaagaagtttgatgtgaagtaaacataccgtagtaacgagctattaagtgaaagcctttaattttcacgttcggcgcagacagccagccagccaagccacaggaatctacggcgctcgcgcccgcaacactcgcacggcacgttttatctagcgcgcacgcaccggcagtccatcgatcggctctagcgacagtacgattattcagcgtattcagcgtattctgttcactgctggccgctgctcgcgtcgcgcacacgcagccggcagctcgatcggtggatcacttaggcccggtttagttttcaatttttattttctaaaaaagtcacatcaaatatttaaacacatgcatagagcattaaatatagataaaaataagaactaattgcacagttagaaaaaaaaatcacgatacaaatcttttgaatttaattagtccatgattagtcataagtgctacagtaacccatacgtattaatggcacattaattaggcttaaaagattcgtctcacggtttccagatgagttataaaattactccattcgtctcaatatatagcaacatgagacaacgaatctggactgtcacatgagacaacgaatctggactatccagatttgttgttctaggatgggcctcatcctattgtagggtgttatatattgagacggagggagtagttttttcattcgtgtcacaaactctttccgacatccgaccaaacgtccaacgtccaatgtgacacatgaaattttcttttcacgaagtaaacatggccttattcacgttccgacgtacgtacgcgcggcacggtgtggatgtgccacaacgcgttaaagacctcacaacgcggaggcccgatcgaattagccgaacgctacggaaatttcttcgtactaatgcgcggcctgtagagtttggagtgtcttgaggcgcacaaactggttaattcagcttgtacatacaatcgtcgtaattaaaacaacgctgataaaatttcaataggattatgtgggtcgactcgtttgaagaaattaatgatctttgctaaagggatatccataatattcaaatgtttatgaaaaattttaactatatagattaatatgtaatatattactccataaacatagaagatcaaattaaacttttaggacccctttgaatcgcatgaataagaaaacataggaataggaaaaacgcaagattttgataggaatgtaactgtaaaacagaggactgtaaaacataggaatggtcgtttgattggatcacaggaaaaacacaggaattagatgaaagataaagactcaaaagaaagttttcaagagattttatctcatgttagaattcctccaaaacttgcatggcattaggtaattcataggaatttcataggattccataagatccattcctttgattcaaagggctatatatgaaaaattctaatagaaataaaatcctctaaaattcctataaatttcatttgaatcaaagggggccttacatgttgcaacgaaaaatgtttgactataaatatacgtgaactagcaaaccttttaattgttttgtttgcacttgggacatggtgaattttaatttgcatatttgtgaagtgatatatcgcatattaatctatcttctatttttttttaaaaaaaatcataactatttcgataatatacaaacaacgagtgagtatcccatcgagagtttaaaatttgcacccactgtaaagagagaaaatacctggtacattcttgccaaacaattttacaaactacggtactagctgatgttgagttaatgacattttacatattcagaaaacaaaatgcgtgcatgtagccgcgaagtttctttcatcttgcccagaaaccctccacaccattgacttgtgagtctgaagaaaaattgttcgtgtagcaacactatctcatcttttgatgggcgaaaagattagaaatcaaaacggaatggtactgtttaccgcgaacggctagctagtaaacgtactgactgtcatgtgaccgattaaacctcgatgccgtcgtttgccgcggtttaatagtgcttagcctatattatccccctttactcgctcgatcctccaccccctcttctccacccggtggacgtgaggggagaggtgagaggccatcgccatgagatcgacctctaattctctgtatgatcgcgtgttatcttttctaattttctcctctttcctcgcagataattctgcggagctcgccatgttggccatcctggtctctgtcgccttcgcccagatcctcgcgatcctgtccaacagtttcgcggtgggcgacgccgccgcggggtacgagtacgacggcgcggccgaccaccccgtcctgcgcatggctgtctccaccctgaccgtcgccgtcccggcgacgttctacgtcggcgtcatggagctctacgcccgcgtcacgccggtggcgccgccgcttcggcggctcctcgccgttcttgcgccggggatggcgtggatcacactctttcttggtatgccgccactcgtcgttctgctcctcggttgaagctgccgatcgaggcgcgtgacatggaggaggcaaagcaaggagagagagatcaacaccaaccactccttcgtcaacacgctctgcggttcggtgaaaattcttatcttatggctgcaccatttgcaactatgcaagaacacaataattctcgctcaacctatgttgagtctgggtgaattagcactgcatctacaagaacgggtcggctggctgccgttgcttgctattccatccatcccagtgtaacttagtacggctgtaacatattctaccactacgaatctagataggtagctatctagattcgtagttctaaaatatatcatattcgtgctaggttgcacttatattggtatggagagagttgcgtgtagtgctgcagagtctactggcaagccatagaacaaggttcctgagtcagttcaagtgtactactactgtactttcattgctagagtgagtccatcggtgtccaagctcagacatgcagacaagagtttatcctggcatcctgctgcctgctgtgtactaaggatttacagatagtatatgctcatacagcaatagaagcatagaactacagtacgtaaagtcattaaacagtgtgtaagtcattactattataccatcaataaaatcttatgccccaaatttactcttgtgat

SEQ ID NO: 64571 - DNA, 9815 bp, Oryza sativa
tgaaacctcttttgatgtcttatatctttcaaaccatatattatttttaagatctttttcactgttgtactctgctcaaaatatatgacaaaacaagttcaatgttgaatatattctaaagtaatttatttaaattgcaaaagtaacttaactatgcaatagaagtaactctttatagcactagaagtaattacactgtgagtgtgagtgagttgaaataagaaactatgtggagtaaatccacaaacaaagttagagaagattttcaagtaaatacatatattctttatctaaactaatctctattttatttttctaaaaataaaatcttgcgtcatatagaaagtaactcttcacgatattaaaagtaattacactactggagagaagtaaattttaaagaaatagaagtaactcttcataatattagaagtaaatacactcctagaggaaagtaactatagaaaaataaaatagaaataacttcaaagtattagaagtaagtacacagcttgagaaaattaacttttcatggcgttagaagtaactacacactaactacacttctagagtagctacgaaataaaaataatttgaatatattcaatattagactcattttgccacattttttaagtagagcataatggttcaaacgtatgttaaaaataatataccgtcatagaaatataggtaatcaaagattctatggtaagaaaatatactagtgttgttagcctctgtagcatgtacgtaaattgatatgacaactagcagatcatctggtcctatttttctggttagtggtctcgtttctctatcttggtcaggacaatatccatgtgttcgtatctcagccatcatcaacgaattggtcaagataactactttcaatgctttataggtagttacttctattgcgaagctaagttacttctacgatttaagtaaattactttaaatgtttgaatatatttagtattggactcattttatcatctattttgagtagaggatgatggttcaaacgaaagtgaaaaataatgtggtttaaaatgcataagccatcaaaggtattgttaaaaaaagaattggctagtgtaaccaatctttagttttgatggatggtggtgcatagatttctcgctttgatgccattgcagtggaagcaagcatgtcgctccgatagcaccaagacacggatggatggttgtcggacgagtcgcgcgataatacaaaactgagagcgttttcgatttagatttcccataaacttataccattaactagaattttttttaaaaaaatgtgggagctttcgggtccaattagcataggtttagatagatgttttctcaaatccaacattcttctatggtcccgtatccacaaactaacctcaagttcaacttagttctgaacctcttagtactagctttcaataaaagataaattttctaacataatatttggaatgacatgttttagcctaaggccgcccgcatgtaatacttactacttcggtacggtaagggtgtgctatatatgtttgtcctagacatttttttccctgaacgcgcgaaaacttgcatgtcaatatattagcaagagagaaaatattgtacaacggcgatattccgaagtggtcacgagggagggttttacacgaggagaagggagagtaaggctaaggtaagctaggtaaaaacaggtcccgaacaataaaaatagctggaaaatgaaaaaaaaaagaaacggggactaaagtaacatattaacgcttacctgctagtttttgtaagttcctcttgaatttagcccgtttctcttcctgcttgaactgccccggaaaaatagacagaatccttcctggaagattggaagtagacagaatcaggcgtcctggccattagtccattacctccatacgagagtctccatgaccagttgagagaggctctctgtccaaccaatgctctgttactttcatctgtaaagatgaaagggaatttcattgctggagactgctccatcttccatggaatccctcaattcagtgccacccattcgtcactgctgatccactccttctctatttccttgctgtgaagcagtccgctgatctgtttttgcactgcatacgcttcgctgaagctggaactcgatcaacctgctacctctaggactaggagtactccgaccatggccactccgactaacagcgatcacctccggtttgccgagcaaactgtaagcctctctgtaacctttccagtgcgtcgatctcccactccagcaactgccatatatatctccgatttctcctagctttcctgtagcactgcatcctgagctccagagtccataaacgcttgctcatttcctctctttccatacgcctgcagcttgatcaccggtgccattgcatgaacacacgctctctctctctctctctcaagagtttgcccaggtgtttgtgtgtagaaattctacagaagacccggtgctcaaaggttgtgcatacactgatatagacgtctatatggtgtgcaaaccattttataggaaacaaggtagcacacgttcatgcgaacgccgttttttcatcttgactttccgcgatcggtcacggcggcaagatacaggcaaaagccaaaatggaatgtgccaaccgatcgacaaataattcaacaagcagaatttccgcgaagcaacacaaaatgcgggacatgcaagcaaagcgtaccttgatgcatcttccgggaagtttcgttgtagcttgctcgagagaaaaaaatctcccgtaattctttgcgaaattagctctgttgattttcgcagaagcttcgccaggggaaatttctgtccagctgattcccatgggaggtgttggtgtcggccggcggcaagaaatcgttgcttacttctccgtaaaaaaaaagaaaaaaaaagatgtgaccctttatagtttgtccagattactatggctgtgtttagatccaaacttctaactttttccatcacatcaacctgtcgtacacacacaacttttcagtcacatcatatcaatttcaacccaaacttccaactttggaagaaactaaatacagcctatattaggagagatcatattcctttataggttgttttttggacggagagagtacgtttgatggtgacgtatttacattttaagggttcattcagattgttgctaaagtaaaccttatcaaaatttaacaatagcaaaattttggcaaattaataatattgtcaaaattttagtaagattggcttaataatatagccaaaattccatacacatttataatatttagtaactaaatataaccacgtaattattaattttactaaataatgttatggttgaaaatatcatcaatcgaaacagctcctaaaaacctctgtatacagtatactggaccgatatgcaatggatttatgggggcagatcgccacagcccaccggcctagtgagcttcggcgaccgtgcctaaccaaaactcatgtcctttctaaaggactttggcgttgttaggccttgttcagatcccacagaaaaaaatttacaccccgtcacatcgaacgttttaacatctgtataaagtattaaatatatactaaaaataactaattacacaaattgcgattaatttgtgagacgaatcttttgagtctaattgctccatgatttgacagtgtggtgctacagtaaacatttgttaataatggattaattagacttaataaattcatctcacggtttactgacagattctgtaattagtttttttattagtacccgaatatcccatacgacaacctatataccccagatccaaacaccgcccttaattcgtcgacccaagccaaaccaacacggtcccgatcaaacccaaacttgggccttctagcaccacaaaaggaataagtccagtttacctccctcaactcatggccgtgtatgaatagtatccctcaaccacaaaaccggatataacctatcccccaactctgaaaaccgttgcaaatcaactccccaagcagttttggaggcggttttgtcctacatggcaattgacttgcttacgtggcagttgacttgctgagtcatcaagcaggacccacacgtcagcagtcttcaactcatctcttctccctcaccatgattcccttcaagaaacgggaaaggaaaaaaatcaagaagcggaggcgaggcgatataatcgagcagcaagatcaacggcaagacaagtagcacatggtggttgccgaattcagagaagacgccggcaatcacgtgaaacaagaaaggggaacgaacagaacaaatcagagaccacgaaatcgtcgaagaacacgagcaaacagcaaacaagctagcggagttcttctaacgtgcgcgcgacgcggagcgggtgtccgccatgcacagctgcgggcaatgccgccgtcgtccccgtgccggagcctctccgtcctcatgctgcagtacaacccgacgctcggcgacatccccagtggcttccttcttggacggccggcgagctcctgccccgtgcgcggccggccgacgagatcctcctcgcgcgaggacggccggcgagatcctccccgcgcgcggacggccggcgagctccttcccgcgcgaggactgccggcgagatcctccacacgcgcggacggccggcgacttggaggggctgcctcgtcctcacgacctcctctcagatgatgccccggcgccctcccgcctcctctgcgtgctcgagccgagccgctcccccgcgcgcggcgcggccagccgacgagctcgtcccccgtgcgccgtcgtcgccgccctgctgatagaaggtcagaaggtgagaggaggaagatatgaaagagaaaggggaacagatgagggagaagatgagatgaggtggagactgctgacatgtaggtcccatttgatgactcagcaagtcaactgccacgtaagcaagtcaattgccatgtaggataaaaccacctccaaaaccgtccggggagttgatttgtaacggttttcggagttgggggatgggttatacccggttttgcggttgagggatgctattcatacacggccatgagttgagggaggaaaaatggacttattccaccacaaaatgaccttacgatttgtgcgttaaacgtcgccggccgaggatagcctgctatcacggcctcacgggccgacagcgcggccgcacgtagggcccaaaagtgacggcggtgacgcctctgtacgtgcatgggccgatgggcgacgtcgcagtcaatctatctgcccgtatttcaagccccagtcgctgttgtcgtggcctagtcggcgtagtgactggcggctgctgcctgcttgactgcttctgcatccgtagaggccatagcgggagtcagattggaacagcagcaccgtgtcacgactcacgagccatgtgtgctgtgtgtgtgagaatgacatatggtacactgatatctgatcaggttcaaaatttcagtacgaaatttcggtcatatcggaaccctcccccctccccatatattattattcactgaaatttttaaattttgaaaatttcgtctatcgataccctccgatagaaatgtccaaaccaaaagatttaatcctgtagctgatgggtgatatgagtattccacatttccattattccctaggatctgatgttagctgaggtcgatcttttttctgcgcgctggctgttatctctttcctttctcgtcaaatatactgattaaaatttaagaactctgtactggcggatgctctaattttctagcactactacttgtagtggaacgtacgtactactctattagttcagtcaggctccttgtgtggacattgagagtttttttttttactaaagagagtttttttttaatcgactaattccaccttaaagatataaacaaataacctactcgtccattatggcaaatatgaccgtgacgtggatgcgactattctacgagtgcggagaactaccccttcggaagtgataagcatgcatgccacagaaacagaatggtcggcttccagaaggaaaaaagtggagagcagatttggcacatttgcgctttccgacgcctttgctgcgcgactcgttcttcctccgtgagttccaagcaaggcctcaggcagtggcggagctataaattttaccctgtgggatcgaatagcattggtttatattttagtgagatcatttttataaaattcaatggatttacatgtaaaatgaatttacatgtaaaatatagattaataagtgccactgccatcaacatacctccgccaccggccgcactgacctgtatatgcagggttgctcatgcacaaagtcaagggaacctcttaatactagccttcaatagaagataaattttctatcataatatttgacctagacatttttttttccttcaacgcgcgaaaccttgcatgtcaatatataccttgaacgcgtcaaaccttaaatgttactccgtattagagcaaggataatagtagagctcacttcctactattagcccatcttaaagccaacatatataatagattagctataaggttggctacaattttcttctcctctctctatctctcacctgtgcatttaatgtatttacatataagtttgtgttaagctagttcttgcatgagagccaacatccttgatattttgttatctctcttcacataagtttatagtagacttatagctcactgttatacttgctcttagcaagagagaacccaccgcacgtctccgtcatagctaccaccggccggtgtagcccgctttatccagtcctctcctgggcccaatctggtttggaatctatcgattatcggatccggcaacatcaccgatcacatggttccacctccgcacgcgacggcccgacccctccgagacggctgcgcctgtccgtgtcccgcctacgaattgccgccacgccgatcctttgcgccacagagtaatacagagggaggtgggaaggaacacacaagtgtgcttgatatcgaattccgcagccgcgatggccggtgttgttccgatgatcatcgttctggcgatgggcggcggcgcgctgggcgggcccgaggcgctccgcctcttgctcaccttcgccggccggagccccctcgtcgacatcggcatcgtcgtcttcgtcatcgccgcgctcgccgcgccggcgctcggcaccatgcttcttgcgtgcttctaccgcacgccgcgcggcgcaagaggtgcggcggcggcggccgctgacctcttagccaagatgacgctggcggtgtccatggcggtagcgctcctcgtctccgcgtccctgctcgtcctgccgctgttccagtccgggaacgtcgtcgtcggtcttctcgcgctcgccgttcccgccttcgtcgtaggcgccagcgccgcgcgcgtccgcggcgtcgcgcatctccgcagggcgcgcaatgcctccggcgcggtgacggacgcggggcgcgccgccgtgacgaccctgacggtgtccctcgccgccgtatgcatcctcctcggctcttgcgtcgcggtcggcggcctcgacgcgcaccacctcttcacctccttcgccttgaagaacccaatcatccacgcgcccaccggcgtcgccaccgccgccgtcgtcggcaccacgcttctcgccctcttcttccgcaaggcgcaaaatgcggcggccgcggccgcggccgctgccccactaccggccacggagcgcgccgccaagattatctcggacggtgccaatcccggcggcggctgcacgtgaaggttcccgcgccgcgagcccgcgacgcggccaccgtgtactacctggagtctggaatcaccgtactgtcatcgcagtcgtgcagtgcagagtgtagtcctgtaatgctaatactcatgctcagctcgtgcagatggggaacgtgactgcgtgagctattgtgatgttttaattgttgattcgttctgtattcaggtgagataattaacagtgaagtttcagaaactcatactcaccttttttttatttcatccgcttggctcacatttttttctttcctctgtcttccaagtggtcgacattacgacagttgttcgtgcgttattccctacctgaacatcttgtttagtatttatagtatgaaaatgcacgagttctttcttgtgttcactagttctcctgtttcttttgctagataggcatatacctgtattttgtatgttctccatgtggacttttggggatttgggagcagagcaccgaccggttttgttaagtactcccagtaacagactggcagttgtaaaatattgagcgtgtcatggcggccttgggggtggggggggatgtggatcctctgacataacgtcaggtgactttgtgtcacttacatgtgggtctatctcactataggcccacatgtcagtgacacaaaatcagggtaaggtatgttagagaatcttgttccgtcgggtgtcatatattgtgagagttgttgctagttggtacaatgcgattgttgtagagtgattgcagcacgaaaccacaaaaacagccactttgattgtcaagctgagtcaaattccatgatttgggaaatcgtgaaatgcgtcaatccaaacaaaagaaaagttgtgatggcaatattatgttgcagacggacagccaaaatgcgcaaactaagtgaattccactccgtgtgaccctttttgttatgggatcacgaagattgttgatgatgaaccaccacgtaataagtgcacgaagtgtttccagtgcaaagacgtctacggttttccagtgcacgaagtgtttgcccggttagaacgtccttaatctttctcaaaaaccgttgacgtgtatggatatatacgttcaggctaattcagctcatgaacaactaatgggccgtagctcggtgttaccctgaaaggaataagttcacttcatgaccctcaaaagtgatcgaaatctaaaccatgaccctaaactacaaaaccggatatctcgacccccaaactcctaaaaccggtgcaatttgactccctggacggttttgggaggcggttttgctgacgtggcgcctacgtggcaatattgaccgagttgttgttacacgtggcgttgacgtggcacctacgtggcggtagaaataaaaaatatgcgtgggacccgtttgtcattcacacacataaaaaatgtggggcccactgacatgtgggccccacatgtcatcctccttccttcttcctcctccctctctcccttctctctctctcccttgttcaccctcggccggcggcggggcatgggctgcggtgtggtggcggccggtgggagctgaagcgccggcggcagcaggagctagctggagcgggttctggagcgccgccggcgtggtggacggaggtggcgcaaggagctcgtcccctgggtcaacggcaacggacctcggcgcgacgaagaggcggtcgccccccttcgacggtggcggcggtcccccgagtggaggagtcgacgatggcgaggctagcgcttggcgagatggggtcggcgtcgtggaggaagtcgaccggcgggggttgcccttggcatcgtcgatggccgaagacggaggcgaaggtcgaaggcggcggtccacgcggtcgaagccggcggcgcagccgtgccggggtggaagagggaggcagccacttggggccgttgcgagacgagcaggacggcgg

SEQ ID NO: 64572 - DNA, 3641 bp, Oryza sativa
aggaagaaggatgacatgtgggatccacatgtcagtgggccccacaatttttttatgtgtgaatgacaaacgggtcccacgcatatttttttatttctactgccacgtaggtgccacgtcaacgccacatgtagcaaagactcggtcaatattgccacgtagacgccacgtggcgccacgtcagcaaaaccgcctcccaaaaccgcccagggagtcaaattgcaccgtttttggagtttgggggtcgagatatccggttttgtagtttagggtcatggtttagatttcgatcacatttgagggtcaccctaaaattaactattcgacccagcacaacccagtgtggcccaaaacaggcaagataggacccaattaagcccaatatggtcctgtgcgcctccctcgagcgtgtgactgtgtttgtgacgcggtggctggtgaaggccggggtgaaacactgatgattatacatacccgtctcgcgattagcttatgtggcaagggcataataaataaagataaataacaaaacataaaagttttggacatgttcatctaaacgtccacatcccttaataaaaactctgaaagctacccccacataacaccttgaactttcggtaggcccctaagagcctgacgaccttttcagtttctgatgaaaaaaacgggcacagcgaacctgaagcatcacgaccccgaacaggagcacacatgggagaaaaacaacaggagctactcctacatgggatcgtgccagcggtacgcggagtacgcggtacacggccatcgcttttaaaatcttgtgcaaagcggcaagtgggcgacgaaaaaacaaagccgaaaaggggaagaaagggggggcttcagcgagagctcatcttcttccttccttacctacgtgcgattcctcttctcttccgcgccatttcttgatccccgtcatggcaggtgatattgtgacggccattgttttcgcgctggccgccgcggtgctgggcggcccggaggcgctccgcctgttgcaggacgtcgccgggaagaaccccgccgccgacgtcgccatcatcgtcggcgccatctgcgccgtcacctccgccgtgctcggcgccatgctcctggtgcgcttcatccgcgtcgcgggcgacgctcctgaccgggccacggagcgcttcgcgcgggtgaccctgacggtggccttcgctgccatcttcctcgtcgccggctgcctcctcgccgcccccgccgccgacaagttcgccagctccgcctgacgcgcggggggcgcgcgctcggccgcccggcggattcgggcgcggctgcaactacgagaagtcgagaagctgcccgcgccgccgacctgtggtgcgccgtgcgcggcgagccccggtgctggtagcctggtacagtggtactactcgacgttttactacggctccatcatctgtgtgtgtgtgtgtttttttttttgctgtttttctgtggtagtcttgtgatgttaatttgcgaatgtgagtgatattctgagatcacttgatatgattcttgaataagctcaatcaattggaacagagttataggattttgtgatctttcttgccggtccgatttggggacttgggtgaacatatcggagacagtgaaactggagatattcatattcatcacggaatgtccctggatgatttcatctcctgatgcgtctgttttagttctttccctaatgccatatgcacatatctttatgttactatctctgttgggtttggagtttcggattctctctttttggtccatatgtttcgcgcatttagttatgccgatttgattgtgacgtatcaccagttaaccagcttgagggagaggatcagaggaacaaaggttatactagaacaaaagggttgttggacaaaccgtctcatgcacgtgccgtcaaacacttatatcgatcgtatggtactctaaaaattttgtaccccgacacgtacgttctggacaggtcagtatccggttctagcctagtgagcttctcggcctcgatctctgactctctcgttgcggtggctgattgtgcagatgagatcaggatggaagtgtttgagcagcgaggtgtcgataagcttggcactggcacgtctcaaaggcacgatttcagcaacgatttgttccatgttgcagaggaggacggctaccactggtagcatgggtccatccatctcaccaactgcgtcagagaacggtggtagtggggggcgtacgcggtacgcccagagaaacaattggacagacggtcgctatctcgctcatagtaaaagcgaactgaaaatgcattttcaatagtttcaggtcgccatgtgcatgtttgcataaataaaagggccttccttcaaagaaaaaagggacaccaaaagcggagtttggtaaaactaactggaattagatgtaatacattctattgcaatgaatttggaaatagatatgcttaaatttatagtactaagttgtttttttgaaggatgaaggaagtattgttctctcctggactgaacattttgccgcataattttcccgtcgtgatttatctccagaggtggattattgccacgccatacagtaggggaatttaagacacgccacgtcggtatctgtacattgtaccaagacggcagttctgcttgtacccaacaggagaagcagctggtctagccaatcagcacatcagtctactttaaaaagggacaattagtcgtcccaggacggtcagatcggcggcgaggcgtgacgaggcgattcatcactcgtgtaaccattgaaaggagctcgtgtcgctgtgccgtttcggcatatgccacgagcgtttatgcccccgttgagacttgaacagcgcattcacatcatgttgctgcctgctgccttcaagctaaaggcagaggatatcttcacaaatggacggcctgtttagatcgcgaaaagaaaatttttagggatcacatcggatgtttgaccggatgttggaaaggcttttcggacacgaatgaaaaaactaatttcataactcgccgggaaatcgcaggacgaatcttttgagcctaattaatccgtcattagcatatgtgggttactgtagcacttatatgggttgaaatctcgacctgctttcgatcctgtaggggaattgtcacccctactaaaccccagagcctctgctgatcgtcacccctcttagcctagaacaccaagacgagtcgctgttgaatcaatccaacacacttcctctctatcactgacatgcgggccacaacccctccatcataaaagagcaagaccaaacagataatggggcaattccataaaaaataaagatgagtctaacccatttcatcttttctccaaactaaacatacagtaaactaataggtgtatttagttcacgccaaaattgaaagtttggttaaaattgaaacgaagtgacggaaaagttgaaagtttatgtgtgtaggaaagtttcgatgtgatagaaaagttagaagttcgaagaaaaatttggaactaaactcggcctaatattatgggatatggatacgccgatacggagatccaacacatacaggtagagaaaatcagccgtcaagatcgaagta

SEQ ID NO: 64573 - DNA, 48955 bp, Oryza sativa
  unsure (1)..(48955): unsure at all n locations
gttcttctacttctaccttttctactagacagtgaacagggtgagcgaggcagagagaggagagaattttctctgttttctctttggtatttcttgcgattttttttttgttttggctcaacccgttcccttgatcccttccgtgcgtgccgtttttgattcccatggcttctgatcttgtgatggcaattgttctctctcttggctgcgccgtggcgggcggccccgaggcgctccgcatactgctcggcctctccggccggagtcccgtcgccgacatcgccatttgcgtcttcctcatctgcgccgccaccgcgccagtcctcggcaccgtgcttctcgcgcgctacttccgcgccgcgggcaaagcggacggcgttggaggcgcccccgcgcccgccgtggatcccttcgcgcgggtgactgtcgcggtggcgctcgccgtcgtcttcatcgtcgccgcctgcctcctcgtcgtcccctccgccggccgcgaccccggctgcgctgcctgacgcgccgcgccgcgcgccgtcgacgtggacacgacgacacgtggtgcggtggtgggtagtgccggtgcgcgtaccgcggcttctatcccgttcgtacgcggtgtaggtcacatgttatgtttgtgcctttgtggtgtctggattgcgcggtctttttagcggttaatcaagctctccttgtacgcagctcatgcagaggaagcagctgctggttttttattttgtcattccacctatacaatcttaccattcgtcgataggttgtagacttgtagtgttcgtgtcaatctgcagccgagagaaatactatgaatgtatttttttttctctcgagataaaagactaccttttcaccaggcaaacagatcaccgggcaaaactctgtaaatgtttcgtggtgctcttgtactaccggatgataataacggtccttaccaatacgaacggtgcagtccgaaatatgtacaaatccagagtgttgcccggtgaaacgcagggttaagcaaatgaaagcctgtactaatccaaacaaaataagatagtttgccatcgtccacaatccggattcggatcaggtgcagtcacgactgtgactataactttggcagtacccaatcatccagccatccagcacacgagggatggcccagatttaaccgtgtcatgcatcattttagctatttgaacaagcatagaacagcttcagttcagattttgcctgcaatttctctccttttgatctgaactagctgggtggcccgcgcaattgcgcggctagcaccgatacaaaattatatatttttaatatgattttatttataatttattcaatagatatttcattgttttaagactttgaaagaccaaaccatatcatccccatatttctaattttgtaacttttataaaaatcacatcagttgctaccccttgcttttttttgtcacccttttctttatttgctttctcgatctaccatggcttatattaattctccttttaacctttaaaaattggatcttatagttttttttgagtttattgtctcattgggttttatttttttatttttagaagtcccattaaaagctgtcaatatacttctctacggcccatccgctgcttcctctctttattgtcattgggattttaaaaattgaacataattatcatttgagttcaatttttactttatagagtcccaccaaaccgtctgaactcctctacggctcgccccgcttcttcccactctttattatatttgagattttaaaatcgaatgtgattatcattgaggtttattttttacttttttagaaatcccgccaaccgtcgtgaccgtgctgcttaacggcatgtccgtcgtcactccttttaattgtcattgggattctatttggggttttgttaatagtttttagatgttccatcaactgtcaccagggttcaccataccgccggtaaccgcgcggttaccgggcttaccgcgggggtacgataatataaataccgcagtaacctccttaaactcaaataaatttaaaaaataatttgaatttttgatgaattttgcatggttttgtacggttttcacggttaccgcagttaccgcgcggtaaccgtgcttaccgccggggcgcggtaaccccggccccggcggtttggtaaaccctggctgtcaccaccctactcctttacagccccgttacttcttcgatatttattgtcatttatcatcgttgtgttctagatgatttttttttgaaattttcatatttttcattccgatagattttatttataaactatattcctagttgttttattctattttcagaatttattttattacttatttggaattttaattaatctcgttatgggttccagatggtgtattctttaaatagtctttattttttattacgaatttaagttatttttaaattgcattccaagttgaactcttcttttattttcttatttctaatttcggattttattttactttttattttgaattttaattaatctcgtattgggttctaatatatggacttgtatgaaatgagggcactatattatttttctgttgctgcagcctaagcgtgctggactggtatctccaccctatatatgtgcggcaatgtatgttggtttagaatcataactctatactatacagttctgcaattgatttttctaaacggacaaggactcctagtgcggattgtatgatctataattagattgatatgattatattttatacggtaaatctagaccattattcttttagtaatttcaaatttgtattcctactcgaactctttttttttctttttttctaatttcagcaatttatttatttattattctgaattttaattaatcacgtattgggttcttatatggtctcctctttcaatattgtttatttttaattccgaatttcagttatttttcagattgtatttctacttggactcttttttttctttttctccgattaatgtgggaatttctagcctccacagcgaacgtggtgccttcttttcaagctgtcttaataatataatagattttcttgaactttaagaaaacccaaatattgttaaagaaaagtagacacatacttcatttcattatattgaacttcataatatcttgcacgcataattgacaaaatgagctgagtttaagcccttgtttagttcccaaaatattttttccaaaaatgtcacatcgaatctttggaaacatatatgacgcattaaatatagataaataaaaaaagtagttgcacaatttgcatagaaattgcgagacgaatcttttgagcctaattagtactccctccggtttcattttaatgacacggtatacaaaaatatatcttttgaccttatttttctattataatatataaaataaataaatatatatttacttttattatggtgctttgaaagacaaatctatatatgttgtcctttaaactaaatatttttaaaattattgatggtcaaatttataaaagtttggcctcaaccttatctaaaacgtcaaataatatggaaccggatggagtacatgatagctataagtgctacagtaacccatatatgctaatcacggattaattaggcttaataaatccgtctcgcggtttccaggtgagttatgaaattagttttttcattcgtgtccgaaaacccttccgacatctggtcaaacgtccgatatgacactcaaaaattttcttttcgtgaactaaacataccctaactattttcgctaaaattaggtgtcatgcatccactgacacaaaagctttcaaaatcaactagctatgctactgctagattaacccagttacaaaagttttcatgatccaaaagtagatcatcatctgcttccaaaatcagcacgatgccttctaagttctattgacctcttcaaatgaaattttaagataagatgacatcttcaacattaatagaaccctagggaaaaaaagataatatccaaattaattgcgtgtgatgtgcagcggtaggaggtaaagtatgcttcccatggtaaaattggcgccaattcttacttccctctcagacttttccctccaaaacacatttgctcgagtcagagagtaggtgaaaagctgggggaaattaagcaacgaatctagaccatcccttatgtgctggatggttggatgatggatactgctaaagttgcagtagtgactgcacctgatccgaatcctcacaatccttagggatagggtgatgaaaacattcggctagtcgcctcgctctgtcagccacgtgaccacgtcggacgagcactgactaatcgcagacgaagaacacaacgacgatggtcgtgcccgtgtggtggatatgctgcgcgtgcgacgtgcgatgatctgtgaactgtgatagcggaaagagacagtgcttcgaccgtcatttcacaccggagtttacttatgctctctcaacaatttgacatacttttttccccttagaatcgtgggagttagttataacgttggagaataaacggataaacttcatttgttcgtaaagacattctttttttttaaaaaaaatgtatgttctaggagtatatacttgtgatcatggcatcctccgactataccaacggctgcactcagcaacaatacaaatggatgcctgcatgtactatcggtgctaccaaaaatttagtagcactagcatatctgggtaataaaccaaactatttgagaaaccctgaaactgattgttcatcctgttactatcggtgctaccaaaaactgattgttcggcatttcttttcctataattccagtgatgaacgaaccctcctcaatcctcataattctccgcgtatatggtaccaactttaccattgccatcctgaccgaccggtcgtcgatcagttcacaatcacacgtgctggacgcatcctccaaaattccacccaacccgacctaaaatttcgtggccgcgatccccaccgaagaacaaaagggaccgcgccgccctggcccaccccacgggcgccgccctgcctattgaccttgacctgatcatcaagaatatactaatgcagatgcaccagtaatcgcctgaaaactggccagttggatttatctcccgatgagtttctcgattccagttgggagaagtcgggtgaacggattgtcagagacgtacgagtcgattcacgccaccagaacgggcgacaccattcgcgagccactcgaaataccaaatactcgatgggtcgaaaaatgctgtgaaaagtgcgtagttcgtgcgtgcaagcaaaagtactacacctggcgctaagtacattcttcctgcaagctgagagatcgacaacgtacgtagatttactctgggactgtacgtactactaccgtagtccaagcccaaatttgacggaaataacgactagtccaaccaagttctgtattttccgacgtgctcctaccaagtttcaacgggaaaaaggagaggctgtcgatcgatcgatccacaccatgacaccaatgtcaccatcgtcctacctcgactgaactcaactttgctcggaccgactgaaagccagcttcggtgcggggtactgacgatccgcggctcgcgacgcccaaacggcaggatacgatcacccactggcacgaccagccaaccagggaattcaaagagtgcgggacatccatcacaaaaggacggtttgcagcagctcgcgagaaagtccagggcagggcgcgatcgatcgtgccgaagagtcgttgcgtttaggtcgcgcgtggagacgatcgtatatacaagtggcgttagtgcgtcttcgctttacatgtcagtcttgtggcgcctggctggggacctgggactgatgcaatggcaatccatctgaaatctgcaacgcaacctatctcgcttcaacacgtgccgtgtgccaaagtgccattcttgccctccatctctgtcttccgttctgcaatatggcaccgagctatgcgatcagccaatcatttcgatcgttccaagtccagctacaggaatccaattgaagtagtaaacatacttttaagtttctctttgtacataatcacataaaaattggttgtgatctctaaaaacaggggaaatgctggaaagagaaaggtgttgagtgaaccacactaccctacacgtttatacaggggcggagacaaacctagggtagcttggacttgagccctagacatgcctccataaatatgcctcaatccttttaaatcaccatatatttttctttagaaaactaatatcttattagttgagctctactcgagttttaggcttagaaaatttctagctctgtcactgtgtttatagattagacaagaggcaacaggaagagcgaaggagattgaacaggcaaacctcagtaacagtaagcacggcgaatgaccacatatatatttgctattggaccgggttcccaaattgaccatgcccgcacgtaacctcatggaccggaaacgtcccacttgttcactttgccccgtcaggcatcagcaatgtgcccacgtcggacgtgcaccgaccaacccttgtcgatcactgcttgctttgttgcaagttgtgtgcaaagcgagatcgcaatcgaattggcgaaggggataccgatggagaatagcatgaccatgttgtgtgtaaagtgaaacattatattgcttccgtttcaaagtgaaacatgctgtaccaaaccctgtgattagtggcttatatagcggtgctctcttcgcgtacgggaactggtggtacatcaaagtccgaaagcgcacaacatttggatacgtgaaattttggatgattgatcagaaattcggaattccaaagggtcggtttcacgcaagatatcgccggcggcgggacctagttgtacagcatgtcagcagcgacgtcaagttagtggatcacctcggtacctcatagaatggagtactttttttagtaaaacaaatccaattctaagaataaattaaaattattattttttaaccgagtgagtactctcttcgtctaaaaaacataggtatgggacataacttagatcaatgaatctgaatattccattttcacatactcctcccgcgcccggagccgccgcctgccgcagctgatgctcctcccgatcccggagccgctgctcgccccccccatgaccccatgtcccaagcccctctgcacctcccgacccagaggcgccactcgcccgctgccgtcgcgctcgcccgccgcttgccgctgccgacactccgcagcctcgctcgcccgccgatgcggccgctccgcctgcctccggccgcgcaccgctgccaccccatctgcagcaaagataaaaccgaaagagtagaagagaaaaagaaaaagaggaaactgttgactaggattgttaaccccatatttttcctcacttacatgtgggtcccacatttattatttttattttttgctgactaggatgccacatcagcaaaaccgggtaaaaattaagtcaatactgtcatgggagctcctttgagtgagtttaggggtacacattttctgattttatggttaagggtcctaaaaaaacctcgctattaaactgagggatctctagtgaacttattcctacggtggcacttgtacataggtatctttggtgtaatcaggaagagtggtgcttttttggttcgtgttcgtttcgtattggggggggggaggtgtttagatccaggggtgtaaagttttggcgtgtcacattggatattatatagggtgttgtatagggtgtttgggcactaataaaaaaactaattacagaatccgtcagtaaactatgagataaatttattaagcctaattaatccgttattagcaaatgtttactgtagtatcacattgtcaaatcatggagcaattaggtttaaaagattcgtcttgcaaattagtcgcaatctgtacaattagttatttttttgtctatatataatacttcatgcagatatttaaatttttgatgtgacatggtataaaatttttgacaggatctaaacagggcctcaataacggagggaaatacactaccactcgtgaattgcttgtgcattctccagccacgttttggaagggaaccatttttttttagggaaaggaaccttttggaaagggcagcacagatgaatggaaatcttcgtactttactatcattgggtacatgtacatctactattagtgactggagtatctatcacatgcagttccaccacaccgagggacactttctttggtttgacacaaatatgacaaagggaaagaaacggaactacgatgatgattcgtactcgcctcgcactcagctcaagtggcattgtgggcaagggcataaagagaaataaaaaagaggagatgttgaagaaaagcttccacatcccttaagttagaactctgaataataagatcggataacataacacagggataggccctgagagcctgaccttttcaacgatcttattcgagagcgatcttctcggctctgatggaagcacggtgatagcgaccatacgagtatacgactcatcacgacgcgaactgaagctatgtgggaaataatgctaaggaatagcacgtcgtttgattcggctgttcagttgcaggtggtacgccgtgtacgcgggcgtcgctctcagtgtggcaagcggcaagcggcaacgaaacatgtacgacgcgtcgtcccatctcgccgtgtaacgttagtctgtcatcaccatgaacagtgtagtaccagagcagtgaccagtgtctgtatggacttacctttctactgttctgaacattgctgatttgctgtgcactaccgtcgacgttactacagtaacgaactaaccaaccgaagtgctctgcggatcttttcgattggcatttgaccctccacgttccattccattaggaaatggcgaactttccgtcctcgtccacgatgacgtcagcagacagcgtcacagcgcctcggacgccgcaggttctgaccaaactagcatctgtccccgtcccaatatttcttgtccgaatttcccctatcagtgatcgatccaatccgctgcttatatgaccatccacttccttcccctctgttctacacatagcgaagaggagagaaggcgagctagagagagagcaccgggagaagaaagggatttcttgttcttgctgccagcgagagctcgtctttttggtgttcttgagagatttgttcttgttgatcgccatggcaggtgatcttgcgatggccactgttctctccctgggctgcgccatggtgggcgccccggaggcgctccgcctcttgctggacctcgccgggcagagcagccccatcgccggcgtcgtcgtcatcgtcggcgtcatctgcgccgtcacggccgccaccgtgctcggggctatgctcctggtccgcttcatccgcgtcgcgggcaatgcccctgacccaaccacggagcgcttcgcgcgggtgactctgacggtggccgtcgccgtcgcgctcctcgtcgctgcctgcctcctcgccgtccccaccgttccctccgccacgttcgcccgcgcttgatacgaggctgttcttcacttccctgtgggtgtttgtcagtgtgtgtgtgattgctcagctctcgtctctcgacaagtttacagcttttactccatcacctgtgtggttttctactgtttatctcgcagctatgtgatgttaattggcgaaagcgattgatcttctgagatcagagctgaattttgaatgtgtcgaaccaattcgaacagagcttgtgatacaccatagtacatcctaggatgatttccttttcttgacgaatccgaaaaaaggcgccccgtattcgtgtttggtttgttcaatgttatctctgttggatctctctttggttccgtacgcttcagcatttggatatactttgatagtgacgtatcaacaggtaaccaccgtgcgtccatgccgatcgagggagaggaacaaatgtaaacaaaaaaaagaagagttgttgggcaagccatctctgtgtctcgtgtcttctcacgcttatgcaaaagctctaacgcctgtgtttctggctttctgcgagatgatatacagacacatatgttttggacaggttctagcctagagagcttccccctctttcccgttccaggagcacgatggaggcgtttgcactgcgaggtctcgacacgttgggttgtgccacgtcccaaaggcacaaacaattttaccaacgttttattgcagaggactaacggcagattgctatggatagatcatcaagggcgagcaacaaacagttggccatgagaagtttcagttgataattgataaaaaaaattgacaattactaaactaccctgtatgttattttctatctctaaagtaccctttaacaaatcaacggttgatgtgtaataacaggatgcctcccgagcactgtaaaaggtaaaagctctcatcacgggtcaatgacgacagctgcgaaagaaaaagggcagaagtcgtggccatacaccgagagagaaaatgtgattggacggtcggtcgctgtcgccgtgtcaccgtctcaacatgaaatcgaacaaaaaaagagtgcaatgtgcaatgtttgtgtgtgcaaaaaaaaggggagcacaagttgatgcattcgtgaatcgtgacagttgaggcagcaagccagcaacgcggacatgtttgtgtgtacacgaggaagtctcacgtactgtccgagagtgcacaaggctaccccagcgtcatcccttacatcacacaatttacggagaagaatttcaaaagtcgggtcgagagaaatcgccgacggtacacgtcaaggtctcctcgacttggtggctttccatgtcaatggacaaccgcactccctgacggccacctgctaggaccacgatcaggagctgggttaatttgcagcaaaaaatgcagatgtggtgtgttcaattgccgttgttgctcgcgctcagatacctgcaaactggcaaaatggccggcatggatactctattactcctgtccggatgtagggtctgcctgcccatcagatcccggttttatcaggttggaggggaacgtcgcatttgctcgtcgtcaccacacccatcgtgcgcgtgcacatgtgggatgtgcaggtcagaggcatcagtttcctagtcgacggctcacggctccaaaagcaattggctgccttcaaaaatatagattcccacctgatcatggaagatcttccttttccctacgggctccatcgctatgcttcggcttatccaccgaacttgtccttttgatttcagatttttcagcggaagcatttctaccgctgggcaggttatgattaaacgatcttctatgaattggtagttcgtagccctcctcgtgtatttctttttgtgtgtgtgtgtgtgttcgtactgggggtcacaggatcagcctctaccaacatattggcagctattacctggcccacgtaattcggctgaaaatctcacagcctagtcaacaaatcgatggggttcagctgagaagccacaaccttgtcgttatttttctccgtgtcttatcctcaagtagttaacctcttggcactgggcatattgatttggttgttgttattaggggagacaaagtaggggaggagttagctggtgttccccagcatgctacctttctttactttctgtcgtttttttgtttcttagtctgtaatgaactcgtattctttttagtaaaagcttggcgtaatgcctttcgtccaaagtaagggaggagtaagaaaacaaacgacagaatacgcattatacgacggattcagcttgttgctacgatcaactttactctcaccattatcttatagctgaacatatctccatgccaaaattttgccaacaaagtattcgaaagcatagggattaagccaagatgatggcaaaaccacatggatagggagatctaacacagtgacacggacaggcacatcaaatcagtcaaagatcggattagtccttaatggcctccacactccaatccacctttttctttcgctgccgagatgacccgtcgcgccgtgccgacttggctggaacgaggcgtcaccacctaaccatgcccaaaccaggtgccgaatcgcctatattacccggagcaaatgctacacctagcaacacacaccagtgcacaacctcttcctcctctgttcttctctacttcttgcctgatctactggtaacagtgaacagggtgagcaaggcagagagagagagagaggagaggcttttcagaggactctgctttctcttttggtattcttgcgaatttttgttttgatcttttccgtgcgtgctcttcttgatcgccatggcttctgatgttgcgatggcgattgttctctccctcggctgcgccgtggtgggcggccccgaggtgctccgcgtcctgctcggcctctccggccggagcctcgtcgacgacgtcgccatttgcgtcttcgtcttgggcgccgtcaccgcgccagtcctcgggaacatgcttctcgcgcgctacgtccgcgtcgttcgaggcgccgccgccgcggcggctgcgcctcatgctcccgccgtggatcccttcgcgcgggtgactgttgcggtggcgctcgccgtcgccctcgtcgtcgccgcctgcctcatcctcgtcgtcccctcctccgcccactccgccagccgcgaccccggctccggcgctgcctgacgcgccacgcgaccctgttcgtcctgcggaacatgtccctgtggagtggtgaacttggtgtctggtgaacatgtccctgtggtgaactttagcggttaatcaagctctccttgcacacgcacctcatgcagaggaagtagctgtagatgttgggttttttttttcactcaatgttgtaatgttcgtgtcaatctgcagccgagagatatactactaccatgtagtacaactttttctctcaagataaaacattatactaccttttttcgccaggcaaacaaatcaccgggcaaaactctctataataatggtatttaccaatacgaacggctgcactccgaaacatatgcacatagagtgtgttgcccggtgaaacgctggaataagcaaatgaaagcttgtactaatccaaacaaaaaaaatgtttgccatcgtcgacaagccacagggatagggtgatgaaaacattcggctagtcgcctcgctctgtcagccacgtgaccacgtcggacgagcactgactaatcgcagacgaagaacacaacgacgatggtcgtgcccgtgtggcggatttgcagcgcgtgtgcgtcgcgaactgtggtaactgaaagggacagtgtttcgaccgtcgtttcacaccgccttcatgtcatcctccgattgtacgaacggctgcactccactccagtgcttcagcaacaacacaaatggttggctggtactgtcggtgctaccaaaattttaatactagcatatctgggcaacaaaccaaactatctatctattatatactaaaagtctattaaacttcctataaacgctcctaagccgacatgtgacggtctaataaattagggaaatccaagaaattctgagaaaaaaacaaaacaccaaaccgttaattttcacataacatagtggacccattatttttcaccattagatctatttaaaaagaattcctaaagcccaatccattaattatcacctcccaccatacccaccacctcctgggttgtccccttatgtgtacgtacgtgacctcctctcccctcatatacgtagatacgtctctccctctcctatccttcctttcatcttccaattttctgcctaacaaaatttaatatgtaaacaaaatcaaacgttagataactaatgattgtaatttttataatatattttatttatctatattgggcatgtttggatatataagaatatataatttgaaaaaaaaactcctatcttttacatggcaaataatgagcaattaaatattattaaaatataataacatatatgtgatctcttatctctctgcttgctcactttctcctcgctattttgtaggagtagcaagcaaatcattatatacacaataaaaagtaaatttcacaaagctacatatttaaggtgaagtttcaaaatctaaagatttaatcgatcaaatagacaaatacccattgtgtaataaagatccattaaacatcatgtagatcaatctataataagctccattaaacatcctctacagtgctactaacctaccacatggcacatctgataaattaaaaataaatctattatatagtaaaagcccattaaacttcctacaaatacttctaagtcgacacatgcatgacactttatataccggtatcgcgttgggatagtatcccaacgggatcgctccctgtccacttccctcagacgcgagagtgtaggccaccgtgggagcagcacagatgcggctaacgccggtggcgcggccgcggccggcgccgacgacctccggcgtggaggacgcggccgccggcgacgagctccggcatggaggacgcggccgccggcgagctccggcgtggggcatggtcgcatggacggcggaggatctgcgtggtgacagagacgacgccggcgacgagctccggcgtggggcgtggacggcggaggatcctgcgtggtgatggcggcggcgccggagacgagctccagcgtggaggacgcagctgccagctgaggcgtggacgacggacgtgactgccggtgacgagctcccgacggaggacgcggtcgtcggcgatgagttccgatgtggaccatggacgggggaggatgcggctgccggcgacgaggttcgggttcagtgtggagcgtggacgggggaggacgcggccgccggcgacgatgcctcgacacctcgacgcctagctcctggtatctagtaggtatcatatgaatatgatacctcacaagtatcaccccgatacgtcgtagaaatcgcacgatacctgataggtatcacatgatacctcacgagtatcacctgatacgtgataggaatcgtctgatacctgatacatggtagaatcgcatgatacctgataggtatcacccgatactagctacttatcaggtgatacctgtaaggtatcatacgattcttaccacatagaagatgatagttgcgtagttgcgaggtatcaagtgatactcgagtaggatcataaatctgggaggtagcatgatcctccttagtatcatgtccagtttcaccaggtttcataggtgatactttgggaggatcatgtgatacctgagaggtatcatgatccttatctgtatcttgtctggtatcatcaggtttcacaaatgatatcttagaaggatcacatgatactcatcaaagtatcattatgtgtggtacctatgcagtaccacatgaccctacttaggtatcatgtctagtaacaagatcctatgggttttaaagatgatactttagtaggatcgtgtgatacttgcgtttctaccacatatcagatgatacttgcgaggtatcaaatgatacctatcaggtatcatgcgattcttaccacgtggtgggtgatgcttgtgatgtttcaggtcctgatatctaaccggtatcaggtgatacctaccaggtatcatgtgattctactatatatcaggtgatacttgagaggaatcagataatacctatcaagtatcatgcgattcttacaacatagaagatgatacttatcaggtatcatgcgattcttaccacgtagaatatgatacctatcatgtatcatacgactcttaccacgtagaagatgattctaccacactccacagccagccatgaccaagttaacaagttctttgcacaccatcttgtctctttgctcccccaaagtagcagatggataggatgaaggcccggactcgcagcgggatcgacggccggcgacgaaggagccgaccggagagggcccgcgacggagttggggcgccggtggagggcgcaccggccggccacgcagatggagccgagggtgggcgttaacggcggcgccgtggatggcaggcagcggtgctggagctctcggcggcaatccggcgaccacatcatcgacagccacgtcaccggtgacggagttggggcgctggcggagggcgcaccagccggccacgcggatggagcaccaggcggcaaatccggcgaccacgtcaccggcggccgcgtctccggtggccgcgtccttctctccccaagcgggacttcttccctgcgccggagtcaccgacggccacctcctcctcacagcttaggcgctcagcgtcgttcctatttggatgggaaaggtggacgaagggtatcccgtcgatacccttcccgacagtataccggtatatagcatttccgttttacaaatgctactaggccaccacgtggcattatgagaaaaaaatggaccatctattttcattgaaataggtagacacaatattttaaccattaaattattaatttaaatatcagttcttatctcaagaaaacaaatcatgtacgtagccatgccctccttccaatatattccaacgtatatacgattcggaaggaaaataaaaggtacccacttatgtaccaactacctcccccttctcagctaaaaaaaaaaagaaaaaccagaaaaactccctccccatggtgcatatacgtgcttgagccgtgagcagatggtgcatggtcgttggaattaatcttggctggtcggccggtctggttgttttataattaatcttggctgtgattgtttctttcaatcatacggtcatacagatgtaaattttttgtatttatcttttttatcatacttatgtatatctttatttttatggataaattgtacatatgtattttctctcgtacataaacaggagattaggagtgacccctctgaccccgtctctcccctaagctaacatctatatatatatgaaaaataataacaagatagtttataatgaacccggggttgcctcaccctcattggccactttatggaaatagattttgtaatggttttgctcctagagatctatttaatagagttttaaccggccacaagctaatattgaatcagtttaactataaaattttttttttgaagtcctacttatatttttctctttttttttcatttctatgtttctctttatatatacaagtaaagtataaagttatgttttggtttgatacatatcaagagacgaaggtcaataacaaatccataaagtcatttcattcatgtctttgtggtagcttcatgggtttctccacatcttgtatatacaagcagctcaaaatatgtggtattccatatcatgataaaagttatttcttcctattaaatttatattttaagactcatattgcctatatttttctttaaaaaaataccataagggtcccacatatttcagaaaaaccatgtccactatttgcatatttcttcaatacatgcatacaacaaatttattaattcatatgcaagcatatagcaaattgcgtgcatgtgaaccaattaaattaagcacttgatggtaaaaataaaacattcatcggcgatataaatttcttgaagtttcttaagaaaaaaaagatataatgcacaatgaattaaaaaatagtatatcttactttcacaatttgttatatctgtttaaaaaaaactaatacacatgcccgcgcgaatgcgcgggctacctttcctagtttcagaaacgatcgtgcggtatttcttttcctaattctcgtgattaaccactttgatctacaatcatgtcctcctcaatcctcataactgtccgcgtatatagaaactttaaaagttagtccgagcggtcgtcgctcagttcacaatcacacatggtctggagtctggacccatcctaaaaaattccacccaacccgacggaagataaagataatcggactttcacgctcgcgacccccaccaaagaataggcagcgaagaacgaaaaggaccgcgccgcgccgccctgactattgacctggtccgccgcaagaatataacgcagatggtgcaccaataataatcacaaaaccggtcagttggatttatctgccgatgtgtttctcggtatgagttggaagaagtcgggtggaacggattttcagagacgagtcgacgcacgccaccagaacgggcggcaccatttagcgagccactcgaaatatcgaatactcgatcggtcgaaaatgccgtcagacttgcatatttcgtgtgtgcaaacaaacgtaccactcctggcgctaagtacattcttcctgcaagttcagctttgccggagagtagagtactctggtagtacccgtagtccaagcgcagctttgccaagtttcaacgggaaaaggagaggctgtcgatcgtcctgccggatcgatccacaccacgtcaccatcctacctcgaccgaactcaacttggctcggatccactgaaagccacctgttgcgtacgggtaggtcgttgtgtttcgctttacatgtcagtcttgtggtgcctagctgggactgatgcaatgcaatccatctgaaatctgcaacgcagttcaactggtgcccgtgccaaagtgccattcttggcctccatcttttgtcttccgttctgcaatatggcaccgagctaagcgatcagccaatcatttcgatcgagatctaagtcgaactacaggaatccaagtacaagtagagtagtaaacagagttttaagtctctctttgtacacacgatcatatgaaaattgttcgattgtttgggttgataaatacagggaaagcgctggaaaaggagatatgctgactgaaccacactcacactctgcccctacatcgggtgaaaaaaaaatcaccttgatcgagtaaacacctataaaacgtgtcgctggttcggcgagaatcgcacattagagactagagaggcgacaggaagagcaaaggagatgggcaagcgagcctcatgaaccgaccaatcctttgccgaagcgctgaaaggcgacagcgagaccgttttgttgcgaggtttgtgtgcaaagcgagagatcacaggagaaagggacaccgatggaaaatactagtaggatgactagatgagtacagtacatgttgggtgcaaagtgaaacatgcatatcctctcatgtaccaaaccatatgattagtggctcctagtcgtgctctcttcacatacgtcaaagtccgaaagtgagcaaggctatatgtagcaggacgttgtcatatatagcgacgtacgtgcgcgtcaacaaggtggacgtgaacgagattggtcacgattaccagcatcgctcgctatcgacgcctcagaacgtaacgaacatggtcacatggacatgatcacaaggactattctgcagcagtgcacgcccgaattacggttgattttcttctttcatcttgtcagtagtgcatgccctgcccaaagactcgcaagtcgcaacttcgcatggaataggggcaaaggatcagcatttgttgtgcggttctgtcgagtggccatgtcgtgccagtcgccacttgtggagacggtcatacaagtgatagcaaaactttttcggtttactgctttacttctggagtgttgctatacgttcgactccctcgtccgattcccatccaatccaactttatctgccaatcgttacgcttcacgcagaccaacttctctccatgtggctagggcaattagcagctaagtgctggtcagacgtgagttgtacgtagcgattttcttacttttgtccgttctgtggcgcctagcttggactgaaacatgcagcacaatcaatcgctcttcaattcgtgccatccatccttggacttcgttgtcatccgctccgtgatcggcaacgagttacgcgattatttcggttgatccttcgaacctatcgaactacatgaatccaggagaaacagagccttatgtatctctctcactctgtgtacatcgagaacccaaatcagcaatccatttctacatcttcaacttttggtaggggtctgccaaatatatacttgcaaacctacgaggctagcgtattatgtggatacttgcaatccatttttttttacttgcaatcgcgtagctccagctccagtaccgaatcttcacatcttctatactgggaccacagggtggaaaagatgtgctagtatgcatcagcacggccgctcggcaaatcagcaatgccccctgggcccctgctgctgccaagaatatgccgttaatcaacacctataaattaagccggtcgaggggttcagccacggcgagaagagcagagccgcgaaggagatcgatcggcagcttagcctgagtaagcacggaaggtgagagtgttctcagctgttgagccccatcccccatggccgcaattcttcggaataccatcgttgtcgccatgggcgccggggctctgggcggaccggacgcgctgaggctcttgctcgggttcgccgggcggagccccctcgtcgacatcctcgtcgtcgtcttcgtcatcgccgcggtcaccgcgcccgccctcggcaccattcttctcgcgcgtttcttccgcaagccgcgcgctggggccggcggaacgggtgcggcggtcgatgacccgttcgccaagatgacgctggcggtgtccctggccgtggccgtcctcgtctccgccaccctgatcctcctgccgctgttccagtccgggggcctcggcgcgctcgccttcgccggagccgcgctcgtcgtgggcgcctgcgccgcgcgcgcgcgcggcgtgcttcttgcgaatgcccacggcggcgcccccgccaccgagcgcttcgccaaggcgaccctgatggtgtccctcgccgccgtcttctccctcctcgtcctttgcatcgcggtcggcatcctcgacgcgcctgcgcagcgcctccttgccttcgccttcaagaacccacccgccaccgtggccgtctgcgtcgccacagccaccatcatcggcgccacagttgtcaccttgttcttccgcaaggcgaaaaatgcggatgccgccgccgccgccgccccaacggcgatggccatggcgctcttccacaaccacaagatgatcttggtgatggttacgcccttcgtcgtcatcttcttcctttgttcataggtggtgcggtgccggtgcagcgtgctgggcaccggtggttgaaaaaaaacgtaatccctcgtatgagtacggtggtgtatgtacatatgctatatgttatctttcgtgtaatcgggaagagaaatgtctttttggttcgtgtttgcctcgtcccatttgctatatttatgtgatttagaaatacgagttttcgttgccttattcgggttgaacttgaatatcatcatctcgttgaagtgagtaatcgacgtgaagtattaacagaactagtttagtgaattgctactgcagtctccagccgtgttttagaaaggcccgcacagataacggaaaatatttcgtagtactttgctatcatcgggtacatcaactagtggggtgggaccatgggagtactttgctatcatcttttttctgctttgctctttccctttccaacattcgcctgtgatggaaacgccacgagccttttgtcttggcactcgttattatccaatgttctttgatataaatacgagttaccacatttgagggatctgggagtgtggatcgcacagctttgattgtggtttgccgtccatcagcatttcagcaactgtcatctcctcgggctcgttatcgtacgaggcgcagcctagcgaaagttgtggtgattgttaggaagtggcagccaccagagtctcgcccggagcaacacggccggttcgattgccatatgatttttgcaacttgtttcctggatggaggatggtttctgccaaaagcgaagtgaagtgaaattttctcaacgaaagttttgtcctttcttatcacgatgcctggtgtgaacaaggctagccagcccatgtgcccatgccgttttctctgaacgccaattatcctttctaaaatactatacttaacttaggttgtgtttaattcatgttaaaattgaaagtttggttgaaattgtaacgatgtgacggaaaaattaaaagtttgtgtgtgtaggaaagttttgatgcgatgaaaaagttggaagtttgaagaaaaactttgaaactaaacacggccttaagaaaaaaaaagaatatgtagtgacataatgaacctgcagttagtttcttgggtttgttggaaccatgccaccttaattttgcaaaatttgagatatgccacccgtatctcaatgacatgtaggacccacatgagtcaatgatatgtgggttagggtgacatatcacaaattttgaaaatttgtgtggcatggtttaaattttccatagtttcttttggtgctttatgttggcctcggattgtactagagtttggagatcagagtctttgtcccactatagtttctttttttgagatcagaaggatcgccggccaattgtgacgcgctgcaaccatgcattactcgtattttctccttcatgtgtgcactgggaaacgtattttctccttcgtatttgagcgccacgtctcacacggaaagggattttttttctccttgcactgttgcacacacgccatcaaggcatacacaacacaaccgggcacggcgaaaagcccaacaggccgaaggtcgaagggcagaggccacgcgagcgaaaggaacccgtgtggcatatacggaaaatatgccgttcaaacagttgaatactcgtgccttgccgccgttcacaccagagtagtatctagctgccataagacggcaataatcctcctgatctctacatgaaaaaagtgtgtccgacggatgttgtggcaagcaaataaagttatgggcaattgcctatagccgtctggtccagtttgaacgtggcggaaatgtggcgaaattgtagagtaagcgcccctggcgagtgatgtggttcatttagctgcatgtggaagtacattatagtcgattgatagcgcaaagttgtgtgcgctactcagtggagagaaagggaacagaaaatgaccgtgtgacatcatttccttctagggaaactgtttgacttggctcttgtatattcatgtgaggaattcatgtgatcatgtcctcagttgttgtccacgagcagcatccgttgttcttcctcgaagcagatctaccatcccacactggttctcaaaaaaaaaaaaaaaaactcacccacactcgctatccaatccaatccaactgtccgcatccatatgatagcgaaacgctgccgaaagctaaaacccgcaacggcgaatcctcctcacggagaaaaggggtcaagacgtactgctcctatgagctttttcgccctcttcttccgcatgtcatctcctaagattatcctgttctatcttggagtaacggaacttcaaatggactctgttttttttattaaaaaaatacaaagaccaaagtatatgaagttggaacaggtccattcttaaatggtactcttttttatttagtatacttattttttgctatatcatggttaccgagtggtattattacgcatccaatatttctctgtgtaaatattaggatccagaatttgaaggttaaatgtgtaatagtgagcttggaagcaaaactattctagtccaatgtccaattgtggtaatctgagtcatcctataggttttctaatatacattttttttctgcgattgccatctactacttctggtaaacgtttcaggcgaaaggacatcacacatgaacgctaatatacgtagatgtttatttggaaaggttcaaaacgacaccataaatgaacagatggagtacatctgccgtcattgtgtagactgtagtactcccacgtcccataaaaaaccaacctaatagtgaatgtgatatatcttattactacgaatctagacatatctttatgcagattcattgtcctataatatatcatatctagtattagatttattgtttagacaaaggtagtacggccatgtttagttcccacacaaaaattttataccctgtcacaacgaacgtttgaacacgtgtatgaaatattaaatataagctaaaaaaactaattacatagattgcgactaatttgctagactaatcttttaagcttaattgcttcatgatttgacaatgtggtgctacagtaaacatttgctaatggtggattaactaggcttaataaatccgtctcgctgtttactggcggattctgtaattatgtttttattagtgcctgaacacctcatacaacacactatataatacccgatgttacacatcaaaacttaacacccctaatctaaataccaccctacgtctactaatgaaattgaatacggcattctttaggacacctatagtgttggtgggattagggccctgtttagtttcatgggctaattattagccacccaccttttagccctgaattagcccctaaggatccaaacatgtgggttaatttggggctaaagtgaattagcccccctcaaaacattagcctctccaaagagtgctaatgggactaattttctgtggggaccataaaaaaaacagtcctatcttcctccccccctctctctcctctctctccatcttttagccctaaactagctcatggatccaaagatattgtcccagactaatgtttagcctaccaattcaagactaaatattagctcttaaaattagcccgggactaatcttccaaacaagacctatttcgattgactcgagcgaacaaaatctcaaatcaatcgctacagtgtagaaattgatttgtgggaattcgcgtaaaaaaaatctcagggcttgtttggtttagggtcataccaaaacatcggtagtgccaaaacctaggtatgttttggcactattaataatttggtagggtagaatactaggtaatgtgtttggattaataccacttggaagccaaattttatattatggtaaagaaagttctagaattgtaccaaattaaccatgggcattactattcatttggcttcaaaccaaaccatcatatttactattcaaactaccaaaaaattggcatgtcatattttggcatcaatccaaagtggcccttagtctgggtggttctaacgggcgatcgatcgccaaggctatcggggagcgatcgattcccctccccctccctccctccacctggtttccttttttggcaccgtattactttcctattttagtaaatttatacacctcaaagtttatacaccttaagtttacacatctaaagtttagagaccaaaagtttataagtcaaaagtttatatatccgattcaaatttgaatttgaattcaaatatcttttttatatatagtgtcgacgtttgatgtctcaactatggtatttggacagtatggggatcgttggtgctaggatatacacgagactgaggtaaaagagatggagacgaggatttttatacaggttcgggtctctgagcagtcaggtaataaccctacatcctgttggccggagccgaagttgctttttttcaccataatcacaccagtacaatatgtggggtagcctatctaactgttgtcgacatgtcggtctgaagatctgactcgtagtcgacaacagggtagccttcctcctcgaatccgtgcccggcgagatcagagatagcgttttcgtctctcctgacggtatccggagacactgtaggggaatagccatacctatccctgaagtcgatatccggcgtcttgtcttggagtatgttggcttgtatgttgtggcttctatgttgattgtgttgggtgttgattgtctcgtcatggtgggtgttgatcgtgttgatcgtctcatcatggttgtccccctgtcctcctaggggggcttgtatttataccgataggtgtccccttgtccaagtagaactaggaaaaccaatatggatacaatccgagtagttcttgtcgtttctatgtagaactctggttgtctttccttatccggaactcctcctatatccgcagattgtttccgtataggacatggtatgtggtgggtcttgccgagatttagtcaactactattaggtatgtggtatacataaccctgacagtagcccccgacttcgatgcaaatgaacgaattcatattctcaaccgcgcagacattggagtaactattatcgaggtcatgtgaccgttctcggtgagtttagagagaacgttggacttcctttgtcagcctcgtgcgggcaccgaaagggtttgtctaagtcaatctctgatgtcgaccgagaaagtatagagcgtacgactaagtctcccgtcttgctgtaatcgagaatttggattgaagtcaagaaattttatctcggcgggtacacaatttcttcattccgtattccttttcgagatccagcaaccgttctcgagcgatcgagaaggcgtagagtctgcgacggagctttgtcgacatttgtcgtactcgccttagtcgatctttggtgtagaaccatagagacatggagtcttcgataatgtcgaatagaattttcctgaaatcaatactcagaaaagaatattagatagaaagagcccccgagcgaatgctcaaagggtgacatgttataatatgtatggtaaattgaaaatgaattaaatttaccaaccaatgttttgtttacgagcgtcttctctcttaccaactttgatcagtcagtttgtagagtcatacactctccctagcccccagccttgtcgtcggagaattcttctcggaggataaggctcttggacccttgacctgccttggttgaataagcactgatcctagcccccagccgtgaagttggaaagttaatttccgattacacggcttggttaatacgcacggcgagaactcttacacgaccagatcttacatggtctttcgtctctataggatccgacaaggccttatcggctctgggcgtccccagccgaagatcccttaggttcctcggaggccttgtcagaacagcgtaaagggacagtaggataggtttcaacgctaggtgtcatcgtggtaagggatctctgggtaaaacacttggcgatattgtgtacctgcttccaactttgttgaagtagaagtagtaggagaaatcgctacaccgctagtcgaggaccaggcagtagtcgtaactcgaccactagaagtggaaatagtgggagaaacgctacatcgctggtcgaggagaccactgaaagtgaagtagccggagtaatgctacatcgctggtcgagaaccaggcagtagttgtaactcgaccacttaaaatggaagtagtcggagagacgctacatcactggtcgaggaccaggcagtagtcgtaactcgaccacttaaggtggaagtagtcggagagacgctacatcgctggtcgaggaccaggcagtagtcgtaactcgaccactgaaggtggaagtagccggagaaacgctacattgctggtcgaggaccaggcgatagtcgtaccttgaccatctaaagtggtagagttggtttattgcaagtgtatctcatgtggccagcatgactcacgtacccaacttatagcatatccggatgtccgttcgcaatcatgtcgagtgatcaagccgacgacgttcgcgaggaattatccgttaacaaccttttctcgagtagtccagccatggcctgtgctatgagataggtcgtcggtctttgttggcaggttgggtgcgataactccgcatttgtcgagaatgttctcgataatggagtgtactcgaccattacctactcgagtgctcaattgttcctgaaaaatattttctagaaggcaaaatatatagcagataatatcgagtatgtactcaaaaaattgcatagatcttctagtattatcaggatacaacaagcagattaaatatcaggcattatgtaaaccgtaaacaagcatgatttatacaggagagaacggagtgagcccctagcgttagaccatagttggcctatcgtcgaaagtactcgcacaacggatattgtataagaagcatgctctaggtaaacataataaattgttgatctgacaatgctgtataaattggaaaaataggtacgataaattgcagataaaatattgcgtacctttgtagatacatgccggatgtatctacgaaaatagtagaccatttttaaaaaatcaatctactaaatacctgatcacgggcggccgttgatttatctgaataatcaacacattgcaatttagacagccatgttggtcttctttgcatgtacacgtcggccaactaatgcatgcatacctaagcacgtactgagtccatacatatgcatgtgtacatgtcaggagcaagcatattagttggatctttgtcttgttgttttctcgataccttggtagatatccgtgatcaatgatccttggaacacatgatgtcgggatggatgttctcagtatgcgtcaggggtccaaaatttggatcctaatcggggtgtgagaatgatccgagtcccaaaagaatccagtgaatagatcgagatgttgattttggttcctcgatggccggtgttctgagcaggcagcggcattaccgaggttaccaaaaatcagttgatgatgtcgcttccgaagagatggagatcggagacctcctagttgataatatcaagtcactgttctccgcggcagcgatgtcttgaagtttggtcgatctcgagagatcgagttgttgacgacgatggttctgatctcatcgggagacatattttggtcgggttagatctccccacagcgaagtcatcgagtagcttgttgtcggagaattcgtcttttgaacctatctcgttgaaatcctagagcaccaaaatccccttacctggcacgccactgtcgacgtttgatgtctcaactacggtatttggacagtatggggatcgttggtgctaggatatacacgagactgaggtaaaagagatggagacgaggatttttatacaggttcgggcccttgagctgtcaggtaataaccctacatactgttggccggagccggagttgcttttattcaccataatcacaccagtacaatatgtggggtagcctatctaactgttgtcgacatattggtctgaagatctgactcgtagtcgacaacagggtagccttcctcctcgaatccgtgcccggcgagatcagagatagcgttttcgtctctcctgatggtatccggagacaccgtaggggaatagccatgcctatctctgaagtcgatatccggcgtcttgtcttagagtatgttggcttgtatgttgtggcttctatgttgattgtgttgggtgttgattgtctcgtcatggtgggtgttgatcgtgttgatcgtctcatcatggttgtccccctgtactcctaggggggcttgtatttataccgataggtgtccccttgtccaagtagaactagggaaaccaatatggatacaatccgagtagttcttgtcgtttccatgtagaactctggttgtctttccttatccggaactcctcctatatctgcaggttgtttccgtataggacatggtatatggtgggtcctgccgagatttagtcaactactattaggtatgtggtgtacataaccctgacatatagtatttctatacatctaaagtttatacacctaaagtttatagacccaaagtttataagtcaaaaatttacatacccgattcaaatttgaattcaaatattttctatatataatatttctattcatctaaaagtttatacatctaaagtttatagacccaaagtttataagtcaaaagtttacataccaattcaaatttgaatttgaatttaaaatttttgtatatagtatttctatacataaattttttctaacttttgtttttttaaaaaaattgtgtggtgtcctgtagtgaaaggggaggaggaaggggaagaagaggaaggcaatagtacatggaaggggccagcgcgggcgttagcatttccgccttagtctcatccgtgtccaccgccccctcgtgcaacttgacaattttttttatttgcttgtgctcaacttctatctgtaagtcgatttttttctcggtgacacatcattcaactctacgatgtgctcggttggaactttttgtgcaaaggtcgattttatttggaacacttcgcatcattcttcttctgctctttgcatctcggtccaactttcgtgtacgtgtacctttatttccattccgaagctttggagacttatattttcttttttttttcgtgtaccttttcttggttttttttcgagaactcttatcttttcttgtggcgccagttttgtcttatattaattcttgacagatactccactatcgttggggcctctttcagtttggaccatcagcttgattgtggtataatcatcaccgggtaaaaaaaaaaatagtaacagtggaccttaaaacgaaaaacagtctatggtggggtggccgtgggtagcattgcaacaggcatatgattgccgcagaggttttttctttccctgttagagcaggtataaggcctctcacagtgtagtgacatagaccggtgctataccacgccaacgaggatttgtgcttgcgtggagcaaggtcgcgcgccctagttgagccccttggccccaagtaaagacgcgaggaactttctcgcagcgagtccacgcgtagcaagctccgtgcgctgtggagcacgtgacccagaggtgtcgtaccctcgcgccgaatcccatcgcgaaatccccgattcgccctcaaaaatcctctcccgattcaccaccgattcatccgctccaccgatatcgcaagatttccccaatcaaatccacgcctgttaatcaagaaccggaagaaatcaaggtggggaaacaaataaagaacccaaagaaatcaaggtggtgcaaacaaatcaagaatctaaagaacaaaaacgaacaaaaaaaaaagaacggcgtccattgcctccttcctcctacccgtctcgtcagccagccgccttcgtcggggatgcctcctgccgacgccgcgcaagccgctgccgccggggatgcctcccgccgccaccgcgccagtcgtctccgccggggacgcctcccaccaacgccgcgcaagccgccggggacacctctcgccaccgccgcgccagccgcctccgccggggacgactctcgccaccgcttcccatcggcgtcgcggagagggaggaggaggcgaggcagcgtgagtagtactcgaggaggcgcgcgagggctgttcgggaaaggaggacgaatcggtccgcgcgagtagtactcaatgtgacgattccttttcgtggggcccaccggctgtaggcttggtaccctgactatgggtgcttgcactgtgggaagggtgtccttggaccaagttttgaggctaaggctatgggtcccatagcttgcattgtaaataccctaagagcaggtacaatagcaggctataagccagctgcaaacatattttaaggagataaatgaggagagagaagggcaacgggctacatatttgtagccagctgtagcacggactccaagacatagtgtgtgtatgacaggtgggaccaggtattaatagtgtagtatgtaactattgtatgaatgagctattagattggtatagatgaattggagctagtagttggctatactattgaacttgctctaatagtactgaactcagctggcgctaggaaccaccacatcagtattatcatacgtggagggagaaagcatgagagagagcgaaacgagcgcttctgcaagcgccggacgatagcacggtaaattaggcaagatgaaatattttattcgcttggtgggtctatagttcagttacttgatcttatgtgcatatgcatactgtgtgattttaagtactagtttagtttcatgctgaagcaggatgggctacagagatggagtttagttttgatcacctgtacatgtaacaattagggcaagtactataatgacccatatattatccctaagaatgccacattggattaagtgatgatgtggaggagagaagtgaggagagagatgatgagccacccctaaatcaagaggtaacctccacacaaatttcaagaaagatgtgagagtattagatatattggtatttgtgtactagaggtgatacattgtatgggttgcctcttagttcatgattgaataaaatagataaatttagaggtgatagtcacatctaccatagcacttgactttaaacctattcttgcttccgtaaagcacatctagactctagagccaatcttttatataaacaatatacagtattaactttaaatgacctgaacatgtactaccgccgactactacttttcactattagccttgctcttatcatcaaattctcatggtttgattttaacccaaaaagcaacgtgcaaagtgaagtgaaatttcctttacggcgactgaggatgaacaagactagtcatcagcaacgtacagccgtcctcggaaaacataccgtcttgagtgaaagtagcaggattgcatctcagattctcggtcatcgaaattggaaagatgggatggccaaacgtaatttgcttccttctccagctcactgaccgaataaattacttgggcgtgtgaagtgtgaacacgccatccccaaattctcgactatgcctgtgtttagatccaaagtttgaattcaaacttcagtctttttccatcatattaacatgtcatatatatacaactttttagtcacatcatctccaatttcaactaaaatctaaactttaccatcaactaaacagagcctatataactgtgatttcttttcctttttctccttatcattacaattaacaggtaaagtgcagtagggagaaggggggaaatgaagaaaaatggcgtgtccaaaatgtcatccgtaattaaataacttgcacaatggcacactctcgcgggaaacagtggaggagcaacatattactgcctattgtgtcaccgctttatcatcaacaatgctactacctccatttcaaaatagctttgtttatttttttttaaaaccaaaataattttgtttatcatcaaagtaagaaatctcaatgcaattttatctagcctcggtatatttatccttcacctttacaaacaacaatggaatgacttttgaaagatgaaactattttaggataaagataatgagaaatgaagaagtttttggatgtaaggagtagagtacctatcttgcgaattgcgaggaaacagagatctacgacgcaaaatacgcaatcaatggcaactcagttatgtagtccggtttgtcaccgcaacgagctgttgcgaattccgaatcacgatcattttcggccctgtggagtacgttacggatcgattcaaaggaaactcgcgaatcgcgatcacttccggtcctcaccgtctttgtactacccgtatatcaacgtgtccatacatgaaattggtcgaatcgtttggatctccaaggggaccacgctggcatgataacgacccgcccagcctctgccggcggcgatgatgtgtggtgagtgtgtccagaaacgcaaaagcacacatgtaaaaaaaaaaagaaagaaagaaaaaagaaacgcacaagcagatacccttccacatactatatattattgcggttgtaggcgagaatcgtgaatcaaacagaagccaacggtgccaaaaaaaaaaaagaaaaaacagagagaggccaacgagcacaaggaagagcagagttctgaggcggtgagccccaatgtctcgagttattcggaacatcatcgtcgtggccatgggcgcgggcgctctgggcggaccagacgcgctgcgtctcctgcttgccttcgccgggaagagccccctcgtcgacatcctcatcgccgtcttcgtcatcgccgcggtcaccgcgcccgccctcggcaccatgcttctcgcgcgcttcttccgcaaaccgcgcgctgtgcccggcgcggcccgtgccgggcgcggcgcagcgggtgcggcggtcgctgatgacccgttcgcgcagatgacgctggtggtttccctggccgtcgcgttcctcgtctccgcgtccctgctcgtcctgccattgttccagtccgggcacctcgtcccgctcgccttcgccggagtcgccctcgtcgtgggcgcctgcgcctcgcgcgtccgcggcgtgcttcttccgaatgcgcacggtggagccggcgccggcgccacccctgccgcgaccgccacggagcgcggtatcaagccgaccctttcggtgtccctcgccgccatctgcctcgtcctcgttgccccttggcgcctcgcggtcggcatcctcgacgcgccatcgcagcgcctccttgctccgctcgccaccgtgcccgtcgtcggcgtcgccgctgccaccgtggtcggcaccacgatcctcgtcctccgcttccgcaaggcgaaacatgcggccgcgacgccggacgctgccacgacgccggccacggaacgctcccacaagatggtcatggttacggccttggcggttgccttcttcctcgccgtcccgctcgtcgtcgtcgtcgacgcatgtccgcgtcgtgtcttcggctgcgcctgttgactctgaagattcacatcgcccgatcgccgtgaccgagtcctgcactggcgacacgagtggtcgagtgctacttgtttttttctgttttcttgagggcgtaatactaaagtggtgtgcgtttcatccttttgcattttacgctgggagaacgtactcggtactcggtagtgcggtggtgtatgtacacaatgtgctttgggttcgtgtttgcttctctctttggagtagtgtctcggtcagtgggctgaactggatatcatctcgttgaaggaatgggcaagaaatggaatatattagggcgttcacagtgcgtgacatggcattcggcttccccctttaacatcagagattcccagccacgtgcacttctcacgctagaaactgaagaacgcggagccaaagaaagctccacgttcctcgtcaaagttgtcagcgattccatcaaagttgtcagtgattcctcaatcatcgtgcatagcagcgtctacacctcactccacctcaccaccggccgtggcggcggttcccctgccatgctcccacatcccatgctaggtggtggtggtcgtcgccggcgaggccaccacccgagctcgacgggtcgccattagcggcgaggacacctccggagccggcaagctcgatccgcccaccgacgtcgatccccgccgccgcgagctcgacagccgccggaagcgagggggaggggaggggactgaagaagttgaggacgtcgccggcctcatcgagctcgccgccttggtgtcgactatggcaggcagcgtcctcggcgcgccggccaggggaggaaggcgtcggccgggggaggagggcgtcgaccggggagggaaggacggcgccggaggcgccgactcccgtggcagggctcttgagaacggcggcagcggaggcgccgactcccgcggcagccgtgacagcgagtccgaccaccttggcgaccggggatgatggcgcggtaggactcgtcggcgagctggccaggggaggagggtgctgaccgacgccgccgcccgccgccgcgcatgccgctgccgtccaaggttgatcccacgatccgccgcccggccggaccgcccgacctccgcgacctctgtctccgcccgactcctgcggtggggaaaggaagagtgggggagagagaggggggaggggaaagtagtattggtgggacccactacaagctacttgtatgtggtcttgtggaacatcaaaacttgatgactcactgtgatggccttactgctagtactagtagaccagtaccattcgtgaattctgcatgcacccatgtttcgtaaaggaaacctttcttcgctatcattgcgctactactgctagtgcctactccctccgtcccataaaaaacgaatctagaaccgaaagtgacatgtacgatgaatctggacatatgtatgttcagattcgtagtactataatgtgtcacgtctgatactgattggtttttaatgagacggaggaagtactcaacccggagtttcgtctgcttctgctctgtccggtccctttcgaaccttcgcctgtgatggaaagttggaaactagaaaggccacgagccttttcttttggcactcgttttgtccattgttctttgctagatacctcatcaaaggactaatttgtatattacatttgaaggctctgggagtttggatcactagcttgattgtggtttagtgtctatcactagataaatgcctttttggttcgtcgtgtttgcctcatcccatttgccaaatttatgtgatcgagaaatacaaagcttttgttgaacttgaacatcatctcgttgaagtgaattgctagggcagtctccagccatgttttggaaagcaaccttttggaaagggcccacacagataacagaaaatctatcgtagtactccctccatctattgttgatagtcatatttccaaatctgaaaaaaatatttttgataggcatatttcaatacaataaactatcatcttaatgactttctcggatttaatgcataactatccattcttccacacacgattggctacatgggtattgagaaatataaatattaatgaatcgcttgtttacgaggaatgactagtagcatgtttaaatggatgataattagaattacttatccttagtctgtgtgacaagataaaatatgactatcaaaagtagatggagggaatactttgctatcatggggtacttctactaagtggggtggggctgttgagtactcttttttctgcttcgctcttcccctttccaacattcgcctgtgatggaaaggccacgagccttttgtcttggcactcgttattatccaatgttcgagttatttttttttcctgtctttagttgcagacttgcagtaccatatttgaggggtctgggagtttggatcgcacagctttgggggtgtttagatctagggctataaagtgttcgggcactaataaaataactaattacagaatctgttagtaaaccgcgagacgaatttattaagcctacttaatctatcattagtaaatatttactgtagcaccatattatcaaattatggagaaattaggcttaaaagattcgtctcgcagactagtcgtaatctgtgcaattagttattttttaagctatatttattactttatacatgtgtttaaacgttcgatgtaataggatgtaaaattttggggtgggctataaacagggccttgattgtggtttgccgtccatcagcatttcagcaactgtcatctcctcgggctcgttatcgtaagaggcatagcctagcgaaagttgtagtgattgtttgataggcatggtttagttccctaaaaattttttccaaaaacatcgtatcaaatttttggacacatgtatagagcaataaatatagattaaaaaaactaattgtacagttaggggagaaatcgcgagacgaatcttttgggcctaattagtccatgattagctataagtgctacagtaaccctcatgtgctaatgacggattaattaaacttaacagattcgtctcgtggtttttagacaagttataaaattaatttttttcattcgtgtccgaaaaccccttccgacatttgttaaacatccgatatgacacctaaaaattttcttttcgcgaagaaaaaagaccctatagttacagccaccagagtctcgcccggagcaacacggccggttcgattgccatatgatttttgcaacttgtttcctggatggaggatggtttctgccaaaagcgaagtgaagtgaaattttctcaacgaaagttttgtcctttcttatcacgatgcctggtgtgaacaaggctagccacagtttcttgtcatgtgcccatgccgtttctacaatactatacagttttgcttttctggtgctgcatgttggcctcgtattgcagtactatagtttggagatcacaatctttgtcccactagagtttcaaaaaaaaaaaaaagagagaagccaatgtcacgtgttacaaccatgcattactcgtattttatccatcttgtgtgcactggggaacgtcgtaatgcgtgcactttaagcgccatgtcgcacagcagaggggattctccttgcacacacaccctcaaggcatacanagntcnttgctcatggngntcaaagtgcacgcattgcggttgcggcattgggtcatggctggacaactcgggcacggcgaaaagcccaacagagcccaccggttgaagggcgggggccacgcaagcgaaaggaacccgtgtggcatattcggaaaatatgccgttcaaacatgtactcatactcatactcatactcgtgccctgccgccgttcacaccggattgctagtacggtactagtacctagctaccatcgaataattaactatttgccactcttataaatagtgctaaattatttaccactggacccacatgtcatagacacatgagggcccacatgttatagacagcgggatgacaatcaaataaagttagagataatctaaaatatgtcattgacaagcatccaaatccaaaaaatatcatcgacaaatatgagctccaagaaatacaatcgtacaaacgattttgtcccaaaaataccatcgccgtcagggttccgtccattccgcgtcgttaagtgctataggataaacaatgtatttaacagtgcaaaatggatggaaccctaacaacgatagtatttttaggacaaaaatcgtttgtacgatggtatttcttgggatttcttgtattcctcacacttgtacgatagcatttcttgtatttgggtgcttgtcaatgatatttcttgtatttggatatttgtcaatggtattttttggattatctcgtagaggttatgggcaatcgcccaatccgttctcagaaaagaaaaaaaaaaggcccaatccttgtctagctgtctggtccagtttgaacgtgtggaaatgtgagggaaatgcaatgtaaccgtctgtcggaaatggttcgtctagctgcatgtggaagtacattataagttctgtttacttttcttcaaactttcaaaaattccgttacattaaatatttagacacatgcataaagcattaaaatgttgataaaaaaccaattacacagtttgcatgtaaaattgtgagacggatcttttgagtctaattacatcatgatttgacaatgtggtgctacagtaaacatttgctaataacagattaattaggcttaataaatacatctcgcaatttacaggcgaaatctataatttgttttgttattagtctatatttaatacttcaaatgtgcatccgtatacgttaaaaaaaatttgaaggaggaactaatcacggctatagtagattgatagcgcaaagttgtgtgcgccattcaggtgcagagaaagggtacagaaaacgaccgtgtgacatcattttcttgcagggaaactgtttgacatggctcttgtatattcatgtgatcatccgtgaggagaaacaacaacggatgctgtcctccattgttgtccgcgaacagcatctgttgttcttcctcgcagatctatccacccccactcgctatccaatccaaccgtccgcatccaagatagcgaaacactgccgaaagccagcccgaaacggcgaatcctcctcacggagaaaaagggggtcaagtactgctcctatgagctttttcgctctcttcttccgcaggtcctctcctctcatagaactgtcctggcctatcttggagcgacggaactccaaatggactctgttttttcttttaaatacaaagaccaaagtatatgtgtcttaattgttcaatgtacttgtttctgtgtttgatgtgcggtgaagttggaataagaccaatccatgcgcgcgtccagattcgttgttaggattagtctttttttttatagagtagtatacttgtttttgctttgtcatggttacaaagtggtattatgacatgtccaacatttctcggtgtaaatattaggatcccgaatttgaaggttaaatgtgtaatggtgagcttggaagcaactattctagtacaatgtctaattgtggacattgcagagtaaccgttcactcgaactctacatagaggtcttgcgacgatgatctgcgttattgtataggttttctaatatacattttttttctgcgattgccgtttcataaacttttccggtaacctcttgtaagcgttttaagggaaaggacatcacacatgaacggaaatatatgtagtagtagatgtagatgtctatattcgttgtatgttacatcctaatactaggttatcttttttttacagagggagtaagacatatgctgttattgtatatcaatactccctcagtcaaaaaaaacttaaatcctggttataaatttggacaagcaatcttcaacccccagtggaatggagggaaggagaagtacatctactggtggaatggagtacgacactcttcaggacacctgtagtgttggtgggattagttcggttgactctttagttcgcactaaaattaaaaatttgattgaaattgaaacgatgtaacggaaaagttggaagtttttgtgtgtagaaaaattttgatgtgatggaaaagttaaaagtttttttaaaaaagttgggaactaaaccaggcctcaagcgaacaaaatttcaattcaatcgctacagtgtagaaattgatttgtgggattcgctcagtcttatccatgtctgcctccccctcgtgcaacctgacaaaaaaaatatttttatttgcttgcgttcgatttctatttgaaagtcgattttctaggtgacacatcattcaactctaacgatgtgctctctttttgtgcaaaggttcgattttagccaaaagtgggagctgctctttgcatctcggtccaacctctgtgtacgtgtacctttatttcccttccgaagctttggccattaccttttcttgtggcgcccgttttgtctaatattctttgacagatactccactatcgtttgggcctctttgagtttggatcatcagcttgattgtggtataatcatcaccgggtgaaaaattaaaaataacagtcgactggtcactagttaaaagttaaaatgaaaaacagtctatggtggtggggccttgggcagcattgcaaaagacattctggctcatagcagcacacggccggtttgactgccatatgattgccgcacagcattttctttttcctgttatcatcacattctcacggttgattttaacccaaaaggcaacgtgcaaagtgaagtgaaattttctttacggtgactggggatgaacaagactactccctccgtcctaaaaaaagacaaaccctgatttccgtgtccaatgtttaattgttcgttttatttgaaaaaattatgaaaaaaattaaaaagacaagtcacgtataaaatattaatcatattttatcatctaacaataatgaaaatacgaattataaaaaaatttcatataagacggacagtcaaagttggacacggaaatcaaggtttacccttttttctggggacggagggagtagtcatgagcaacggacagccgtcctcggaaaatataccgtcttgagtgaaagtagcagtagtggtaaaaatacatatatatagtgcgcaacagaagatgtgtcggatcctaaaagctagtcctgatcttctgttcatgttttctcgacctgtgttgttcgtcttctgctgcatgctggctacaggttggttttaggttgatttttttggttgatgcctaactttatctaattcaacctattatagatgtaacaaagcccataaagtatggtcataagtgtggtacaaatttaaatacactatttattctaaaatatagtaatatactttctccgtccgagaatataaaaaattttaggcttggacacggttattaaaaaaataggtagaagtgaatggtggagggttgtgattggatgagtagtggagatagatgggaaaagtgaatggtagagggttgtgattggtaagaaagagaatattagtgaagaagttgttatattttgggatggagggagtagtagtacgaatcgggatatactagtgatgagtaaagtagggcttatcacagctaaaataatcaactaaatgcctatcttaataaactgcaacatatttaaccttcgacgtggcaatatgtggatgaaccaaacatacccttacccttacctttttttagtatgctagtaaaatacttatcttttttttacatggaaaattatttttttgttcctatatacttttttcgtttcagaataagtttatctcgtatgtggataagatatatctgtatgggattaatttattttgggatataaggattatatatatccgctctcgagttaacgaacggcagattcttgacttcttggcactccttgtcggccacaaagttacgtacacactgcgtacacaagatcggtgcagtgcacgagccacctgtactttgtgcattgtaccgggagaggaattctggttgccccaatcgaaaggaaccagagccaatcagcactcagcactgcgagctggagaatcaggcgaaaagcccgttccacccgtgctgaaaaaacgccgttctaaaattttgatgactctttagccgtccacatttgcatggcataccttcgcccagaaggcacgaggcagagggtattatcacgagaggggaaaaatcactcgactttaccaatcaatatatattatactttatccgttcatgttataagacgttttgactttagtcgaaattaaactgctttaattttgactaaatttatagaaaaaagtaataacattttcaacccaagataaatttattatgaaaatatattcaattattgagttgataaactaacatagtattataaatattaccatatttgtcaaacttgaaatagtttgactttgaccaaagtcaaaacgtcttataacctaacacgaagggaggattattgaagagcgttattaaatgtaaagatacacagtatcagcaacaaatattaaaaaacacagctattactgagttataaatcatatttgtggaggtcttaattgctcatcaatcactccatccactgctacagaaatcatttttacatgcgaccaaaagtgaattttacatacggccaatgaaaatcggacttttgcacgcgagcaacgcatcttatgttgtcacctataccggccgcatgcgaaaataaattcggcaaaaaaaaagataaaaataaaaaaccccaaaccctagcccgccgcctgctgttgtcgtctccatcaaagcgctggatctgccacccccaccgcccgctcgtcaccaacatcgcattctccatcccaaccgcccgtcatcgtcgccggcactagaaccacgctgggatgggccaccccgccgtcggatccacgcgggacggcgccacctgaggccgccgagctgcccagccgctgcccactgccgcccgctcccactcggaggagaggagaggagagagagagacatcagtagacggagggggagagagaggatgcgaggtggaaaaaaattgaagtggtgagggaaagagagaggaggggaaaaaactatgaagaagagcaggatactttcacatgcggactaagtaagaggcctgcatgtgaaaatatacttatttttgcatgtggccccttaagagactcgacagtaaaaataaatttttgcatgcggatctcttaagtagctacatgcaaaaatgaaggtcgattttgaagttcccgtacagtaaaattattttttaagtagagatcttactatattgtgatttgcaagtttgtgacttcactaaacagaggacaacaacaaaaataagacttaagagggcacataatttttctacaatctgcaacctgctccaacaagtaatatgacaaatttttcaccaatgttcttttcccaatcacaattctccaccatttaattttttcacccaccttcactttttgtccaatcataaattttccctatttaattttatccaatttcttaataatcgtgtccctataaaaaattcctcaaacagagggagtagtgcagtagtgacgtttggagtgacgcagtttgtattgcgtcatcggccagtgcagcagtgacgtgtggtagccaaacgggttgaaggtttttctttcctccctcttttcaatcatggagtcgttagcgcaggcgcagatcctagctgcggcagccaatggagacctcttgtgatgatatgatgagcacgtacgtaccggatgtcgccgccgccgccacggtggtcggcaccacgcttctcgccttttcttccgcagggcgcggcaccggccggacgctgccgagggcggccacggaccgcttccacaggatggttgtgattattgagcctgtgtgttgttcccgaacaaaattttttcaacctgtcacatctaatgtttagacacgtgtatggagtattaaatatagataaaaaaaactacacatattacgtgtaaattgtgagacgaatcttttaagcctaattgtaccatgatttaacaatgtggtgctacagtagacatttgctaatgacaaattaattaggcttaataaattcgtctcgcagtttccaggcggaatatgtaatttgttttgttattagtctatgtttaacatttaaatgtgtgtccatatgtccgatgagacacgctaaaaattttcgttcgcgaactaaacaggcccttgcgtcctcggcggtttgctttcttcctcgtcgtcccaccccccgctgcctgatgtgtctgcgttgtgccttcgcctgcgcctgttgactatgaagattcggtggcgttcttttctcctgaagatggagattaagttttttacgtaaaacgaggtgatattaacgtatgattgattgagttttaattattataaccttaaaaaaattaaaattaatatgatatttagagcaaatttcatatagaaagttttcgcacaaaacaccatttaacagtttaaaaaacgtaccacaaaattttttatcttcatccaactcttggtggagaaatgaacgggacctcacataccatgcccggggccctgtgtcccgtgtacccggtaccacctgctgcagtgcatcgtgtgcagaccactgcccactggtgacactagtgctacggagtactttcttttccttttttttttttctgttctctttgagggcgtagtaactgagttgtgaagtggtgtgcgtttcatcctttgcatttttaatcgtgtgctgggagaaccgaggttgtgtttagattcaaagtttggatccaaacttcagttcttttctatcacatcaacctgtcatacacacataatttttcagtcatatcatctccaattttaatcaaaatataaactttgcgctgaactaaacacaacccgatatgtgaaatgtgatttgggttcgtgttcgcatctctctttggagcagtgtctcggtcagtgggctgaactggtcatcttctcgttgaaggaatgggaaccttttctttgggaaatcttcgtactttgctatcattgcgctactactgctagtgcccagtggagtggtgtgagtctttcgtctacttctgctctgtgcggttcctttcgaaccttccccctgtgatggaaagttggaaactggaaaggccacgagccttttctttgggcactcgttttgtccattgttctttgctagatatctcatcaaaggactaaatttgtgtcttacatttgaaggctctgggagtttggatcactagcttcattgtggtttaacgtctatcacagttcagcttgccaaaattgtggtgattgttggaaagtggcagccagcacaggctcagaacaacatgtccggtgtttagttccatgcaaacattttacaccctgtcacattgaacgtttagacacatgtatggagtattaaacatagacaaaaaaaaactaattacacagtttgcatgtaaattacgagactcattttttaagcctaattagaccatgatttaacaatggtgctccaataaatatgtgttaatgacggattaattaggcataataaattcatctcgcaatttataggcggaatctgtaatttgttttgttattagtctatgtttaacacttcaaatgtgtgtccgtatatccgatatgacacgccaaaactttacaccccctggatctaaacaacctctacatatgagtgtaagcgtgtagttagggttgacgaaacagatgacaatcctttttcagaaaaaaaaactgttcaaatgtaaccaagttatgtcaaaatttaaatattcagtttgatttttttctaacttaaccagtttaaaatgtgctctattgtttttttcttttttgaaatgtaaatttaccgagtggattgtgatcttagaacctccagatttcacaaaactggatggtttctaccagttttgtaaaccctgattgcaacattttgtttcatgtagtaggagtatgcatgtagcacagtgcacagatgattgatggtgcagccgaaaagcgacaggcacaagtgaagtgaatattttctccataatttttttgtatcccatgttattattgatgatggctggtgatgaacaaggctagtcaggccatgtcctcgtgccgctctttctgaaggtctattgccgacgaaaataagtacctactgaagttggagtagaatctgtcgtagtggcattctgaacaagtgttattcgtgcctgttgttgctgcatgttggcctgagattttactcttccaccagcaccagcatgtccgtaatacatcggcgaggttctggagatgagatgccgccctggttgcaactcggcggtgatctgccgacggaattcagaaaggcgtttcctgaccacgtttgcaactcgtgaaaggtgcttcctttcgaatgctttttgttactacctccgtcccaaaataagtgtagccatagatattcgtgtttagcattttgaccatccgtcttatttgtaaaatttataaaaaatattaaaaaaattagtcacacataaagtactattcatgttttatcatctaataacaataaaaatactaatcataatattttttcaaatagaacgaacggtcaaacgttgaacatgaacagtgctaaaactgcacttattttaagacggagggagtacttgttttctttcccctgtcattagtcattacaactgacagatttcctccttttgggatcgtgtgtgaggatttggaacaactgaacaacatgctgatcagatcagcaaggatcaccaattcaccactgtgtcactgcgtgactgtcgcgtgagacgagcaaataaatatagttctcttttgaaaccgaaaaggaaaaatagctcttgtggagttgtgggtaaccgtctccattgaccatgtttttaccgtgcccaaagccaatttctgctgctcctagctagcatcctagcacgacatgtttgcctgtagaaatccagtgacatgtttcacccaattgagggcggattaaggttccaaacttactatacttcgtaacacatgcgttgtcatgttttgtggtggtgccatggtacaagaattaaatttgaaaatatactattcattcaattttttctcagaaatatttcggatgtaaaattttttacataaatataccatcggtctcgcacaaacgttacgcgaaagtgacgtgacaatgacgtcgcggacgatatcgcgtgtgggaagggcgagaccgcgtggtctcacggattgaaaaaggagaccgagcgctgtcgctcattgcatgagcgataccgttcaatgacaatttaattagcggttaattatcctcattaatgattaattaataaataattaatcaccaattaggataattaattactaaattattattagttaattgttaattaagtatttaatcactaatcaaattgagcctttggaccgtgtcgctatttgattccgaacggtctcgctcttctgttccgcgagaccgcgcggtctcgcgctttccccgcgcgataccgtccgcaacgtcacgcctatgtcattttcgtgtaatggttgtgcgagatcgacggtatatttctgtaaaaagttttgcatcccgaatatttctaagaaaaaattgaatgaatagtatatttttaaatttaattccatggtacaacaggtgtgtgtgtggtggggactggggagtgattggctgtctctctctgtgtccatttgctttactaaaatctaaatttgggaggaggagacttcagggctgcaggaatt

SEQ ID NO: 64574 - DNA, 10555 bp, Oryza sativa
  unsure (1)..(10555): unsure at all n locations
tgagcgtgcgtgcgctgctgccgtacgtgtgcagccatgtcagccaggttagtcaatccactgtcaatttctcttggttctgaatttcagttctctcttttcctctgcatctcctgctcctttttgttttgagaccgatttgccctgccttttctgaacaaacgagtcagcttaggcaacggaaaaactgtttgccttactagatctggccatttgctttgacaaagatgtgctgtcgacgcggcccatagcctgatttgggaggaacaaattttcttacccatgtccttcttttcctgataaaagggcagcttgtgttgtcttccggtgcttcttccataatacaaaaacagtgtgtttctgcaacagtagtgttctgttcatgggcaacccaagaagggatacatgaaactttcttctgatacgagacatccgaatttgggcgtgtcctggtctcctggacacggcaaaaaaaatctgccacaccgtatctgaactctgaacagcacacgctctctcaactgctagtcctgcacatctgaacatgcctagagaaacaactgcttgaatggaaccaatccaaagtttagatgggccccaaatccggcctgcctatatgtgcaagcccaaaatttggactacaatcctataagaaatatactacacaaatctaccaaaaaaaacaccaatgagaaacttccgttaaatttgtatgcgaaaactttcgtagaaactctgacctacggcacaaaaagttcagccattctttttgcaccaatcaccattcccctccatttttcagataattcagcagtaggtttggtttctttcgtgcaactcttgcttcggcctcgtgccgacccttcaccctccccggattccaccctcccttcctctcctcttttgctgtagcctgtagtagcttcgtcccaagaaaccaaaccaaaccaaactgaagccgaaaccaccctccttcgtctcctcctctctcgagaaaccaaatcgatcgaatccgaccgaaaccatccatggcgagcgcccctacggccgccgcctgcttcgggttgctggtggcgatgtgggccatcggattggtctcctacctcgaccagttcttgggtgccctgatgagctccgctcgagctctgccgccgctcgacgttgctgtggaggtggtgatggcggtggcggcgatcggctccctcaacaccgccatggcgtccatctacttccgtgtctacaacggccgcgccgcagctgcgaacaggcggatgctggatggtgcgtgcttcgccgtgtgggcgtcggccagcgtcctcctccacctcatcttcttcctccagccgggcgccatggacggcgctgatcaagatctgctacctctcgccgccgccgtcgtccgcgccctccttccagcttctgcggcggtgacgttcttcgcctccatcatcctcatctacgcgtatctccgtagcggcggcgccggcgccggcaccggtacctccgtgaagctcctcaccaaggtgaccaactcggctgcgcttgtcacgattgttcttagcctcgtcgtcgctgccatcgttgtcttctactccgagtaaatttgcccaaagcttgtcgaaccaaccatcgatccaatcctataccgctgcagttcgttcgggtaagcgactttaatgtctcgagtgtgtgttcatgctttgtggtgtaataagaacatatttcgctgtcaatcgtatgcatccgagtactactcttttacgcataatctgattgtggatttgacgcaaaaacatgatctattacgggaactcaactcatccggttggagtcttggagatggcgcgacggtttggtcactttggtgcatgcagtgcagcagccgaggttttgagcgcccgcctgtcgaggcgggattaaggtggccgtgccatgccagtgccggcgcctacggcggctgtcgcggttggagaggtggtctagctcgcggcggcgcccgcgatgtcgctcggcggccggcggcggcatccactggtttccgtccatgtggggcctgccgggtgacggcctgaggctgattttggggttggttgggccgtacgtcgaggcgatggcctatgttcttagccacgaaataggtgggcacggacgcacgacggggggcacggcagccggcggcggcggcggctgcggcgagcttgccggaagaagcatcagctccgtccagtttcggtggaggattagcggcccaccgtcgccgacacatgtccttgtctggttcgcagcttctggtgtggattgtggagttgtgtcgctagtgcttaacctcgaggtctggttgctcattcgtcactttttgtctggggctttgacctttgttatgccgttgcgtttgaatattttcatttttgacgcgcactcacgtagatatatactgctcgcggcagaatgtttttgttatagcagtttggtttgcctctaattagcaaccgaaaaatggaagcaggggatcgatcgtgtggtctgaaaaaaaacagtacacaagcacctaccagtgaataataacgccagctggattttaacgccgttgatgagcaagtgtgttcatttttaacgtgatcatcagcctcaccgtttcgcttatgattatctgcacaatttaatactatctccattttttaatagatgacgccgttaactttttctcacatgtttgactattcgtcttattcaaaaaatttacgtaattataatttattttgttatgagttgttttatcactcatagtactttaagtgttttaagtgtgatttatatcttatacaattgcataaaatttttgaataagacgaatggtcaaacatgtgagaaaaagtcaacggcgtcatctattaaaaaacagagggagtagcaaataaaatataatacatggataaaacttttatatacatgtcattatcttgacgatgcaaacccttgatcccttgttcgttgtcttcttttttgccaccctatctatttagcacgagggattttgtggtacttgagaaaatacctataaatatcaaaatgttactcaagataagtagtaataggaagtattaatttttacaatagaaaatataaaatcttctaattctttctcaaagatagtaaagttacccatccgttctagtgaaagatggaaggggccaattctgcatgtttttttgttgattcacgcgccatgtcctcaactccccctccgctattctgagttgccgccaccgctgtccccacctgctgcctccctcgtccctgcccgttgttaccatcctcggctccccctctgctgtcctcgcccgccgtcacccactccaccgtcctcggctacccctccgccggctgctcgatgatggagagaaatgaagatgatgtgagggagaagagagaagaggattgagtagagagagagaggtgagggaaggagatggagagatgagactgacaggtggggcctgatgattaaaaaaagaagaagaattgctgatttgactgccacgtagaaccaaaaccactccggtttaagtcgagaggagggaggttaattaatttagccggtattaatagttgaggggtgaaggatgtctggtttttggatccgagggagtaattcgtactcacctaatacttaaggggtgtaattcggactgttctcttaaagcaatacgcaaggttgagagtttccattcctgaaatgactttttcctaagaaaaatatagcggggacgataaaataaatttaccctagctgcttgtccagttgtcttgttggaggataatttctgaactcattagttttcccacatgtacaagaaaaaaaatgcacagctcaacccatgtactccctcaattctgttatactgatttctgaagtactaaatttgtcacaaaatgtattgatttctagccgtatctatcattatttcataactcaagaagtttatctttttaataccccttatttaccacctaacaacactattctactatgaatgaaaggtacttcggtcttttttttactctactaaattttcttacgattctaacattatttagttcaactaaataataataataacattttcgacataaagcaaatatatcataataagaaaaataaattacaatggtgatttaataaaactaatcttgtgttatatatagaagttgctacatttttaaataaacctggtcaaattttaagagtagaaatttaacttatttggacagagggaatatttatttgagtaaaacatgcagccctgttactttaaaaacgaatactccctccgtcaaaaaaaaaaagacaaactctaggtttccgtgtccaactttgactattcgtcttatatgatttttttttataattcgtatttttattgttgttagatgataaaacatgattaatattttatgcgtgacttgtctttttaattttttttataatttttttaaataagacggacggtcaaacgttgggcacgaaaatcagagtttgtctttttttgacggaggaagtaggtcaaagaggataaatatggggatttgacatgttctgggcacggtacaaacttcctcacaagccacgccaagccacgcccttgcatgccaatgattactcgaaaacatctttagcagatctctataatagtaggatgtggattatttttataactatttaggtgacatgcacgaaatgaggggatattccttcgagtgatgaattctcctttatagtactccaatagtagtatatgacccatagtataaaaacctaatatgggatgggagattttatattactataaatttggacatactatctgtcaatattcgtagtattagaaaatatctaacccggttctagttttttatattttgagactgacggagtattaagccttcaattaactaattaatatcctgaagctgttggtccaagcacatgcgaaccttttcagaactggttaggaatgggcgctactatcccagtccggatccagccaactgcccccatccaacagagaacataccaacaatatgaacttggagaatttaatatggatatggatttgcttgcataaaaaaatcttattatttctccgcgataaaacagcaaagcaaagtgcgtggaaactcccgttaaatgatcctgcagaagcgccctcctcctcctcctccttcctcttcctccaatttccaaaccctaccaccgaccaccgataaaagtccccaaactctccactcgctcaaccgcacccctccagtttccccacacgcctctttcctatcccaagaaaccaaatctctcagtggtaccatggcaagccgcccttcggccgctgcctccctcgggctagcggcggctgtcgccgccgctgccgctgccggattcctcacccacgtcgaccggttcggtgaaaacaccttggttggagctcctccgtcgcgagacgccgctgtccagctgatgctcctgcggctgcttgtggcggcggcggcgatgggtgccttcaacaccgccgtcgcgctcatctacgcccgcctgtacaacgccggcggcggcggcgtgaacgggaggattacacggggcgtttacctcgtcctgtttgcgtcttccggcgtgctacatgtcttcttggttcctcagctagagccaggcgtcatcgtcgatggcgctcaagaacttctgcctcctctcgccgtcgccgttgcacatgtgcttcttccaactgctgcggcggcgacgttcttcctctccatgatgctcatctacgcgcatgtcggtgccggcggcggcgccgttggggacatgatggcgatcccgacgaccaccgtgaagctcctcaccaagctggtactcgctgctgcacttgtcactgtcgttcttaccctcaccgcgaccgcccttgcctcctacgccgactgatcagcatcagcatacgcatccatcgacgacgacatagacacggtctactggtaaggaatttgagcattttaatttaatttcgtgagacaggtgccggttatgcattggtaaatgtaagatggtgctcgccttgtgctgtaacaagatgatcaggctatgcatgctgtgactgtgagtgctgcttaatggttgtggatttgatgagagagctttagcagcacggccggttgtctcagcttgacgattgcactgcatgttttgggggatggttgggagttgggacgcgatggtctcggtaattaggcaatgtggtgcccttttatcggtttcttgcttcgctgtagcgcggcgacgacgacgagctggccaacttgatcgaggaagcagctggccgggaagatcctttgtagggatactttagattgaggggctacacctaggagtttcgaagagttttttctgttgtctaacaataacaacaactcaacagaaactagaattagcttgagtttgttggaatctttggtttactaggaataatatgcatggttttcagaagtaaattggtgtactctccactaacattacctttccaaaatgtttcaaattttatgcagtggaggaagctttttcggccggaagaggagagcaagctgaaaacaaaaggtggaacagatgaagcaaatgatgacaagattaagacctccaagagcaggagtgggatagttgtgatgtttgctttccctgtttatagttgctgtaggagttctactggttgtgtttagagcttgtgactgttgtcattggggtccttttgccgtttagagttatttagctaagtgtggtccctgtaattgaatataagtgcaatataactacaagttggatatacaataacacgaatcttaatgcaagattttatggatgaaaaagtgaaagataggtgccaaagatcttgtgaatgaaaagtgaaatggagtacaagaaaatacacgcgatttagaggtacacacaacaaatcgaaatgattagagctcaagatttccatgaaatatgccattttagagacccaattccatatgaattctagagacccaattatttattattgggttaattggatctataccaatacaaatatgacatttagataaatgacactactattcatgatatcgtctacgtgccgctagaatttggagaaattggaaccccgccgctccctccatatcattttttttttgctaatctaacaaatcatgacacgtttaacattcgacgtagcaacatgtggaccaaccgaagatgcaattgctcttttaccagtagtactccctccgtttctaaatatttgacaccgttaactttttagcacatgtttgaccgttcgtcttgttcaaaaacttttgtgagatatgtaaaactatatgtatacatacaagtatatttaacattgaatcaaatgataggaaaagaattaataattactcaaattttttgaataagacgaacgatcaaacatatttaaaaaagtcaacggcgtcaaatatttagaaacggggggagtatatgctaagactgtgttcggcagccagttttcccaaatcctctctctcatgtttcacatgcatgcttttcaaactgctaaatagtgtatttttttaaaacgtttctatgtgaaaactgcttaatattgatccatttttgaaaaaaatactagtacttaattaatcacgcgctaatgaattgctccggtttccatacacaagatattagttcctaactagtcctaacgaactcaacatgagtaaaaaacttactccctccatcccattttaagcacaaccatgagttttcatttccaactttaatcatccgttttatttgaattttttttatgctccactaatttcatcgttagaatgttaggaatagtcttcttgtttaaagaaggtggaagtatttgttttctttattgatctgctctcgaattaacgaacggcacatcatattcttgacttcttggcacaccctagctatcggccaccgtacacactgcatacacaagatcggtgcagtgcacgcgtgtaacaccctaaaaattcccgataataaaaatcactaaaattttaaactttttaaaacttttacatcatactggatgttatggttgttattgcttgccaaactgtaaatcgtctcaatagaaaaatcaaattaaaagatgcacatctaagtaataactaaagtttacgacaatatattgttaaccctataagtatttatgcacaagaacgcaaagccaaataaagcacaagccaattattagtttctataatgtagattacaaattgaatgttaaatacttgaaccatgttgacaagtgtcatgacatctaagtaactaggaaaatagtcgccactacaacgaccctatatataaaggagtgtttcactagaataattaaattaatatttatatgttcatcaagtctctcatgggatggattcactcatgtaaaataatttgtcatgcaaataaattgagctttatatataaaatgcgttctagattaatattgcaccaagtctcaatttaattttatggaataatagattaaacatgtccatgtaaaatacattgttatacaaataaacttgaccaatgtgctattgtattattaaaggtcacattagaatatttaattagtttttttaagaaatatcaaagcctatatgttatattggataatttaatggaaagcaaattcatttgggaactaatgaataaccaaataaatatttaaataaaacatttgaattctcaaaacccaaaatgtatagatgacatttcaattcaaacccaatcacattcacttttacagtttagccccaccctctccctctattccccttttctttcttttggcgcactattcattgtccgccaaccgttcgatctcggcccaacctcgcgcctctctcccgtgcgccgcgccgcccctccggtcgctgctatgccgcgtgcctgccttccctattcgtgcgccacattatgcgtgcccgtgcgccgcatcgcgtcacgccacgccgcgcgggcccgccgccgaccgagccgccgaaatcccgcgcaaaagctgcggctccacgcgcgcgcgtcatcgccgtcgccatcgcgcgtcgcctcggagcagatggataacggccactgcgccatcccgcgtcacccctagccctagccaactacctttggacaggagaaccgccctcaccaagccgccactctgccacagctcccatgtgcgcgcatcgccatggccacgtccgtcaccaatgatgtcccggcgcccttctttgtatccggtgggtaaaacgaagtccccttccccagctagggctaaaactcgcagactataggatatagggtgatgatggagccacaaaacctcaatgcccttatccgattgccattagggctctagctcagctattgtgtgttggcatccttatcctccatagttttcttacatcctaagccaagccaggccatcaaaaccccatccccctctgcctttctctagtcatgcatttcatcgaacaccttgctatcactctctcaccaccgctagagatcaccattgtgaggctccccggccagagctggaggttggagggagtgggggaggttccgtgctgccgccatcgccattgggggagcagaggaccgctggacaccgggaaccacgcgtcgaacactttcgggcgtcaccaacagctagccgcctctgcttcgtccgcaccgcaccacgcgtcaccgcccttcgccgtctctccatcccggggtaaaacctcgagcctatagcatcctctacacctctaatatctagcgtcggctccagtttgtaggattaatgcctatggctgtgctgccccagccgccgttccgccgccgacgagctcaccgtggacaggccatccccggtgctcttcctcccatctttctggagaaatagaacgcccgtacgccgtatatgctcacgcactcatcaatttggtcggaaacccttcctgtcgtcctagccacttgtagccgagctcggctatggcgcagccatggcggccatgcgccccgtccctccaagcgccgccgcagccggtgggtggtcgccggagcttctccgcacctcccctggccgccgccgggtcgccctcggccggccttccgtgcgcgccgtgttcccctgctgctcccgctcggtcgagaggaagaagacgaaggttaaagacgaccttcagccgagccactgacaagctgtcccccactcctcctatttcctttagaaacttaatcctgtgaaaaagaaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64575 - DNA, 827 bp, Oryza sativa
cccaacaacatggcagggaccttcctcttcgtgagaggaagtccttgctagtgaacagtagaggggaggagagcatgagggtgaggatgacagtccatggatggaatggatggggatgaggacaatatctgatgattttttatgatacttggccttaccttgatcttttaggggactttccatttcttcacatgcctttgtttatgagttgaaattgcttacgtaattctagatgactaggtttaatttccttatgattatgagtattggtaaatccaaagcggaacgattgtttctactgtattgattaatcattttcttggtgaatggctcagagtggaagaaaaagattggggagctgacttacgcaagttgtctgctggggctgctcttgttgctctaacattgtggcttgatcagatgcaagtaggtcttaaaaataatattaatttttatatggtgttgcattagttgattgaaagagaccaaatcaatgattaaaaacttgttttgagtggagaaatagtaaagtttgttcactagctttacttatagtgtattgtttttttgccattgtcatgactatggacagtacagcacacacttttgagtcaaatgaactataaattaagaagaatgaagtgactacagacaagtaaaatgtgtggaatgtaggctatttatctcagttgtagtgtctaatgcatttctacctttgtttgacattgtatgcaattttcacgtagagaatcgtgataggttttgtgacagtaacatgatgaagcattgtcctccttttttgctagtctatcggcttgaagcacaaa

SEQ ID NO: 64576 - DNA, 914 bp, Oryza sativa
ggcaaaatttatagggtcaaaatggaagtagatattttatcaagaaacaatacaaggctactggtgcaggtaagttgtataagcatgtggcacatttcactcgtacacccatggatgcaaatgcatacgagatgcaactgagaccacaatggatgatgcttacctgctcaaaacatgcatttcggatgcgggcaaaatcacgggcttctccccttgattctgagtacatgtttgctattgatttgcatataaacataaagagatcagtctatagttgtggaacagaataaatcatcaaacatacaggagggaaacacgctatccacacaaatgacttggtatatcaagatgggcattacctactgcatctccagtttcgagccatggagcagctcttgcactgctaacactttgaaacttgtttccagaagatgttttggtcgtagaactgtactgcttgggtacagaaacagttgaaacaccattaccgtattcaggacctttcttatacttccaatggccagaattttgcgatgcaagtttgcgaacagctgaaacaaaatcaccagtaccagtagatacagagggtgagctgcgtccattgaagatgcttagaatatctgcattgcctttggaaaaaccattttggtcttcaactgttggcagtgcggggaagtcccctgtgctaaagtttggtgtcctgggggtcagagttggattggaggtagcatcaacttgcatctgaaaaacaaaaatgatatcactagacagacaatgtaaaaactgttaaacatgctagtgcccgcagaagatcaagatggtcagcatgacaatgggatgcaagtgcaactgcaaccagttattgctgcgttcctaacgagctctaccaaaaaagagtaaatttcagaaaactg
